United States Patent 11,001,841 (CCCTC-BINDING FACTOR (CTCF) RNA INTERACTOME) - sequence listing, part 28

SEQ ID NO: 68575 - DNA, 1071 bp, Homo sapiens
gttaatgaaataaaaaaggcacaggctttgaaatcagttgtctaaatttaagggccagctctaacaatatacaaccagcaatgtaaccttgaacaagtcactgaacctcccagcctcagtttccttatctctaaaatgggtacagtcatacctttttcacattgttgtgaggaaattagattatgatttcagaggcactttgtgaattcctataagccttcatacttcttattaaaccactattgggatctctggagactgaaatatagtattaggctaagacagcagaattgtagaatttgtagatcaatttggcaaatatttagtagaagtcttctatgtgtgcagcatggctcgactctgtgggggaaaataaacaagtggaaagtttcaggtggccgcatggtatagcagaaagaatattggacttggggccaggaggccagggttcaatcctggctgtcactcagttgcctgtgacttggtatgaactgtttaaccttgatgagcctcagttgctcatctgtaaaactgggagaaatcaaactctatgaccttaataaactctgtccaactctaacattgtataatcagttttaagaggtttttgcctttagcagctgtttataggatttattctaaagagtagggaagaaatattcattgtataagagcttgtctgatgaagaagattgcatgaaaaagctacacttttttaataagtatatctgatgtaaacaggaaaaatgggtgcttgccagatatgtcatctatagcaacttgttttgagggggtctctgaatgctgacatgaaaatgactaggatcatgggttgaacgtgagtttgctcaagagaaggttctcttggggctttggtttacttcctcccagctgctccagggaacactcaggatatttccaaatggctgctcatttaagccattcccgttatggttctccttgtccaaattggcttccatggtacagtcccagtgttgactggttctgctaatttgattctttttttttttaatgtgctgatatgtagttttaggactgctgcattattgt

SEQ ID NO: 68576 - DNA, 1047 bp, Homo sapiens
gataatgttgtgatcatgtgtataaaaactttcagacacctaaaaagtagaaggtgtgattcatctctgttaaagcttaatctctgagcataacaaccaacatctggaagctaggcagccaacagaggggttaatttttctggaaccttggttgcaaaaggttattagtttgcagaaagactcagagatcactgtttatcttaaaccacaagagaatgtttttgaattcagaagaacagtgatatagttcggtaatttcatgaacctcttccctgggaaaccttatgactcaacagtcaaaggtgtccgaatagtaaagatggttttcagtgatcaggtctgtgcccatgcctggccttggatagactctgaaatgagattctttgtttgattgatggggtgatggtttctgttgtgtacatttgaaggaaaccagtttccccacccaaaatttctaaggagtttaatctttggggtataggggagttaaactacactgagtcaaggaagtaattgattgcatatttcctctaaaagtcagctatggacttgatattgactaaaacaaactagcagttctcttccaccaccaagtcagagcgtctgttcaccattctgcatgattaaaagaacaactaagaatggtaatgctccatttaaactttccttgtgattctctctggtctaccttcaatcaacaaaagcctaaaatttttattttagaatcatgatgttggaagatctttagattgctcataccataaagctgtttctaagattggtctcgggaaggtccaagatcaggattgaagtatgaaaaatcttggccaggtgcagtggctcatgcctgtaatcccagcactttgggaggccgaggcaggtgggtcacaaggtcaggagatccagaccatcctggctaacatggtgaaagcccgtctctactaaaaatacaaaaaattagctgggtgtggtggcggacacctgtagtcccagctactcgggaggctgaggcaggagaatggcgtgaacccgggaggcagagcttgc

SEQ ID NO: 68577 - DNA, 1060 bp, Homo sapiens
taaaataatcactgaaataacctttggtgcttagtatggtaccctggaaaacttggatctctagaatggttcatttcagagcttttccagatagccaagtttttattagaaaattggttggtatagacggtgctcactgtgactgttcagtgcatgatgagaatccttctttacagagataaaaagtgtgaagagaattgctgagaagtaaccattcattcccttctgcatttgcctagtgtgctgtgtaattaaatgagctgataaaatttacaagaaataaagctttatgcaattacaaatagatgacatgactttttaaaaggttttgcccatatttttcacacacgctctacctttagccttctctgctttcacacagatgctgaaaaacaaaagagttaattagaaaccattccttttctctctttctggtacagagaaggcttccactaagtatgtgctgaataaatgacccagtctgaaagttttaatttattacacagtatattcatagaactgtaactgttacaacctctagtttgatagatgtagctgtttttgtttttttaagttgagattatattaatatctgtcacttgggttgccagccttttagaagaaaatttggggtttatattagaataggttttaggttcagtagcctgtatccttttttactgccctgggacaacagcaaatattcacctaaattcattctgtggtgtaacactttagaagtataccagttcttccttgcaaataacaacaaaaagctctgaacaacttaatcacagagaaaaaaaaagcttttattggaggtatattgggcagctcattggctgataaggtagcagaagcaaaaggatacttggcagcccggagcttagctgagatggagccataaggacagttttattaggatgccaccacagctcggctgccagtggacacatgaattcgtgagactagcacctctgccataaataacatctcaccatccctggggaattggtcactcccttaagactcaaacactgtggcaagtgcatctaattgg

SEQ ID NO: 68578 - DNA, 1041 bp, Homo sapiens
caaacaacaataaagaccttgaggagggaaagtgtttgatgtattaaaaggaacgcgaggaagcaaatgtgtctaaagtgattggcaagtgaggaagagcggagttcggaaacaggagtggggcaagaggacttgggaggaggctgtaggccactgtaaagatactgtgttttttgtcattttctgagacaggctcttgcctcggctggagtgcagtggtgtaatcatagctcactgcagccgcaaactcttgggctcatgatccttccgccgcagcctccagagtagctggaactacaagtgtgcaccccgtgccttgctaattttttttttttttttttttttttggtagaaatgaggtctcactatgttacccaggctggtctcaaactcccagcctcaagcaatcctcctaccgcagcctcccaaaatgctaggattacaggcatgaaccactgcgcctggccgggactttggcttgtattaataatttgccaatgagaattgtaagcaatggattgacatgctctttgaattttaaggaatcattctagctattgtgtagaggataggaagagggagagtgggagaaaggagggggaagtgtgaaagtagagaggcctgttagggatctcttaataagtctggcaagacatgatggcaggccgtaccaagcatgttcctacctcaggcctttgcacttgctgacctcgctcgctgggatgctcttctaccaaatatatacttgaaccactgcgtccctccttcagagatatctgctgaaatgtgaggtcttcatagtaaacctcaccccttcacttgtataccctttccatgacattttttcctctataacatttatcaccatttgacacagtgtatattttacttgtttatttacttagtgcctgatttcctgactaggatgtaagctcaagaacagggatttttctgtttcgttcattgctgtgtccctgatgcctagaacaatgcctgcagtgaggaggtactcaataagtatttgttgaatcaattagggaa

SEQ ID NO: 68579 - DNA, 1032 bp, Homo sapiens
taatgtccttcttacttggttttttatctccttcactaattcatccgccctgcctcactctcctctcagtagttcagatgccataggtgtgatgagccttgaagcaagagcttctacctgcttcggtctgggcttcagcttggtgcccagctatgacctttgttcactttttctctccttcgggtgtgagtccctttcctgaattctggccttaatggaggacaatttccaatagcttcctgagaaagggtaggggggaggcaactttattgagaccttgcgtgtctgaagaatgtctttcttctttcctcatacttgatagattatttcctcatacttgatagattatttgtcttactgtatgattttagacatggggtaattttcccccagaattttgaaggtagcactccattgcattttttttcagtgccattgttgagaagaccatgccattccgatctttaatcttttgcataaacctttgtttgttgacttattgttccctggaagcatttttttattccccagattctgcagttttacagtaatgtgccttagtctgggtctgtgctaatcctgatgctctttcaatctggatattcatttcctttcattctgggaactgtcctcctgttttcttcattctttctccagaactcccattattaggatgtaggtccaataattatctttatttttcacctcttaatattttaagttcctcttggagagattcctcaaccttttttgtcagcacttcttttttttttgtttctgatatcatacttttaatattcaagtactttttttgttcgacttgttcttcattatagcatcttgtttttgtttcatagttgcaatatcttatttctctctggatgatatttttctttccctgagttgtctgttttccccacgttgcctttgtctggttttggtctttgttttgctgtctgccttctatactcaaacgtctggtgatccctgcatgtctgcccatttctgagagttgatggacccctcaagcac

SEQ ID NO: 68580 - DNA, 1051 bp, Homo sapiens
ccagcactaactgtggcagatattgtcctaagcactttacatctgctagctcattttatcctcccaagagccctttgagaagtttctgttattacctccaatttaagatgaggaaactgaggcaccaacggcaagcttgctcatgagtggtggagctcccctgttcatttaaccatgttgctgtattgcctggtgctgcttaccacaggtgcctggcccataggactttatgtcctggactgggcaaggttatagaagatgttttagttattagacaaagaaagccatgctgttccttccacacaccatctcattcaaaaccaatggtcactctgtttgggggccactaggagagatgaggttcagagaactccagtaaattaaggtcacaaggtcacacagatgaacagtggctaccactatcagctaggattcaacccaggtcggactctacagctggtgggatgcctcccttctcttagtatatgtgctctgttttgccgctcaggaggcaggaaagaaagatcaaggatgagtaggtgcctgtactcctagttaccttgcgtagcgctatgtgactcttacttgtatttcccaggcataaacctggctgcatggcaaagaaagccaggaaggcagcgttctccttttttgtgtagaagaaaatactcttgcctcagcagcagagaactgtgtccacctactgtttattttcctccccctttttctttttttcttcatcaaaaagatatgaatgctgagatcatcccagagaaatctagaataaataccatgagaaaatagtccctctggaaggcgtcttgtactcctgctgtttgtaaatgtgaaaagctcagcaaccgggcagctggatgggtataaatatagcccacagcactgacgcccgctgaatcctgctttcttagaggcacaatgggaacccacggaagtcagagaaggagcagtaaagcccagtcgatcaatcagcctctctctttctctctctccatcctggaccttagtgtgggcgtgaggatagaagcagctttaa

SEQ ID NO: 68581 - DNA, 1048 bp, Homo sapiens
tatggttaagctagtggtatcttgtatttcaatgataccttacggtttaccagttttcatgtaatatattaacctatctcatttaatcattacagtgttccttggtgtacagatgaggaatcaaactcagatatgacgaatcaaactcagataggctaagggtggaggtagaccaggagaacctgcacccgcatgcattcttctcactgcaagttcaggcaggccaggagatgaaagccagcatgagccagtgaataagcaattatctgacaaacccaaggccagcagaagtaagataacatctttgttcccctccatttcttcctatgccatccagccctcaacccctgctaccttcaagccctgttgatactcacgccctcctgcccacattccttcggtggggcactgaagttttggtggaggggagcagagcgaggaactctttgtttgtgcagtaaggacttccttacaggaaatttcctgtgatggaaactctggggaaacttcctgttggttaggccactgccgggggctgataacctgaaccacttaaaaccttcagggctctgctgctgagaggatgggatggcccttccctgcttctccaagtctgggagggcaagaaagtccaagcgtacagaagcctcaggaatctccctgggatggtattttccaggagctaaaagctatggctctcatcagctgatcttattctagaagaccagccctcatggttaaatggactgcttagatttataacgagaatggtacctgcagcgacatactagctggatgcattaatagggctttggaaaccatctcaaagttctgggtctggttcttcatacatcattttaaaacatattcctgttatattactctccagtgttaagggtttatgagcactgcaaacatttattttcagctctcacttatgaacttggaattctaattaatccttgtcattgtcagacatggttgacactgtatgctgtgtgggtcacttagcaccaagtgtaaatcatctggggtatgtcttgcagga

SEQ ID NO: 68582 - DNA, 1055 bp, Homo sapiens
attctttcaaaagatttttatcaggtgtttactgcatactctgaagtgctgggatatatcagtgaccaaaacagatatgacccctgccttcatgttgcttacagtttaataggggagataagtgtctaccaaggaattcacactagccagagagcacattgcccacacagcatccagagtaatctgttgtaagataaatcagactgttacttccctgtgccaaaacctccactggcttccagtttcatttggaaaccttctgagttctcagtatgaactgccaggccctgtgtgatctgaaatttgtaaatctcgtcaacctctccaccctcatcctccatcaccttgtgttctgctagttcctcttcagccaccctgatctttttgctattcttggaacacacaagtttatgttctacctcagggcatttgcacttgctgcccttctgcctatgaagctgtttctccagatactctcatgttagagtccctcaccttatccaggcctctgcttaaatatcacctccttagagaagcttccccaacagcattatccaaacgacaccttccttcactctccatcacctttatcctgcactatttttcttcttggcaattttcaccacctgacatgtaattttttaaaacactggatggtgacccttaggtatctattcaaaatggccattcttgtgcacagctggggtatgatgccagtgggtccacctgtagggtaattggatgggcctggctgtctcatgggagactccagagtcttttcttttgggaaggcaagtttgtccaaaaagaaatcctgtgggctcctccttagaaagagtcaatatatgatggcacttgagcttttaccatgaagatttccactgagttcccctatattccagagctgctcacccttgctccctcctgaacttggcgttctcagattcatcctgattccagcaagggaaatgtcctttcatctgcaaggaggtgcaggttgctgggctgggggagggtggaatacagccatgccacagatgctttattagtcttct

SEQ ID NO: 68583 - DNA, 1050 bp, Homo sapiens
tgaatctgccatttttaggttttcatgtttaaaaagtttcctgacaatgtgtctagcaatgtgctagacactgtagataatatacaataaaatattaaagaggcggctcgtcctcaaggaactttcaagcattcatacatttctgtttgattgtaacatatttattattttaaagaactggccagagagttgcatgttctgtgtagggataaatagcaagtttcaggcccctgcatttattggcacttacgtacatggtagtcctcacacctttgccggacagcaccaaaaatcctgcggagctcaactctgtgacctcaccctttgagcctggaaatcagcatgaactcatgatctgacaatcccgaacaagctaagcatttcttaaaagaaagcagtgacttttaataggtctcactgatggtgttccaccgattaaatcagtcaaacagaattgtcacattgaagattatcttgggtttctagaattcattctaggttttaaagatgcagacagattctgagggtcacaaacgtcagtttgccaagtatgtttaggctgtaaagttatccatgaaaagaccgtgtggtttgcatgagattgattgtgatcggatgtaactacattgctttttacagctcagtagaaaccactttcaattgcaaattgtagcagaagcaggcgtctacttaattttgatcttaaagaatttcaaagagaataaatgcacactaaatagtggtggattttggtagtatacgccaacatcactttttatttaacacatgcagaaatgtgtactggtagagaaaattggtagagtgaattaaagtacagacagatccacattgactttaaatgaatacatgcacggtcagaaaacggtaaccctgggcaggaatctttaagttttcagggctcattagacagtgagcaggtgaggctcaaggctgagtttgcaactgtgctgtgaaaactcaaaaatgaaagtttttttcatttctgagcctgttgaaaagtgggtaagaagggaaagggcagtctcataa

SEQ ID NO: 68584 - DNA, 1617 bp, Homo sapiens
tggcatagcttagcatccacatcataaagggctcagatcgatggctctccttgtcaagctctgcagccctctctcaggctttgtgagatgtggtttgcatcattttcctttaaggaaatgttatgcagaaacataaatgcagtatacaacgaggaggctttcaccaagaaattaaaagggtacagatgtctaggaatgcaggggttaagacaaaaatgtactgcagggaaagaaatgtgagcagaatgcccctcttttcgcctgcttctgccttgcatccagcccttcccggggagtgtgatgtgaactgccatccaaggtggctgtggtacaggggcagggtctgggggctgcttctgcagcttcagcgcagaaaacccagagctcagtcccagcaaaagcctaaaggagaaggaaacagaggccctaacacaacagaaaatgatgcaccccactttcctgtggttcatcagttcacatacttcccaggagaagtcaaatcacgccccagaataggatacctacttaggacttagtgatgttttatagtcatgtcgaagaaccttcacatccatggcctcatttgatctcacagcaagatgggcatgattaaaaaaaagaagttactcccactttccagatgagaaaacaaattcaaagacagtgagtgccttagctgagtcctatccaagcaaggcagggggcaaagccaggactaaaacacaaggttctaattccttctccatgatttcctgatgcccatcataccctaatagaataggatcaccctgcaaggcaactggtccacatggagagtcctcttggaggacaccgacccgtggtgccacctctgatttgcaagttggtgcattagacaagccctggaatgacagccagaagatctctattctgatcctggccctccgtctacttgggccactttgatcaagccatttagccccgttcccttcaggtggctcagctggaagtaagaatgataatgcccatgcagctgactcacctggtgactgtgaaggccaaatgagatgatgtgtttgagagcactttgcaaactgtggagtattgccagccatttctcctaatttggctcagggcagaaagacatccaggtgaagagcttgatgtgtgtgatgacttaggcttggggatatttgtgaacaggacacaacaaataaattcgtttgacgggcagagggacagtatgctgggtatagtagaaactcttggaacctgcagttattgaagggtttaaaactcaaaaatgatacagaaggcagttctattacagtttctgcttttttgctgttcaacacctctgaagatggtgcgtttaatccttcctgggatggcaggttatagatgacttcatgctgaaagtgacccgtaaggaatatccgtatattttgaagtgtatgtggttcaccaggcagaaaacagtctgccaagtctctcatcccaggcagaaggggtggcacatgcgaaggccagagaatgcagtgcctctgagaactgtcagatgtcagtgtggctggagccaggtctgctagagggtgaggttggaagttaaccaggagtttaggaggccctgggaagcct

SEQ ID NO: 68585 - DNA, 1052 bp, Homo sapiens
gggaaagtccctcgatttctgaacttcagtttcttctgaaaatacagttgtgccagctttagctccctcgcagaatagatgatggcatgacatggatgcggaagcatctggtaatgttttgaactgcacagagctgagtgtcctgaccatcaaagccagagctggagtaagtgatcagatgtgtcggggaggagaggggtgccaatcacagactgcagagctggctcagatgtggactgcctaggaatggaaatctttggctgtacagtctggcattaaacctggggactgttatgtgccaggcaccgtgtgcaaatcactgcaaaatccccttcagctacatgcatggacatgttaactcttaacacatgtacctaacaattcacaatttcatctcccagaaggtggaagatgcattgaggagcattgctaatttgcactcaaatctgacaaatgaggaattgtctggaaaagtagaaatgatagcagagggtgagaataaaaacatgattttaggattggggaagggaaatgagagacaagaacagatgtgttttcttgacttaagacaaatttttaaaatgtagggaaaagtatttatgatctcatgatctgaatgctgagacacaactcagagtcatttgggctgctcttgaaaatgaaatcctgacttatcaactgcatatgacccttattggaataagaaggaagggagacaactaaagaaactgatgaggcgatattggggatattctctgattagctcaatttttaaatagtttgtgtgtgtgtgtgtctgtgtctgtgtgtgtctgtgtgtgtgtttgtttgttttgaaatagagtctcactctgttgcccaggctggagtgcagtggtgcaatctcggctcactgcaaactccacctcttgggttcaagcaattctcttgcctcagcttcccaagtagctgggattacaggcgcctgccaccatgcccagctaatttttgtatttcagtagagacagtgtttcaccgtgttggccaggctggtctcaaactcctgacctcaa

SEQ ID NO: 68586 - DNA, 1060 bp, Homo sapiens
gggttcagatctccgcttctgtcattactagggttatgtgaccttgggcaagtcccttaaatgcgttgggcctcagtttcctaatctgaatccctatcatagggttgtgtgagcatgcagttgaatgagctaatatctattcatataaagtgcttagagcagtactaggtgcatagtagtgcttagtaaatgactattaagtaaattaaatcagcctgattagaattgcctccaggtgcaaggctctatcccatttagacacgctaacacacaaggtcttaagggctttaggtttaaggaaaaggggctttttcccccctcaattctacaccacaacctttttattctattgaattacaaaggaaataacagtgggacttgactttgaacaccaaagtttatccagcctctttccagctcggtgaacgtgtccacctacttcactctttatgctaaaggaagagcagcgacgctgataaatgtattgagtggcctcgagcaggtggcttgctctgtcaagatcacttttgtatgactgctgggatcaccacagtctcccctgtaacttgctgggttcctcttgtacataagccgagggcatttgcatcggttcctggtgagggggtttccacacggtggccctggttgcttcaggggctgggctgtgggagacattaatgggaagtgaaaagagaaactgttgtgcttaaccggcagagctgtttggagtgtgactcttcttgtatttagggaaaagattactcatgagtattttcttccatagaatataaagaacctcaaattactacttgcatcccccacccccttctcacccacctccctccgttgcagcgtgtcctctgcagaaacttcagcattttactctcaattcccctcccaagcaggattcagttctgtatttgctttggggcccatgtttccaataagccaccctgtactttttcctgtttctgcctgagcatcttctgctcactggacctctcacctccaggcaccttcctaggcctgaggaaccagaccttcacatgtgtcccctaat

SEQ ID NO: 68587 - DNA, 1053 bp, Homo sapiens
agtgcagtggcacgatcttggctcactgcaaggtccaccttccgggttcacgccattctcctgcctcagcctcccgagtagctgggactacaggcagaggatcggcatggcaaggtgcggcggtgaaaagtggaggcggggcatctgttgggctgcagtctacgagcaatagttgtgacattaactaaggtgaggcccactgagagacgaggtggttccagaaacagataaaaggcagagtctgcaggtcttggtgaccactttcatgtgagatgagaaggaagagaggccttaacgattactcccaggtttctggtctgatcatctgagcatttgctgacctaagaaacaccatctcatctgtagagatgtttgtgttaggcacatcaaatgtgtggtgcctatatgacctccaggaggaattacttaggagatcacggaatgtggttctggagttcagaagaagtgccaggctggagtagatttagcatagacgagccgattgaagccatgggagtagatgaggttgcccaagaagaagggcaggtgagagacctggggaaccttactactgaagggctggagaaggaggaagagcagagaagtaggcggaaaaccaggataagtggaaatctctgaagccatggagtattctaagagaagggaagtagagattgctggtgagaatgttgttgagaagtcaggcagttccctgagtaccaaccattgccctttggatttgacaacagggaggtgacctgagcaaaagcagattggagaagggtgggagtgggaaccagaatggaaggtgaggaagtggtgagaatggtgttggacagctcccctgggaagtttggctataaagggaggagagaaacaggagcagttcctaacagggaggatggggacaaggggcatgtacatgtggacaggaaaaaaacttgaaactgcttaaaagctaaagggaagaaacccaatagaagaagttggcaatacgactgcaaatggggacagtaagagctaactgtaaactggaaatgtctgtatgaaatg

SEQ ID NO: 68588 - DNA, 1050 bp, Homo sapiens
ccagctcagcctcccgagtagccgggacaatgggcacgcatcaccacgcccaactaatttttgttttttttgtagagatggggatctcactatattacccaggctggtctcaaactcctgggctcaagtgatcctcctgcctctgcctcccaaagtgctgggattataggtgtgacgcacagcacctagccagattcttttgttagtaacaccttttagatgtgatctcctccatatatgaaaattggaagaatacatcaagagagcaggctgggtgtcgaggaatgaagggacactggaaatgaaagaagatggagggctgtcttcatttacttagcaacctgctatagacaagacacatattctgtgttacttcacaagccaaaactaagaaccaaagtacagggattgcaggggaagccagattccacctcagcagagaaactttctatcaactagagctgtccaaaaatggtttgcttgcgccgtgactggctacccatcactggaagtacccagccaaagccacttctttctgggagaaggggaggtgggagactcttagtgagcaaagtttgagtcaatctaggaaacctctagaatcctgtctagatctaatattccaagttattactgggacacactatcgctgccaatcatatgctcacagtgcacgcacagcaagtggtccccgtccgcatggtggtgatgtgtttttgctgagccagccgcattccctgacggagcccctagttgctgaggaaacatgtctgtgcatggactgactcagctaaggccacactcctgggtcttagaactaagttttttcgtgacccagtacccaggacctcgggtccatgttcccacccgtagccgcctcatggatagcatttaagataactcccaataccttattagtctcctaataggcttctggtctaggtaggaaactggccgagtccacttgacccgcccctccccctgcttcctcctgcacactcgggaagaacccctctgaccctgctcccttggccagcgtcagtatgggag

SEQ ID NO: 68589 - DNA, 1040 bp, Homo sapiens
ctggtccaggacacctctgcatcttcctgcccatctccttttaataaaatgcccaagtgacatggtgtctgcagctctttgaggtattttgctttatttagtcatgatactaagtagtggcagaaagttatactaacagcaaccaaatttcaaaggtagaggtaggaacaaagtcaaggcaaaaacacaaggttccctcaggaatcccttagaatagggtatccgtggagttttatttagtgtcagtgatagaggagcaggagtttgtagaaaaaaagaaattaatatggaacgtttctcaggtccatgctgagcttgaaagaaaaaataatacagcaatatcttcaatccaaaatatgccttgaatttaagttggtaattaaaatgtttgtttaaaaaaagtcgctaaaattagagacaaagacccattgtttgttattactgctgactgcatatctgtgtgtggagaagggtgtgaggagacagtcacaggcctgtgatattgtaaagatttatcacccacccccaaagggttttgaggcacccacctgcattttcagcttggatctaagtcaaggggtgggacaagaccatgacaggttttggggtttgtttattttttgctaattactcgtggacacttcaaataccaaatatatcagaacagaaaggcacctgctcaacccagcccctgccatcctctggcaatggcctgacatctctagatgattttctagagattgtggaaccttggagcaatgcctgtgtgcatttttaaaggagggaagcatcccagaacatgccagttccttatagagtatcttgaatagttaccacctctaaccggacttgtgaatttttttcatgtttattcttttcccgtctaggattgagattggttaaaaaggcatatttttctctgtagggaaaatttctgtgaagaatctatgagttgtcattggagcattacaaatgttcttaatgacttcataattcttcgagtaatctgaagtgcaagctaagatagatgtaaaaagaac

SEQ ID NO: 68590 - DNA, 1026 bp, Homo sapiens
aatgattgctcatccccaagagcagggctaacaattttgttttgttgttggcaaaccaaaaaatgagaagtttcttgtttttcctaattaacacttcacaaaagagagcctgactccaggcgatgacaccacctccttgtgccaagcatttcacagcagggcccctcgcttccgtgatggagaacgaacagcatttcgtgcacgctccctgccttcctctcatcctttcctcccctcactctacccttgctaaatttagcagctgccctcctcccccaattcagttattcattcttttgctcttcctgccatgtgcatttccggcttgcataatagccaccagccactccagagaagaggaggtgggtttactgaagcttgacattaaggcaaggaatatattacctagcctgcctttcagatacaaagggtatgtgatgggttttctttctgtctcttagtctttctctcattattttttttgttaatctcatttggaatttagccccattttattcctgagtgtgattggaggcttatggtctctcctcctcacagatccttcctcttttccctttggcctgatttgactcagcagtaggtgtgtttgttgttctcatttgcaggagctcagcaatagagaaagctggcttactctgagagctgctcgcaaaccaagtaaatacagatgtgccaccgcatacgctgtaatgagctttctctcaagtattatgatgttggtggttgtgagctcagtaggtaagaggatggagctaatgaggccgaggtcaagggtgtcattgccctgcagaccagttagctctgcttcagacccagctcttaaaagtagtgcattttcagagaccattccttaaagctcatggccaggaagcaaggtctgagagcatgtccgggcgcatgtgctccagtgaacaggtgcacacaacaaggagagaagtgtaggtctttatccggtggtatccagggagaagagctttccaaggcacagaagtgatatgaagaggt

SEQ ID NO: 68591 - DNA, 1096 bp, Homo sapiens
atattttaactaatgcaaccaaatccaaatttaactcattccactgaaaggcattgtttttctccgaagaaggtaggactgaatcatccctaaagttccttccagctctgccagtctgtagtctgacagtcttgattctgtaaccctcccaagaaaacacaagagttttaagcacctttgtttctttgaggatacccctgtgtgtactccactcttctgatgtctttctggactcctcgatccttgtaaaattgattctgtttattggaggtgaaattcattgggtgattcctgtgtacaacgtaaaagttctgtcattaactgaatagccataaaaagcctttaaatctccgtaaagcagctgttagatgagaaaacttagttccttaaagcttttcaaatgagcacagcacaaaaagaaatgaaggtgctgctgaatgtcaaactgatgagtactatagctggagggtatagatggaaatagtactcatgaatgtggatcacaaaatgaagctaaattcttactattcagatatgatttgttcaggtgccctagaatttatgcatttggacaccttctgtgtataaggcactgttctgcattcttgatggggtggggacagcctcagagaggtataagacacagtctttatcatgaaagagctgagcacagttaactataaaagcgaagcacatgacatgtatcttagaagggctcctgttaagtaccacaggaggtcagagtagggatgtcagggcaagctacatggagggctggcttttagctgggcttggatgaatgcttagaatgtggacaagtggagattagagaaaaacaggtcattccagatggagaaaacttaccaggagcaaagcaagataaggctcggtgtattttttctatttcaggtagaaatgtaaatctacaagttgagatctattgaggtcatttaaaaatctatcatttttcaggctgggtactgtggctcacgcctgtaatcccagtactttggaaggccaaggctggcagatcacctgaggtcaggatttcgagaccagcctggccaacatggtgaaaccccatctctatcaaaaa

SEQ ID NO: 68592 - DNA, 1067 bp, Homo sapiens
tttttagacagtcagagaaaggagtaccttttcctaatttgcactaagttaacattaatctcggggttcagtagctctccagctgtataagatgatggagtctttctttatatacaggctagagttcagagtgaagacagctttaggaaaatggaatctcttacctcctccacttcttcttccaaaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagatgccttctgacagagttcagcctcttggagagtcttggggattgttggcacctaaacagaatcagtgacccgggtgctttgtggccagcagcacagaat

SEQ ID NO: 68593 - DNA, 1101 bp, Homo sapiens
agtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgtt

SEQ ID NO: 68594 - DNA, 1041 bp, Homo sapiens
tacatgtccagctaaaaattaggggttgtattgccatagaggaaggggagaatgtattttagcggacaactagcagtcttggtcaccagtcactcctctatctgttccttgtgtctttctaaatgccttatgtaactgtagaaggtgacttggtcaccaatcagtttgtggcaaagagcattacagggttctggtttagtcccagactttggaaccatttttgggggagatcgcttaatatgtcaataaccttccattccagaaactgctccccttccatgttagccgtgtgggtttatagaaccagagcagtgatgtcttccgagaagggcatccaaggtaatgaaggaactgaaaaatcacaccacatgtgggacagctgaggatatttagcctagaggagaagctgaagaaacaggatatttagcctagaggagagaagagtggaggatgacatgtttcatatatttgaagggctgtcttgtgaaagatctagatggacaagaagggcagaatccactcagtacatagaagttatagggaaagtaatataagttcaatacacagagagaaattgtaatattaagagctatctcagaagatatgagcatagatttactgctctgttcccattgctggtagacattcaggacaaaatagtcagcagagaaggtttgcttcttgccctgatggcagctgcagtctagtgaggaagacagaaatggctcagatcatcacacattcataaatgtatatggtaaagcatgacaattaggccttagaccattgactgtggagaagcaagggatagttgaccatttgtagacctcgtatagacaggatttgtgctcatgtagggtctaaattaaatgacttatgacctctcccagttcatttctagaaatggactttaagtagtgctacagtgggaagaacagaaaagatttaccttggagggcaaagtgaatttcaaatttgtgggacttctacagtggacttttgaaagttccacaataggtcaccattactaaacccggttgt

SEQ ID NO: 68595 - DNA, 1024 bp, Homo sapiens
ctgtctcagcctctcaaagtgctgggattataggcataagccaccatgcttagcttgaaatacatgtacatcagactatcatgtacatgataaataacatacaactttatctgtcaattaaaaaaatctagtatcaccactgaaggagagaactctgaatagacataatgatgagaagagaaaggaaaatgcaaatgtggggtcctttctatagatacataagacatttagaaatacacaagtaacagaagagtcatagatagtactgatcgggaggaaaattttttgttcatattgtgatgatcctaaagtgcacattttgggctcatattaacctctgaaattgggaagtctcttaccagcagcggtgtctcacaaacattgtgggccaggcagcagtcagacgtagtcattgtttacttatgtgtgagcttcttcaaagattggcacaatgtctgcacttcacttgggttatgttcattgtcagaagtacaaatgttgaatttaagtgggatcagaaatgtcttcagaaagattacattatgacactgcactgttgcatttgaaacgctgcaacctaaggcaggagaaataagcaaatctcagatttctaggtaacgagaggacagtgtgagtcattcatgtgttgcacattactatccttaatacattagttatatgtagtggtcctaaaataatggtgcatcttataattgatagtgtcttgaatatgatgaaatacggcacaaaattacttgattaagtgatatgtatggaaaatgcattttttccagaggtttcaaggtgtgtgcggcactctcttaggtctcttgctttgccttcagacttctgtctagtagtcccatgcactagtgaaggcctatggagaagaggtgggtaggtgccgacttgctctgaggctggagctgcttggtgttctattaatagtaggtcatggtctaagatagaagcattctaggaaaaagtttctaataaacttgcttttttttgagagaagttctgg

SEQ ID NO: 68596 - DNA, 1925 bp, Homo sapiens
tattgaaggtattaaaaatagccatcatctgtattaggtagcagttttggaggatcatctttttcttttgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaagtgtctgtcctttcttttcagcaagaaattaagacagtagctggttgtccttcgctgtttcagacacaaaacccagctttattgtttgcattttaaataatactctgccagtacacctatagtccc

SEQ ID NO: 68597 - DNA, 3478 bp, Homo sapiens
atttccctttgctaagataacaacaatggaatagttatgcccctgaggctgtctaccaaaatccagcctggactgtacagaaattgtacagaattgtacagaagaaagaaatgaagacttcagatgtcattaaattaattattcatcaggttaattttggagtaaagaatgttgagggaatgctgacatgtttgagtagtgtaaaatatgtaaaaacccattcttcccatgggctatgaaactgcagaacaaatttgaatagtcattttttattctgtgatacagtttaacttgaagatgtaagagcacaaccagaggctagattgaattcacctctgcattcccatcctgttcattttcacttgccactttcttatttgcaaataagaaagtacctgctattttcctcagcgaatctgccattgaaaattgcctcttggtctgtgtaaatttaaattgcagtagcttattgttttcatagggtagttgacatctaatacctctattctgagaggggaaatcatttttttttgtaaaactaactgcttctctttattttctccctataccagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacgtaaaaatgtaaatataaatttggttgagatctggagggggggagggagctattagagaaggatgaggcagaccatgtacagttaaaattataaaatggggtagggaatactggagatatttgtacagaagaaaaggatatttatatattttcttaaaacagcagatttgctgcttgtgccataaaagtttgtataaaaaaaatttgtactaaaagttttatttttgcaaactaaatacacaaagcatgccttaaacccagtgaagcaactgagtacaaaggaaacaggaataataaaggcatcactgaccaggaatatctgggctttattgataccaaaaataaaaaagaggaagaagaaaaattaagtccatctcagagcagcaaaccatagatacatggatgtagccagatagccttcagttaactaacatttgagggccaacaagtaagaaatgatgaaaggaaaaaaatgcaattaatactaaccttggacgaagggctttgttttctctaggaatccaacagtgctagtgaggaaagtagatatttctaaaaacccattctgggtgttgctgttgtaggagagatcagccctctggtaagatgccatgaagctgtgtgtgtgtgcaagtctctgtccctacctttagaatccatacctctgtcaaaatgaatttttttctctaggtatgtttaccttgctgcctcctccagcaacttggtaagtcattttgctaagataccatgatttttttaagctgaagcattgactaaatggaattttctaaattaaacttgattttaatatttcttctagctccattccccagtaggcttagctcttcaatttgactgctgtttttgcataatgatcaaaagttagacatattatttctcttcttccaagattgttttaatgctcattaaaatgtctttttacaacacatatagacaatgtttaagaattaaaaatttaaccattatgtttttgttgtaaatctcatatccttgcactactttcagcatatatcacagtacgaaatcatttatatatatatatatatatatatatatatatatatatatatatatatatatattttgtttgtttgtttgttttctgagtaaaacatttaaatatgttctggttagagacaatctatttaaaaagatttttttcttattaggattttccctatattaacagtttgtgatgttttcatgttctttagaccggtttttctcagaataatgtctacatacatacctcttctaatgtgtgacatgaatttaatatctttctgttacccactgtgaatgttaggctgttttcaaattatccacaaattattcttgtaatcacccaatatttttatgtgggtcctctcttacccattatggattaagatagtttaacaaatttaacaatgaggattaaatgagaaggcaaactgttaacttctcagctgtcagaatttgggtggaagggaataatggaagcctcttttgtgatctgcctgacctgctgtcatgtatggtactggggctgctacatcttgagctatcagggctgacctgtggaatgattctagcacttgctctgccaccttgccagaagttcgtttcctgctttttacacatgtgtagcacttctctgctaaaattgaatggttttaaactaatgtatttttagcttaagaggtgttggtcagttaattattgaattttttttttttcttttttaattctgtcttgccaaggcctctctgggtttcagggcccaagagaaaacagtggaagaaaggattcagaatttgggcaagggtgaagtaactgttcatgcaagttaaaaatacctaagtaaagtttttgaagataaaattgtggtttcagaataatgctgattgttggagactgtaagaatcaggtgcacttgattttgcatataagcaaatggtaaatctatcagaatcctaaaacagacaagcatgaactcttcccattgctggaactaagtgcccacagtgtcagacaaaatggacattgaacttggattctgtgatacacagggcacttgatgcttaaatgaagatggaaaggttagcaatacctgggtgtcagttagaatttgagaattctatatgtttacatatttaaatgtgcatcttgatctggtgggcttcccatgtggagacttgcactctaattaactaagaagaatattgccttgttggatctcagtccacgtgcttgcactgcgatggcaatggcctcttcttcaaaatactaatttgtgtgccaatttgtttaaaattatttgaaggcagttcagcctaatctcagtgttctctttctggggtagatgagatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgt

SEQ ID NO: 68598 - DNA, 1036 bp, Homo sapiens
ttgatgccctctgcttcttaaacgggtagctcagggatccagggaaggtgaatccctggggtggtgtcctcttctggcaatgtggcctttctttgtgagtcctccagtaatcaggtattaaagaccttatgttccttggtctcaggcaactagacagcctgaaggccagcagcataggggatttgagagctgaggcttatctttagcttccagttttcattcatcaggcctaaatgtcactattcaaatctaaaatctaacatgtgctcagagctgattttggcttcttcaccattccaggtaaaacatttgatgacttttctaggtttatcccttctggtcataaattttttcccgaaatcttggaataccgttgttcatttgtatggtatatagaatgaagtagaatggattttatctgtttatttatttaaagcttcttaatggtgtttaaatctgtacttcatttaccatctttgtttctatctgtttacaattacactttccaacctattgttttatttctgtcttcatttaagggtagttcattttgattcctaatgatgacatttatttcatatgtcttcagggcgtggtatgtatgtactcataaaaaagaaaagtgtttatgaattatcttcattaggcttatagcttcacatcctattagcaagccctcttttgattactattttgaatatacagttgtttttctattaaataaccatactgcattcttcattgtagatccgactgaagaaccagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggtgagtcaggatggatccattgagaatcaagtctttggtcctgcaagactgccagttt

SEQ ID NO: 68599 - DNA, 1490 bp, Homo sapiens
gagattacaggtgtgtgccactgcacccggcctaaaattttttcaatcaccatattagtagagttttaggagagaatatataagtaaacttgtgcttagcctaccatctgaatgttgactcaggcaatgccttcccatctggaatatctccccacttttcttcatttattaaaaagttggcattttgcttgcctctttcctgaaactttccttgatacttccaaaatatcagctaatgtctttgtttgactgaactcatgacttaggaaccgtgaactttctataaatatttgaaggactgttatgaaaaagaaggaatgagtatattttttctttttgagtgagggagaaactgaataaagcagggtggggggtatgaacacagattttagcccactgtataaaagaactttctcactgtgcaacaatagcagaagttgcctcctcagagtctggatgactctatgtctgagatgattagaaataattcttaccttggggtgagtcagtcattttttctaattgtgttctgagaagccaggtggggtgagagtgaagctgttcttcataaatgcctcaggtatactcagaactctgggtccaccaccactgctcctccagagaagtgccatttttatctgttgtatatataagttagggtttttcaaactactgttctaagttcttttctacatttctatgaactagaatatttactgcacattgggcacttacttgctcttgattgcatattaatatctagtttattggctgttttctagtgtatgtcttaccatgatttttaagttttgtggtagagatcttgttttttttttcttttctctacctgtagaatctaactggtagtcagtaaataattaccaaaagtataacttgacccacatgagtcatttctgttgaattttctccttttccaaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagtaagtgttaatgggataaagctaattggaggaatcatgtgttataataaattaatatgtacttttgtggatttttaaactctgtttccttgaagactttcatgcacttttagttttgccatttttttgaactctccatgcttttttttttttggagacggagtctcactctgtcgcccaggctggagtgcagtgtcacgatcttggctcactgcagcctctgcctcccgggttcaagtgattctcatgcctcagcctccagagtagctgggattacaggtgcatgccaccatgcctcgctaattttttttttttttaatttttagtagaagcagggtttc

SEQ ID NO: 68600 - DNA, 1895 bp, Homo sapiens
cggaatattgtaggatgtttaacagcatccctggtctctgcctgctagttaccagttgtattcccacagtcgtgacagtaaaaaatgtcttcatacattgccaaatgcccatggcggggcaatattgcctctagttgcaatccgctgctttagagatatttctagggtgtggttttagccacagttgtctccagtttagagaagatagttgccaccttctcactcccatctcttaatcaaggcattatcaggttcttggagcaactaatctgacctcagctctttttttcagcagcaggataacccaaggaacatttgagatgtgtattaacaaagaagcacattacccataaaaaaaggtatcagtaagaaatactccttaagacttgagagagccttctcagctgtgtgcccatgtaggtgtaagcattgtgactgattgcctcagggttatctgcccctggagtttaattttctctgtatttctttttttccctagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccgttgtggtaaacccagagaaagggtatgttactaaagtggcgttcagatactgtggcttctgagactctcctcacccttctttttcagcctgttatttatttacctttaagtgtcctgtgctccagcaaacaattcaatattctctatcagtttgtttctgcattatcttaacagttgtcttacactttctctgatttcactgcccagactttctttcctgggccactagtgctttaattctaagtcttaaccacacctccaggaccatttcaactgccacgtcctccaggaagttttcctcgatctacctcatcccagccagatgtgatttttgccccctcctgaatactcagtactctgtatctgtgcctctctaagttatacttagtcctttccaatttacgttacttttaattattttttagtcttgtatttaccactagacatcagttttctttatgatgagaactagtatgctttctttcatttaataaagagctttgcatttaataaatactcaataatcagttgtatctgagtcaatgataaggtattcagcaagtaaagtagcttacttcaaaagagaggaaaaggatgaaatctagacgttaaatataagaagtgatttatatgtaacttctttttagttattaaatagattaattagaaagaatttaaaattttgtgttaaggtctctctagtcactgatctttaatttgtcgtattattctgaaaacatatgtgtgcctatgtctaacactattctgttaatctatgaaagctccctaataacttctgtgtacctttgttgctactattaaaagtagtaaaagtgtcccatgaccttttaaaaatgtaaatatataaatagatatgtatatatttataaaaggatttttatctatacacatttatttatataaaagaggatttatatatatatacacatatatatttatataaaagaggatatatatatatatatttggatacaaggtttggctcgatcacccaggctagagtgcagtgacacaatctcagctcactgcaacctctgcctcctgggctcaagtgatcctcccacctcagccttccaagtagctgggactacaggcacacgccaccatgcctggctaatttttggggtattttttgtagaaatggggttttgctgtgttgcccaagctggtctctcactcataagc

SEQ ID NO: 68601 - DNA, 1054 bp, Homo sapiens
cacccaccagacagaataggttaagggttattcacttggtagaccaggagaattttgtatatcaaatacctgatggaaatgaagttttctgtggtatctctgtggacaagatggagaaaaacagggtaggtggctatgtcattaggtaaattcataactgatttggtaaccagagagctgattagtgttactctgaagagagtttttgagggcatgccaaagaattttgtcctcagccttagctcttcaacatctatgtctgttttgtatgaaatacatacaacaggctgatcaaatcattggatgatagaggatgtagggtaactagatttcagattttctcttttcttccttttaagctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccaggtaattgagagcttggttcaaaattcatttctcctgactaataactggactcaccaaccactctgtttcacttaagtcttgactctgcttaagtgtgtgtgtatgtgtgtatgaaactgaaattctggacctggtagcttattttttccttctgacgatattttgagtaagcaattgtttgatgatgatattatgatgaaaattgttaggcgtacttaagctgttgtgttggtaatggctttgtgactgccccctacgtttctttatgaagtctttttccttacatttctattgtatggagtattagaagccttgaaataggccttggttctgattccagctctatccctcacttaggattcttaggaacttttttagctgaaaagaatgcaaagcacatagctcttatgtgttatgtaacaggaactcaataaataacggttacattactaattaactattatttaaaaggttcagaggatatgaaacata

SEQ ID NO: 68602 - DNA, 2156 bp, Homo sapiens
ggccaggctggtcttgaactcctgacctcaggtgatccaccagccttggcctcccaagatgctgggattacaggcatgagccactacgcctggcctaacctttcagatcctcagcgcactcgcctataaaatagagataattttgtggattaaataacatttagtatgatatgtaatatattggaggtcctaaataaatttttcttttcctttcctcgtctcaaattttattttcttactttcaaaatcatagctacaaggctctccttgtcactcagtgcttctttctggcttttttccctctttttaagagatcaggtcttactgtgttgcccaggttagacttgaactcctgggctcaagcagtcctcccacctcaatcttccgagttgctggaactacgagcacatgccactgcgctaggctctattgcttgtttctttgtttcttcatatattattgtaatgagtgtttatttatcaagcacctattacatgctgcgcattacttcagccgttggaaaacatagcagtgaatgaaattcagtggaacagataataaactaaataaattatgtcaggggttaggtggcaataagtataatgaagaaatataaagagcaagaaagggtgatggtgacagggactgcagtgttaactggggtgattagggaagttcttactgaaaaaatgacatttatgtcaagaactgaaggaagtgaggaaatgagctatgcggatactgggagaaggcctatcaagcaaaaggggatagtaaatgcaaaaggtcttgggggaacatgtccgacatgttagaggaacacctaggaagctagtgttgctggaatgaagtgaataaagaaattagatcagagaggaaatgggaagccagattgtgtaatcctttattcagtactgaagtggcctctgtggcatctttgtgcaaattggaaaaagatgtttcctctgagcagatttagccctacaggtgtatggcgtggctaaggaagtgtggactggatttcagttcctactcaatgcccctggcacagagcacaaatggtacagtcatacatgatggtcttggccttatagtttattctattcttaaacaagagcaacacctttgtctaagctaccagtgaacacatatgccttcagaagagaactgaaaagctccctcctacgtacatctcatcctccagcttctctgatgtctccattgtgggaatgcgagactcaagacaaccagatgaggtcgttgttaaagcaccattctgaaggaaatgtgagagaggtggttagagtttaataaatttgatagggtggatttaggcttttaaaatggcatattctttgtcattttaaacactgacttgaaaataggtcaaaatattagctgccttttagaaataaccagttaatttgtaatttttaatatatttgagtagactttttggagcaggtatttatttggagccacatatggctttctcttaatctgcatttctagaacaacaagatccacaactaattgtggaatcttattgaaggttaaaattttgcttggaaaagagagtacccagcaaaatatcctaggagccaaatatatatttgattaattgcttcccaggcaagaaaatatgggaactaaaactctgggatctttcttctaagtcttttaaacagaagggggtcttgctgggttgttcaggctggtcttgaactcccagcctcaagtgatcctactgcctcagcctcccaaagggctagtattacaggcatgaaccactgtgcccagccaatttagaacctttaaaaatttttttcttgctttactaagaaagtagtactgccaaaatataattcttttaaaataaaaatgatagtgggagactttttagctattctgtgtgatgtgtttttactactcgaagtatggactccacaaaaattgctaaaagttgttaaatcaatgtattagtatgatggactccagaaatggagatttgtagtaggatcattgggataactttctaaatcttccaagctgagtgtgggtttttaactaatgaagaacttaaagcagaattgcagttttgtagataacaagtttctttgtgagtactgatttcctttgggatttaagccagtatt

SEQ ID NO: 68603 - DNA, 1105 bp, Homo sapiens
gcccatttcttggtggatagacaagaacaaattggtagatacgattaagaaataagtagattaaatcagaaagagtagattatgggaggggtgtagggtttgggtcaatatgatggaaagtaacaaactgctaaggatattagaggtaattaactattgacatgactttcttttgtgcttgagagaatgtgtcagaattcccataggaaaaatttggtctgttctgatgccaacttcagttgtgaaagagaaaggacacaagcatgtagtggaatgattaagaggttatactttggaatctctgccacacattagcttttttgctttacacaagtaataaattctttaagcctttattttttctcatttgtaaaattggaataataatagtaattgctgtatagggttgttatgaagattaaagataatacatggtctgatttctggggagaaccagtagcagggaagtcagttagaccagtgtggtaatgcaggtagacctggacaatggtggtggcagcagcgtgtgtgttgaagagaggttgatggattcgagatgtatgtggaagctagagcaagcagaagttgttaatgagttctgtgtgggaaagaaagggaggaagcaaggatgacctctagattatgtgtcatagatgatggactatcatcggagaagagacatgaggttgaagatacaaattttgggattaccaggatgtatttaaaatgaatgaggttacctaaagagaaggtatagttcaagagccagcagctttctctcataggctttgtgggtgtttaggctgtctcacacctgctgaactctgcccagctctcgccatggcagtgtgagagcagcctcaggcaatacattttaaaaatggaagtggctgaattccagtaaaactttattacagaaacaggcagcaggccagatttaacttgtgggccataacccccatcagtgggctaactctgatggagagaaaagaaggcacttggtaaactatgcaactctggttgaggaagagaagttcacagagaacactgagaagtagcaaccagagaggtaagaggaaaagcgggagagaatagaggcacgaag

SEQ ID NO: 68604 - DNA, 2996 bp, Homo sapiens
agcaactttgggaggccgaggcgtgggcagatcacaaggtcaggagttcgagaccagcctggccaacatggtgaaaccccgtaactactaaagataaaaaaaaattagccaggcatggtggcatgtgtctgtagtcccagctactctggaggctaaagcaggaaaattgtttgaatctgggaggtggaggttgcagtgagccgagatcgtgccactgcactccaccctgggcaacagagcaagactccatcttggaaaaaaaaaaagaagtaaacagtgtgaacatataaatatgtttactgtatttgctacttaaaataatttccctgaagtgacattgattccatgattagctagtaattcatctagtcagcactgacatattgtggtgatctttgctctaaacattagctgccagacagataaatttaatagttgggactaattggttgctgctggcaagtatgaaatttctctcacagttgtttctctttggctcttgtggtgtgcacatgcctgtcaaatgacaagtgcaaatgcatataaaggcaggacaccttcagttttcagaaaagcatgttcatacattgctaccaagtcagctatcagctgacaggctgatgagtgaatatatgtcctcaggtatttcgtgagagctggcatgtgatgtgcttttttagttccagtattcaagagtctcaaaaactagcacctcactagtttacttgaaagggcatttggccaaggattaggttctagttctagctctgtcatctaactggcttgaagacattagataagttgttcacatttcttgtagtgttttgggctcttcatctataaaaagcctatactgtaggattactgtaagattaaagtgcaaaactcaaaaatggaaaataacagcaaagtaattattctaaaatttcacagagattgttgtagcgtagtgtagtgttcattgcccagtggacacatcaaggggtgagtcgttgttcttaccatatagtatgctcccttggaccatatgaccaaatacattttcaagctttgcttttgacttcagttaaaggcttagtatttataattacctttcatgtacttctgcaacttattttgaggaagagttgattacacaagtcaaaaagtaagttcagcatattaaaaactcaaattagttaatattcaaaagtatataaaaatattttactcagaagtgaaccagattctgagaccagagctttaaacctttgctgttttcttgaatgttaattttacaaatgccagtactgcaataaactgttggtttatttccaattcctaggtttggatggaacaaatgtattggaaagactaaggaaagctgactcacttcctttttgggatatggaaaaaaatatttagtttagggtgccaaaataattgaaagcattgtagccgtgattttgtttaacccatttccttgatttgctgtatgttttctttaaatttatttagttactttgcatgaatatgactctttcccccagataataaaaaattgaaatgttaaatatttattattttgaatttagatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttggtaagctttactactttttactcaaacagtatattctttccatgcaaatatcagtggctgctatttatcattggttagatacttttaatacaacttcatatgaatgtgtccattcttcttctgttctggaattgtatcctgtttgttattaatagtgatccaggtacttggattcatctttttattatgtgaaagtttcattattattggacttgtaatgaaatttataactccctagatactcctgaaatgacttttgtaccagtaaaatatatatatttccatcttttccttctatagttcaagaagaaaaagtgaactgtagacccttatatagagaaaataaaaccacatttaaagtagaccatttgcaagaattttaggaaactgagtgatttgtagcaggaatataagtttgaagcatggggtcagaagatagattgatttcagagaattggtctcgttttagaattgcttttaaatgaatttttctattttaaattgcttacaatgtaatgttttatatgttagggcttttttttttctttttgccagcaagacacttgtattctcacatatttcatcactctgcttctcccctgtctactgcctttctgaaaatagggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtggtaagctgcatttccctccaaagcaagctagaatgagagaaagcagcattttcaaagtactttagtgtgtgttttttctaaagttaaatagtgtggaaatccagagggggttatttgtttggttaaagggtaggggaatgcaagtgtttgttacttattacttgtttgatgatagcaatttgatgttatagaaaaattaagtcttatgctggtccattgtcttatgtccgtaacccagcactttgggaagctgaggtgggaggaatgcttcagctcaggagttcaa

SEQ ID NO: 68605 - DNA, 1053 bp, Homo sapiens
ggcaaagctctcaagataaaataaaagatgttataaaacaaaatatatgataaaataatgtatatgaaggtacattataatttgaaaacaaatgtgcaaacttaaggtgatgatactgtatttttaattttgccacaattgtttaatagaagagttgcataatctaaagttgccagaatttttagaaggaagagtaatatgagattggggggaaaagtggtcaaatagaggcttatatggaaaatttgaaatcatttttataaaatcatcatgtaattttgagaaagcattgtaataggaataccaagatgactcttggatttttatacaacaggcagttggatttgttatttttagctgaagaataaatgcataattcatccccttctcttttgaatttaaacctgaaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggtgagtaactccaaagctttcttagaaatgggaaccaggaatgaaaaaagatggagatagtcagcagtgtaaattattgatgttttgaggcaattttgaaaccttctttactgcccccccgccttttttttttttttttttttttttttttttttttttactgagaagggaccttttaaacgttgacttactactctagctacccagtttgaattgaagggctgaatacacatgcacaggcacaccttcatcaaaagaattcagtctgatagtatgaataatataccttactttaaagcttactgtggtattaaaggaaaatacttcaccatgcttttactccctattaatctgcatattacttgtttgtgatattagaattgaaacttgagattgggagcaagacataatcataggcatttgtga

SEQ ID NO: 68606 - DNA, 1025 bp, Homo sapiens
gccattgcattccagcctgggggacaagaacaagactctgtctaaaaaaaaaaaaaaaaaaaaaagtttgggctcacactgttgtatatgtgtttatagtacatttggaaagaaaagataattatttggtaaattatttatatagcaaggtaagacatagtaaacctatgtgtcttgagtggatcacatgggaaagtctcactgtgttcattcatttatgctacctgctcgcttagtggaaattctttagatcagcttctcacttcctcttttgtaagtggtgatgtgaccagatgctggctacattagggaaaccagggagaaggaatggggaattctgggtattagatgtgtttttatattgtacagagttgtagaaagaatgaatagatttaacctcaggtttataataagcttcgggaaggagggattgagcgtagggcattgctaatgatgtcacattttttaaaagatggttgtggtatttggctcctgctttaatagaataacatatatgtgagggtatgtctgttttccctacttgtcaggtgatagtggccacctatctgtaggtgttaaaatttaaaaggtgcctgctagtacttgtttatgtctcttcttcattatgctgaaatgacttcattgccttttgtggacaaacctagtttacttgtctgcacagtacttctgccaccaccccccctcctgatttttactatattgttgtggggccttcccataataagtactaaagcattagcagaaagaataattttcatgtttttgatagaggaaagatcaaaagcctttatttctattttatatgaccctgcagtaggcagaacaaccttgtttcttaacagcattcctttttttttttttaggatcaggttttactgctgaaaacgtttgttgcactgagggcctgtagtacttcttactaatagccaagatatatcgttgataatttataggtttaaagcatttttgccatggtgtaaaattaagaatgtactattagctta

SEQ ID NO: 68607 - DNA, 1049 bp, Homo sapiens
tcctaagttaggaaaacaaagcccacatgtatgtgtatatctatatctatatctatatctatatctatatctatatctatatctatatctatatcttttattgctgttaactggtgttggggcagatggtagaatatattaaatattatgatggttacatgcaaacaattttaaaattgatttatgggctgtgtgggaacaagactaattaaccaaagcttgggaaaaaatatttaccaagtggtagagttaagtttgtggcaatcaaatagattatggtgaaaataatcagtgattaatattttatcacagtgttttattagtggcctatatccctgatattggtgttaagtctaaaattaacaactttgaattagactttgctacaggtcttatggatcacatagatagaacagagttaggtctcaattttcctttgggggaaacttcacatacaaggatggctttaaatggctcttcagagagacactgtacacatctaatggacagaaaattcagactctagaacagttgttttggaaaggtattctgtagagtgcccatgaccctgagggaataatgacttcaaggccttgcttccaaaatggaaacttggaatagaagaaaccccgttagtattccaccaggctcaaatactgaaaacggcatctgttgttcttgcagctggttttcattaatagaaaattttgcatagactccataaattttctccctgttagtatttcactgcctcccactcttttcaaatccaagttgatgtttgaatcttttaacagttggagtgcattgctgatgagacaaaggttatgagtttatgtttcagacaggcttttagcttcattttggtcagcttgaatatagattgcctacctaatcccatctagttcacacctgtggattatgaactatacatgagtgtataggtacgagtatgcttaggaaaacagtttaaagcccataagttttagaagaatatctgtagcaagaaaatttacgtaagggaatgcaccaaatttattatcatgtag

SEQ ID NO: 68608 - DNA, 3847 bp, Homo sapiens
tttaaacctcagcggtttttttcccatttgactctgtacttattgtctataatgtgcaaaatagcacttagttttattggttttgtttgtttgtttgtttgtttttagttttgctttttgttaattttgtttaactgactaaattgtaacctcttttagggcagggatctcctgctttacttcttgtgtattcctctttggttacaaaatactaagtaaattcacactgattaattcctgtctttgcagatggtttgatagtcaagcacctgcatgacatttggtaataattttggcttatcacagttgttcatgttatggttgttaacctttgtgtacttagtaatcattgatattaatcaatgtgatttatatttgacagccacaaatccatgtggaattgacaatgggggttgttcccatttgtgtttgatgtctccagtcaagcctttttatcagtgtgcttgccccactggggtcaaactcctggagaatggaaaaacctgcaaagatggtaagaagatattatccaaaatgaaaaattttataactattggaattcttcatgatttgttttctctataatcagctctctaggttatactgctttgggagaccagtcacttaatttcacagtcttcacacatggttatagaataggagtgttttgttctgtggcatcacttgaatgctattttataaattattttagtgttttaaataacatatttttgaaaaaagttacgtgttgtatcttttctgtcaaatctcatagtcattgatatcacagttgataactatggaaatgagtagtcgcataaggaatatatttttaacaggtagcatttgtgaataaagaacctctgtgaaagaaagtatgtttattaaacttttagctacaaagaatatcatgagatatattttataacaaattatttaaggatgttttaaattgctttttaacaacagagagatgctttcagagctgggaaaaaaaatccatatttaaaacaacttctttttatacttaagaaacacactttgcctgttctccttactcttaattccctatagagagagggcacgttggagaaagtatactgatttaggacattttaagggacttccagtttggaagaacaccagttcttctgtttttcttcttaatgagaatgttattcttcattctcacccctatggatcaccatctggttctctagcaaccagcaagacctggtaagaaaattgttgtatttagctgtggcttctttatctaactctgaaaagcagaagcctgtgttttggagtgtgttagagtccctggcaagggggccagggagtcagagagatggaattgagtctgtgtacaggatgtttgttatgacttggcattgataaattatcctcatagtaaaaggtgaagctggctgactcttggtcaaatggtttccatggcagacagcaatttggtttcaatttaaaacaaaaggtttttgtaatgttgcttttttctttaaaaatgtagcctgactttaaaacagaggatttattttagcaataatggtctatctgctccctcacagcagtgcaagtgtacatatttaaccagttttgaatttcatgtgtgcatttggcatgtagtagccttaagttaactgttctgttttgatcaccttgctcaaattaacagctctatgacttctttgtgaagttctaggctggctccttttggttgttagccggggcagtgaattgtacaaagttattcctacttggttcctgcagtggcatttgggctgtattttcttcaagttggaattcatttataattagctctagagtgaaagggctgatattgagaggcttcactcctcttctcagttttttgacttgtaattgcagattgattcttgaagtttatatgccagtattttgttttggactcatttatttagctgggaatcttttcttattctttcagttgtcaatttgcttactgtcttttattagcttcctatagttagacgattttttgctggtggtttacttgaacaatttaaaatgaaaaaaagattgagctcagtatcttcattcttggttatgtggttaagtatttggggcttgggctttaaacagttcataaataaacctaatttaaaattcagtgaaataaaaatctgaaaatctttattttttaatactgttgttaagtattagttaatatttcttgagtacttaaatgttcagtactttcctgagttttagatttatctcctttaatccttacaacaaccttacaaggtatagatggggaaactaggcttagcgagattagatattttcccaaagtttgtgtagcttcttgaatcaaattatattggatccacaactcttaaccactgtgttatgtttatctggttccttccctccattgcagctgtttgtttctccatagcttgctttgtcctcaattctgtgaggtattgccctgtatttctctttgttaagacagttttactgagatgtaacttacatagcatataaaatccatccattttttaaattgtacaattcggtgactttttagtaaatttacagagttacgcagttatcaccacaatccaattttagaacattcctatcaagcacaaagattcttgtcctaaatttctttatctttttttaaaaaatgcttcttgaacaaaggatctatatcctacatttccttctcctttaatactgagctacttagcttcttagtcattacatagtcattattcattgtacttttaaatagctggattaattccaatgaaaccatagaatgtatcacaacttaatttggagagttagccattaaacagcttgacctcagagtagactcttctatttcactgtattactttccatttccactctaaagagagtgcacatccttttgtgttaatttatgtatattttatatttatttttcagttcttgattctttatctagagcaggtaaattttacctctgggtttcaaagtattcttcatttcactttgttgttctaggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtaagaagctctactgatagtaaattctgtgtggtgtttctgtttttcacaggttcctgaaaacattgactaagataacatgacatatatattggtttccagtaaacagctctttaatggctgtctattttaggatatggtgattagaatacaatctcaagtttaaaaattgctagttttttgccttggatgtcttagatattttttctttctaaattaagtccatgtttgctgactttgggtgttgtctgcagattttgctcggattgcatcattaccatgaaaaatgtgggaagaaattgttttcagaactctttcccttcccctagaagctttaattccattttcagtactttatagtaagaatatagcttacttttttttccctaaatacat

SEQ ID NO: 68609 - DNA, 1008 bp, Homo sapiens
tggtgaaaccccgtctctactaaaataacaaaaatattagccaggcgtggtggcgtgtgcttataatcccagctacttgggaggctgaggctggagaatcgcttgaacccgggaggcagaggttgcagtgagccaagatcacgccattgcactttcagcctgggcaacaagaaagaaattatgtctcaaaaaaaaaaaaaacaaaaaacacacacacacacaaaaacgcctcttctttttaaatgaaaactctgttaatctagaatatatttgaatttaagtacctcagcttgctaaataaaatacctacttaaacttttctgtgtacccctcccaccttgttttccttagttttggttctgtgtttggtcagcctttacaatgactcgggctatgactgctgagaacttgtaagagaggactggaattaggtttaaaaggaatacgagaatgttaagggtttggcacttttgtgtaaataaatgtctggcatctgtctgagtgtatttcagattttattacatagccaaaaatgaagagattttgcaacatatgttgctttatattagctctccatttagggggagataatcaaatattgaaagtgttatgttggaatctgatgatcatgagcccataaaaatgtttttaagtgtatgtgttactcttctgtacaaaagaaaatgttcagtcacttgtatgaatttttttattcttcatagccctcaaaagagaattttccctgttttttgtttgttttttgagatagagtcttgctctgttgtgcgtttatgtgatcacggctccctgcagcctcgaacttccaggctcaagtgatctttccacctcagcctccctagtagctgggactacaggcatatgccaccacacctggctaattttagtattttttatagaggtagggtctcaccatgttggtgacccaggctggtctcaaactcctgggctcaagtgatccacgcacctaggcctcccaaagtgctggga

SEQ ID NO: 68610 - DNA, 1912 bp, Homo sapiens
ctttcccttcccttttcccttcatttttctttcccttcctccctctctgcccatctctgcctcctgggtgggctattgggaaacttggatttatgaaaatatcaaaacatgtattttcttgaatattattttgactcaaaacgtgatttgttcattattccagagcatttgcttattcttttttttttcttttttttttttttgagatgagtctcgctctgtcgcccaggctggagtgcagtggcgcgatctcggctcactgcaacctccgcctcctggattcaagcagttctctgcctcagccttccgagtgtctgggattacaggcgcccaccaccacgcctggctaatttttttgtatttttagtagagatggggttttaccatcttggccaggctggtcttgaactcctgaccttgtgatccacccacctcggcctcccaaagtgctgggattacagacgtgagccactgcgcccggccctcagcatttgcttattctataactctctctaatactctacaaagttctgtgccttaagtactaactaggctgtctacttttccttttaaaaagtatgtattgcttgtgaaaattttggatctgctttgtctcatgaacatattctaccactaacaggacttctttttggctgcctgaatatagtgaaaagtcagctaagatgatcacttgctggagctagactggggtttgcggggagagtgctacctgcatgccattttggcctcatgtttatgtttcattctcagttatcaaaaccataagaagtgatggacaaaacaggctcaggttctttgttcttccacatcaagaaggaaaaaacctattgctgatataaatctacttcagtgccaactgtaacccctgtgatttttctcattgcttacctttctctgtctgatgacatgaattgtgtgaaagggtggaagctgtgagtccagagatggtagttgaagagtaggatttgacagcagtgcaaacaatgaaaaagcagtgctctctctctgccgggtatcttgtactgaacttgaggctgctgccaagttagggactattcccaaatgcttgtttggggcttttggacaccttaaaaatatatatgaattcattatgtgaattattttttataggtgtatttgacctattggtatgtattactcaagatttgtatgtgttaatgtgaactaagatcattttaatgggagaggtgacgttatgatagaagaagaaaatttagaaataagtttaaatttttctctttatgttaataggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatggtaagtgatccttgatttttaaattgcaagttggaacagctttgtagcactctaatgtctggctttagtgaggatcaggaggagggagggcatatccaaagatagttggcgggaataaaaaagagttaaaatcctacttgggaggctgaggcaagagaatcacttgaactcgggaggccgaggttgcagtgagctgagattgcgccactgcactccagcctgggagacagagaaagactgtgtctcaaaaaaaaaaaaaaaaaagttaaaatcccagcactttgggagactgaagcaggcagatcatatgaggtcaggagtttgagaccagcctggccaacctggtgaaaccctgtctctactaaaaaatacaaaaattaatggggtgtggtagtgtgcacctgtagtcccagccgcttggg

SEQ ID NO: 68611 - DNA, 1016 bp, Homo sapiens
gaaggaagaattttttttttttttttgaggcaggttctcgctctgttgcccaggctggaatgtagtggcatgatctcagctcactgcaacctctgcttcctgggttcaagtgatcctcctgcctcagtctccctagtagctgggactgcaggcgtgtgccaccacacctggttaatttttgcatttttagtagagacagggttttaccatgttggcctgtctggtctcttaattcctgacctcaggtgatccgcccgcctcagcctcctaaagtggtgggattacaggcgtgaaccaccgtgcccagctggaaggattaattaattcaaactggagtaaattagctgttgctgttgccttcaacctcaccagaatggattgcttatggggcttgcttctgtcgctgcttcctctttgacctctacgtcctcctccttttgttgattcagtttttcaaagtcggggttggtttgtctgactggaaaagctcaggacttacacgtaaccctgtcccagttaggagagagatgtggaaagcaaatacctggttttcagtttctttagttttagggcaaggttctgccttataaagtgaagaattctccaaacataggaaagtggattcgataaagctgggtagccccctccagtgccatatatccatgaaagaacattttgtgaatgaaagggaatggttacaggatttgtggatatctttgctgtgatttgagtcttgtttgtattttttccccctttctaatgttgaaaaatgaatgaggtgcaatggtagatacaaaagcggaggacagttggcctgttggggtggctcacgcctgtaatcccagcactttgggaggctgaggtgggcggatcacaaggtcaagagaccgataccatcctggccaacatgggaaacctcatctctactaaaaatacaaaaattagccaggcgtggtggcgggcacctatagtcccagctacttgggaggctgaggcaggagaatcgtttgaacccc

SEQ ID NO: 68612 - DNA, 1178 bp, Homo sapiens
accatgtgcatgatagttgaggattattcatacttgctaatatgtatattaatgacttattttaattatggataggattatataagtaacttcaaggatcatgacatgatttatgatctagtatagatctgggtcacttagtttttatagctcaagtctcaatgtcttaattagtcacctgtgtatgtaattacatcttgtaaagggtgaaatttcatccctttagtctagatttattgaaactgaacattttcattatgggaagccgaattcagattgagtatacttaccaaattagggcttgtgaatattttggaagatttgttgttttatccttacctaatcaaataaattaaatgctttggattgtaataaaaatgtataaagtaaatttgtataaaatggcttgtgtgtctagtcttattatcagtttgagatatttttattttcctggcataagaaattgtgacatcttgaaaacttaatatatgtttacttgctttacttccctcccagttaaaatgaagctcatcttctacctttcactccatttaaaaattattttccagaaagcattacaaatgaatatgagaccagacacagcaataaaattacatttgtgtggacgctaatgaacagcatataacagcctggtcctggttttcatgatttttggatgaatagcagatgtgtatactattgcaaagtggagctgtgaccacatatatttatttaatcattatcaagtacatatgttcattctctcttaattcaaagccaaaataaagctaattgaggccaaaataaattagaggccaaatagattacataaccagagttagtaaagattactgctgaagtgagatttcttctatataagcctgtagcctagcttttgagaagccaagggagatatttatcacacactttctgtttcccaaagcatactaaaattggctttaaaatatgttgctgataaaagcccttgcagaatatattacacaactagttgaattaagcaacttcattgttaagtgcttttatgtgtctacaggtttctaaggtagattctaaggtagattaaatacaaaaacaaaacaaccaaacctgctccttaatatttgcacaccaattattatttattttttgaaagagtctaaaataaaatgaagtagtca

SEQ ID NO: 68613 - DNA, 1136 bp, Homo sapiens
aacatgaacctaaaatgactaatatttggttaaaatccaaagataaataacctgtactattttaatactttgttttctttagctttcagttgtattagaatgctttaaaactcatttcacttatagaaaggagtgaattctttttatgtaataaatgagaacttggggagaatggaagaaaggtttatatgtgcttctttatcttgatatcaggcctggttacagaggttgaacaggatgccatgttgtagaaaaatgagaagactgatttgactgtaaaggattatgtgggcagtagtatagggaaattttagagggagatgtctggaaatacaaatatgtattttttagagtgaaattaaaacgtgtttgttgaagcaagatggtgctcttaaagcaccaggaaatattgtagtggctctgatcgtaggaaaaacgattggatgtcctgaggaggaggtctcagatgtaactgtagttatcaaagaatttggttgttgagaactttatagatatttttgagaaacggagtttgtgttttgctaacagagtttgtaaggctcagagggtgttgaaatgtttctgaggttactgctttgtagaacacataggattttggtgcttgtagtcgtcattagggaagaataccgtggtgaaaagataaagttcttttttcccctcttcttgacaagttcaattttaccactgtaagggtgatgattgaaatttaatgaaatatctgttaaatggttattatgttcagagttctgcattttgtactctggttggagagagggggtttggtttatctttactgtttaaggacagaaaacttgggagagacaactttttcttcttcaaagcatgtttatttgcattatgtaacatgaatgtgaagagaggaagagtgttaaaataattagaaggggcacaagagctgttatgagcttcattaccaaattttggaatgggatcttgatcatttctataagagattaatgattacctgatagtacattattaaagggaactgaatgtatatagttcctcttgactcttcaggatctaacagttcagtgagtaaattaatcattttcattttgttccccaaaactaatgagctttacttctgggta

SEQ ID NO: 68614 - DNA, 1211 bp, Homo sapiens
ttgacatatgtttttgtttctcttgagtaaatacctagatgtggaataaacagtatctagctattgccttggattgtatagtaggttgtatgtttaaccttttaggaaactgccaaactgttttcccaagtggctgtaccattttacattcaccccagtagagtatgagtgttccagtagctccatattattgccaattcttggtatagccaggctttaaaattttatctgagttattttaacaagaaaagactatcgtggtggaaatagttccccccatttcctatgtcttattttttaaatgctgcaaaaataatattttgtgtgtgaagtttagatggtctcctaatgatttatttattcttttcttattttcgacagtctttgctcacttaaaccgatttgaaacgcagtttataagaaccaatacgttttcttccttttcacttacatatttttctttttttgttctagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggtaagtttttgtacagtgtacgaagatcatcatacctcctttcggtttttctccactgacatacaccaccctgacccctatgagaaaagaaagatcgaaaacaggaattttagattctttgggcttctttgttgagtagacttgaatgtggaaagttacgttgtgttattattatttttgacagggtttttgctttgtcactcaggctgtagtgcagtggtgcaatcaaagctcactgcactgtcagcctcccaggctgaagtgatcctcccatttcagcctcccaagtagctgggactttaggtgtgcgctaccacacctggctagctaaaaaaaatttttt

SEQ ID NO: 68615 - DNA, 1056 bp, Homo sapiens
ttaggatacctatatataggaagtggaaggtttgaaacaagacaagaaaaaataggtagtattgtatgaggagaacattctatataggtagggatatagtcaacagcattgactgctctagaggtgttaagaataaagactgagaggctgggcgcagtggctcaagcctgtaatcccagcactttgggaggccgaggcgggcggatcacgaggtcaggagatcgagaccatcctggctaacacggtgaaaccccatctctactaaaaatacaaaaattagctgggcgtagtggcgggcgcctgtagtcccagctactcgggaggctgaggcaggagaatggcgtgaacccgggaggcggaccttgcagtgagccgagattgcaccactgcactccagcctgggcgacagagccagactccatctcaaaaaaaaaaaaaaaaaaaaaaaaaaaagagtaaagactgagaaaagaccactggatttggttataaagatttagaggaagcacttgcagttgagtgatggataggaagttagataaaagagtaatagctaatgaatggtagtgtgaagtatatataccaatgttataagattttgcagttagtagaaatataattattattctgatggtagcaaggttagggttattaaaacaaaacaatagcaaggaacctggcgtaaaccattgaaaatacgagaaatacagaacaattgatagagcgaagttgtagagaggaggtaaggaggctgaaccgaaagtattgctttagccttaggaggaaggccatcttctcatttgagactgaggacaaggtaagggaagatgggtggagagaaaattttgagaggtataaattaagatgttggggatgtatgacatttaccttgtatcctgcttcactgagattgttttatgagatgatctgaggataaaggattcagggcatggaaattagtctttaaaagtagaaaaggcttagaaaggctggtagagaaagtttcccaggagtttaataaaggaaaacaaggattcctgagcactgtgagtgttc

SEQ ID NO: 68616 - DNA, 1434 bp, Homo sapiens
tgcacatgtaccctagaacttaaagtataataataaaaaaaaagaaaaaaagtgaaagatcttatgaaactttgttagaaaagataatgaaattggcaaggaagtttgatttttgtggcatgcgaactaaaatcaacccaaaaaagtgttagacaaaagcatatctataagcgtaatgattaactttattttattattattttttgagacagagtctcgctgtgttgcccaggctggagttcagtggcgcgatcttggcccaccacaacctctgccttctgggttccagtgattctcctgcctcagcctcctgggtagctgggattacaggcacgcgccaccacgccctgctaatttttatatttttggtagagacagggtttcgccatgttggccaggctggtctcaaactcctcacctcaggtgatcaacctgcatcagccccccaaagtgctgggattaaggtgtgagcaactgcgcccagccgattaaccttattttaaagaagagtggctagtacatgtcatttatgaatatagatgaatatattcattgcagagagaaaatctaaagacatataatcctaagatgtaatggaccatgaatatgtcaagagtatatcaagaatgtatatatgtatagagtatatcaagaatgtatcaagattatcaaggaaaaagatttagcagtctggagtaggtcgttaacttctatataatagcattccataagtaaatgatgtgaattcttaactgagaaccattagccaacctagaagattaaagaagccaaattatgaccaagttaacattgaggaaaaaaaatccctgaaattatgactgatgacattatactgttgtctaataccaggcaaagcagcaccagaactctgattaatagacatggacaatgagggcattgatgaatttctaggagctttataccttcatagaacttccaaaatatccctattaataacattttacctatacaaatttaacttaaacttagggagggtaagcctctctggctttgacagtgctttccatatgacccataacgtttgatcaaataaactattatttttaacatctctcttttacaaggtaaagggaattttgattttctagggccccttaggggaaatctcaaagacagttgttggtacaaaaggcatcatttaggaggtttgaacatttgattaaataggatcatgggccactgtggaaaaaaatacttggctacatatttaaccaaaagtgaccggaaaaaaaaaaagattttagttcagtgcggtggcccatgcctgtaatctcagtgctttgggaggccaagatgggaggatcacttgaggtcaggagtttgagaccagcctgggcaacgtggtgggatcctgtctctacagaaattagctgggcgaaagatttcatgcct

SEQ ID NO: 68617 - DNA, 1256 bp, Homo sapiens
tcttttaatattgccttgctgaaagtttttttaaggaatctgattggactttaaaatgcctcttgagactataaaggtaagtcaagaactgaccatcaggtttcacttgtaatacctataaatttgggtgaattcctgtcttgaagttcccaaaatattctaggatttttgagcctgccgggaagtgatcttgcttaattcacctgcaaggctgggaactctgtaagccagttaccaggccagttttcctaagaggactgtaagcgttggttcataaagtcaactgtaacttagaagtatttggtcatacctgattaaatgaatattttcaaatgtggcattccagtcaaagccttggttgcataagtaatgtttccagctagaaggcagactcattgaacctctgcagataactatattgccatgaaaataaaaataataagagtttttgaattctggaggagtaagacgggggagaaaaagataagtgtttatttcggtttacaaaaacatagtctccttaaattgttgtgagttatagatagcttcagagaaaagagaaaggggttccttatatccagaaaataggacgctaaggcatcagcaatattttaaacgaaacccataatcatccttcatcagtttattcagtcctatgtaattaattcttgttctgctggatctgtgttagcagtctcacgaacccatctgtttttctactagctgtttggaaatcttgactcagtccactggtgtggtctcagagttatttaagtgatgccatcagacgcttgtgttcaggttacctggcgtagtagttttcctttttctttctttcttttttttttttttttttttttgagacagagtctcactctgtcacccaggctggagtgcaatggcacaatcttggctcactgcagccttgacctcctgggctcaagtgatcctcccatctcagcctccctagtagctgcgaccacaggtgtgtgcgaccatacccagctaattttgtattttttggtagagaaggggtttcgccaagttgcccaggctggtctcgaactcttgggctccagtgatatgcccacctcagcttcccaaagtgtggggattagaggcgtgagccaccacacctggcccatagcccttttttattgaagacaagtgcactctggcctgtagctgatttgcaagtgctttcagggaagcattagagtaaaacagaaaactatctgtagatgacaaaatactta

SEQ ID NO: 68618 - DNA, 1474 bp, Homo sapiens
aagctccgccccccgggttcacgccattctcctgcctcagcctcccgagtagctgggactgcaggccccgccaacacgcccggctaattttttttgtattttagtggagacggggtttcaccatgttagccaggttggtctccatctcctgacctggtgatccagccgcctcggcctcccaaagtgctgggattacaggcgtgaaccaccgcgcctggcctaaatttatttctaaaggattgcagccataactattttaggtgatgattattataaataagctacagaacagacagttcaaatgattgtgatacttattaaagagttaagcatgggcaaaataattttatcaagacatctaattgagaaattgcattatttgtttacaacaattattcagttggtggatttctttctgcaggatggctgaatgctatactgagtttctgcattgcatgttttcacttcggataagggtgtttatcttctataaagtaagcctcacttcagtgaataaaacactgttttatatgagtaactttgaaatttagtcaaatatacagactaggcaatctaagaacaggctgtttgctcttaaaattatttattttaaaatacaatttgtcagtacataaatgcaaggaaacaaggttatttggtattattaacatatgcttttgtttctcaagctgttcgtgtttgcggcagtgagtattctcactaaaggttcaagctgttcgggtgtgaggctagaaacttttaaaatgtgcttggactcttcggtgaaaattattgatactttgatgctgtgatccttttagcggtatcataacttgtagtttctgtaatatcttgcttggaaggaccttgtataagtgcttaaatattttggaactaatttcaggaggagattggggatgcaaaatgaaattatatttttaggcagaaaactacattaagttatgtaagttattaacaccaggcctaaagttattgatgagactctcaataaaaataacatgaccagcagtagtctttttttttttttttttttgagatggagtctcgctctgtcacccaggctggagtgccgtgccatgatcttggctcactgtgacatctgcctcctgggttcaagtgattctcctgtctcagcctcccaagtagctgggattagtaggcgcccactatcatgcctacctaatttttgtgtttttagtagagatggggtttcaccatgttggccaggctggtctcgaactcctgacctcaggtggtccacccgctttggccttccaaagtgctgggcttacaggcgtgagcctgctgcacacagctgtcattttttttttcccaagaaaatagtcacccaaatattggaaacctacctttatcaaattatgtatgtttaaccaggaggctattttctctaatggtcttagtcattgttttatcactacaagacccaaactac

SEQ ID NO: 68619 - DNA, 3261 bp, Homo sapiens
gccgcagaaagtagtcccgaccacgccggctccaatgttgttcaacgccgcctcacgccctccgcggggagggccgaagcggccggtccgggaaagaatcccgctggaatgcgccaccgggaggaggctttccctcccagttcgcctctgctagcccagaacctctcccagggtctcaggcagaggctgtgcgtgcggttgccgactcccttccctggccgtacaggaggcagtaccgggagaaggggctcgttgcgcgcagggacacggtcgcggcgaccctaggaggcggtgccgaccgtatccctgcgccgctgcgcgaggcagaggctgaatgaggagctgcgcgggggaagcggggcgccgggggaggaggcggcgggatggaagcagacgctggcgtcgcgcgagcccggggccgagcggcgcggtagagagggcggcggcggcgcgcgcggaaccttgacgtgcccctttctttcttctctcgctgggaagctgggaagtatgagcgtgcagccctgccgctgcggcggccgccccggctcctcgcctcccccacttctggccacccctcgccggtgagagaagagaacgcgagaagggaagatgggggccgtcctgaggagcctcctggcctgcagcttctgtgtgctcctgagaggtgggaagagtgggggcactggaaagttggtggggttcggggggaggtggccttgttgtatgtgtctagggggaggggagggacggaggaagggagaaggggagaggagcggggagaggcctggtcgtggggagggggagagaaaggggcccgggagcaggggctgcgtgcaccgcccggccacaatgcggacctggcctggcttcccagaccttccccggacacatcggagcttcgatcccggctgctggtcttagggaacccttggcaccccatgctgtcgggatgactgagtgtctgtgtgcctctctctgcctggggtcttccagggaaaagggtctttgtacgtattttggcttttaaaatgtttgagtccgagatgctttaaggttggccttatccatcgaagccccgccacccactccccaccccgtttcggtgtttcttaggtgaacttttaaagccctcttgctattttttccaggccttgttacaggtaatgattggcttccgtttgggatataatgaccctgggtgagagcgcagttggaaagtgactccggggttataggtcgagcgtttcagcattgggagccttctgagcttcagcccataataaaataaaacattgcccttgtaacctctggtattcacggcttgcccctattttcggagtatgcaagtgtacagttggcactaagtagggaaattcatcctcgtgtgaagaggagccggtcctgggaccaaaatgataatttgctctgcacccctggggactgcttggcactttggtaaattgcataggctgttcgagataatttgctctgggaatcgcttgaattcgatggcactatgatgttttgaattggactgcaaagctgacacatgctctgtgacttttgtgacagttcacaaagatttttgactggcccgtcggcagctcttctcaaactatttagtgttgaacttgagatggctgtgatggctgtggagcatttaccagcagaggaatttaagtactgctcgatacggtggcttgtagttttggtttggtaaagttcttactggcgttcatagtaagttcttttcaggcatgtgaccgctggtcgctggagatttttaggtgttaacaagctaaacttttgttaagttctccaaactaatttaagtttacagaacactaatagtaactaatagtctgtgacaggtgtatatttttgcgtgtactgtgtatatgtatttcggatgagaatgattgagtttttttttggaggaggagaaatactttcttcagttactctgtagtaatgcagcattgtgtttgcatgttatattacttgatactctaagcatattacaaagttttcccacatgtaaaccccggaaaggtagtgttcattagatttttgtggcagaaattttaatgaagtgttacgtactggagaggtttcataagtatatacttattttattattggcatactctattgaaaggggttttgctgtagctgttagaaacaactatatttgacataagaatatgtatgtattttaagacataaggttaatagggctgacaaatatgagaaccagctgattggttagagtcgtgggaaaacttataacttgggatgtttctggttgtctagttgtatttcttggaggagaagcgtgtgatgtaaatgccgtttgtttaacaccagctttgagaccagagctgggtttgttcattattggaatttagataggttgcacttatttatgtaacaagacctggaagaggtaatagtttaaattgtctcgtttccactagcaaagttttcagaagtggagctctcgttttaaatgtggcgaaatatggtgtaaggtggtcttctaatatgtaacagtactgtacttagctgtgagtacatattatttgaagtaaaactgtcttttgatgtaaaatatttttgttcataatttagaattaattcattctttgagaatgtcatcctctgttatagtaaagatatttagtcaaccttggactccaaggagaaaaatctgattgatttgttgcatttaggtcatttttttcccccacaaagaattggggctttaacattggctgggtgtgatggggtatgtgagagtctgggagaccttctgtcctgtagccctgttgaattagtagcagaaagccagggaatactgttagtgctgtgtccctatctctatcatcacatgacaaggtataaaggaaagatttgggaatttcaatactaaaatcttggatttaaagcccaagtgtcacaacttcataactttgtggttctggtctagtccgcttctctaggtctcagtttctttactggtagtgtggataatgatacctgactagtttgcagggttattgggtgttttaaatgaaataatatggagtaccttgttaatgttactttttgctataatttttgcttgttcagggacatatcctcaaatgctttcatgatttgagatttaatttgtataacgttcacaatttttttttttttaaagagacaaagtcttgcttcatcactcagtctggggtgcagtggtgtaatcacagctca

SEQ ID NO: 68620 - DNA, 1082 bp, Homo sapiens
acagaataccactgggtggggaggtatcataaactaaaggaagggagttttaacaagtgggatagaaacctatgttaaatacggaaaagaagaggaggatgtggactgagaaaaaaacttcaagcatgaaaagaaaacactagtaatcctccaaagcagcaaatatggatgaagttatgtatatgagagcctgtccaggggaacttcccaaatggcagaggtatcaaggaagcagggacagcatgtagcacccatggagtcagtaagtttggcagcagaaatgagaacagagaaagcgtggtagccaagagggcaactgaattgaaagaaagtgttcgtcttctgtttttaagatgggaagagctgtatatctgaacaagaggaaagaggtccactaagctagttgcgagacaaaaagagaaaaggacaggagcaaagtcccagcaaatggaaagagtgaaacagaatggcattaagtttcagagaaaggcatgaatacctcatctgagacttaatggaaagaaacaagaatggatgcaggcacacagagatttatgggagtaagggaaaagatgagggtgttctggtgagacagcttcactttctcaatcggttgaaagcaaccattcacctggtacttcccactcttctgagtaaggctaacccaatgctggtaaacagctatgtttatttttgtttttgtttttacacacaactcacacttctctgaatagccatgtttaaaagcttaactgaagagctattacaaatacaaacccataaagtaatcaggaataagtcatcaatctttccaatatggtatttgggagaaaatatacttaggattacccctgggtttagagattacctttaagccattcagagaagactgtggctctgattaagatccattctcttgtcccctcctttggctgccattttccaatgcaatgataaggtctgacagctggtagaggcagacatctgatgaatgcaaagacttttatttgtccagatgacagaagaatgtgaagaaactggtcatttgaaatctagctccatcatgctctccttatcgccct

SEQ ID NO: 68621 - DNA, 1034 bp, Homo sapiens
agatggggtgtcaccatgttggtcaggctggtctcgaactcctgacctcagttgatctgcctgcctcagcctcccaaaatgctggaattacaggcatgagccaccacgcccggcccaccttcacttctttgtgctattgctttcatatatattgcatctacatacgttagaaatcccatagtggttttatacacacacacacacacacacacacacacacacacacgtttttgttttaataatatattttttgaagtgattaagagaagaaaataactatatatagaatgtgatgtttacccacatagttaacatttccagaattcctaatccctttctccagtttccatttgatgtcatttatttttagtttaaaggacttcttttagcatatcttgcagtacaggtcagctggaaaaaagtcctgtttttatctatctgaacttttttttgcccacttttgttataaagtcattttttggtgtaattactaagtttttgaagacatattgtgagactccatgaaatctcattttttaatctacctttatttcatcagttataatatctattgatgattcttgcttgaattaattatgctgtgatggctaccaaataactgttttctaaatttttcattccttctacatttattagtttatattctattggaaggaataggtttctcatctccccatttatttattcaaatcagtgcgggaacagtcagctcctattttatccaatgagttgtatgtaatctgttattatcattatttctttttcaatctcaaaatgttccaaaattggccagtgacagcatcttcaatctaacttcctgtgtccttttttttttggagatggagtctcgctctgtggcccaggctggagtgcagtggtgcgatcttggctcactgcaagctctgcctcctgggttcacgccattctcctgcctcagcctgccgagtagctgggactacaggcgcccaccatcatgcccagctaatttttctgtatttttagcagagacggga

SEQ ID NO: 68622 - DNA, 1069 bp, Homo sapiens
ttattattattattattattttgagaaagagtctctctctgtcacccaggctggagtgcagtggtgtgatctctgccactgcagcctccgcttcccaggttcaaatgattctcttgtctcagcctcccaagtagctgggaatacaggtgcgtaccaccacacccagctaatttttttttttttttttttttttgtatttttagtagagatggggtttcaccatgttggccaggctgatctcgaactcccgacctcaagtgatccacctgccttggcctcccagcgtgccgggattacaggggtgagctaccatgcccggcaaggtgggaaaattaggttagggccagatttggaggctcctaaaggatagggaaaggaatttgaagttgatgccataagaacgtgattgtagttttgtttgttgcagtagggagcagggtattaacatgttgacagctgcgctttttgaatgaattggtatgacagtggccaaagatggacaatgcagttaggagattgttgtagtttcctagtgatgagctgatgaaagcctgggctggggtggggatagtggaaggaggagcaaacttgagaggcattttcaaggaagaaatgacaggatttggcaaattgggtgccaggaataaaaagacggggaaatagccatagggttgcttgattgagggagcagaataatggcagaatggggaagggagattaattttgtttgtttgtttgtttcttttggagatggagtctggctctgttgcccaggctggagtgcagtggcaccatctcggctcactccgccccctgggttcaagcgattctcctgcctcagcctcccgtgtagctgagattacaggcccacattaccacgcccagctaatttttgtatttttagtagagatgggtttcatcatgttggccaggctggtttcaaactcctgacctcaagtgatctgcccgcctcggcctcccgaagtgctaggattacaggtgtgagcaaccgtgcccagtgggagattaattttgaattttggccttgtggccttgcaaaaccacaact

SEQ ID NO: 68623 - DNA, 1023 bp, Homo sapiens
ctagttacataccctagagaaaactctcatacatgtgcaaaaggagacatgtacaaagatgtccactgcaaaactgtttaatagtaaaacaactggaaacaactcaaatattcactaataagtcaatggatacactgtgaaatattcatttgatggaatactacgcagcagtgaaaataagtgagacatatatcaacatggataaatctcaaaattataaggaaaagaaaaaagaaagttacacaagtagctgaaggatacatatagaacacaacttatataaagtcaaaacaagtgaaagaatattctacaccgcttagatatacaaaaacatgtaggaaaaagacaagccacgaagaaaacacatgggcatgatgaatgccaaaatcagatcaataattccctgtggagtgggaggaggagggaatatcagggaaggatataaaggatggggagggggcgttgtttatttgaaacgtgtatttttcttcctgcagggaaagagatctgaagcaaacatggcaaaatattaaaatatgacaaatttgatgaatacacaggtgtttgctatttttttttttttttctgtatgctgacatactgcaaatgaaaaagaaattctaggtagcagctgataatctctatggaggacaaggcatcctatccacagcagtttcttaaaccctgctgggtctaaggcccctctgcaaagctgatggaatctatggctccacttcccatggggtttattatgctaccaccactccacccttggtcacctcaggagacattcaggaaaacccatgcccactcttttgtcatgtggttgaccgaggtaatttcaactcttgctaagagttaccaaggccagacaattagacagggagagagcgtgaaacattggctgctcagagaaatagcctgtgataaaaacaagattttcactgaatcaaggctgccagggtaacaactagtgaaaaagctaaaaatccagtggtacacatgcaactgaatgttttcaaa

SEQ ID NO: 68624 - DNA, 1052 bp, Homo sapiens
aggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagtttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagac

SEQ ID NO: 68625 - DNA, 1032 bp, Homo sapiens
aaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttgggggacttggttttaatgagcttctgtcatttagggcttctcttggccatggtcccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaatacgagaaaagacctatctttgcagccataaactcggtgggaacaccaccactcaagttgccaaaggaggcagtggtgaaacctgtcctgttctcacttaaatgaggatttagctcaaaataaagtggtggtgtcatcaggtttattccgtgttctgtcat

SEQ ID NO: 68626 - DNA, 1377 bp, Homo sapiens
gttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgc

SEQ ID NO: 68627 - DNA, 1099 bp, Homo sapiens
ttacaaaatacacatcattagccttattttacaggtgaggaaattaaagctaccggaggttaggtaaccttcccaagatcacccaggcgatgagtggtaatgcgctgggctgtgctctggtttttctggggccgttacccatgtactttactttattccgtgccacactgagattccacactaaccactaatgaattgtttccaagaagagatcctttaggagtttgctttaataaatcgatcagtcttctcagtatggcatttgataaagttctgtagcttggcagtaaaactctttagcttgatatttaagaccttccaggacctaataccacctttttagttcttacctctcctgttctcttcctctgctcatcctctttcaatgtctggacacactcacctagtgagtgcaccccagatatttctgtcctgtccttggtcttcattcattttctatactccatctggaatgcctctaccgccatctgagcttcagctgacaattttagttcccattataaatagtcttctcagaatccttccctttggttttactcctgttttccactgccattttgtttatcctgctacattatattcatcggatacctctttgtatcatcattattcgtgcaactgtcttacagttgctagtagactattcatccctcagtgagaacacttgcttttttatgccccagaataccttgatgcatagtaagcccttggtgattatttttcaaaataaatagttatatcctaatttgtaacccatgcaacttgtatgaaatgtacatgtccttaaacattaagtaaacacaccttctgttaatttactcagaaaaccttctgttaatgaatttgagaatctaaaattttcaacccaggaaaaacagtcttttttaaattatgaaatgaatgtaagttaatgatattttacagtgacttgtaaaatgaaaatgtgcaaggaacatatatgaaggtttctcattagaagatgctaataaaccagttactagatactgattttagtcagcttcagggataagggttcgttcatgtattcgcccaacaaatgtttattgagcctctacca

SEQ ID NO: 68628 - DNA, 1031 bp, Homo sapiens
cagctcaaaggtggaggaaggccccacagatggcgctagatactgaatgtttgatcaccgtaacaaaaaaacggggaggccgaggtgggcagatcacctgaggtcaggagttcatgaccagcctggccaacttgatgaaaccctgtctctactaaaaataaaaaattagccaaatgtggtggcatgcgcctgtagtcccagctactcgggaggctgaggcaggagaatcgcttgaacccgggaagcggaggttgcagtgagccaagatcgcgccactgcactctagcctgggcgacagagtgagactctgtctcaaaaaaaaaaaaaaaaaaagcaataaccagtgatacctcctgagtgctttactatacgccaggcacaaaatacttttgatatactaactaattatctcaacaactctgtgagataggtgtgatcattatcctcattttatagatgaggaaattagagtaggaggggcttaagtaacttgacaaatcagacaactagaaagtggtaaagccaggacaggaactcaggtacaagggcttgtgttcttacttcctctgctgtatgatcatggggcttgcccacatgtgtatgctgtatgtaccgtggcttctacgtgtgcatgcatggggcggtgtgagggtggtattcttggacaagagaacggcatggaaatgtgaaataacaatgagttttatgtggctggaggtcatcattggaaacggtaagaaatgaaactggaggccaaggcaggtggatcacctgaggtcaggagttccagatcagcctgaccaacatggagaaaccccgtctctactaaaaatacaaaattagccgagggtggtggtgcatacctgtagtcccagctactcaggaagctgaggcaggagaatctcttgaactcgggaggcggagattgcagtgagctgagatcatgccatcgcactctagcctgggcaacaagagcaaaacttcgtctcaaaaaaaaaaaaaaaaaatgaaaccatgaaactgtaaggtgc

SEQ ID NO: 68629 - DNA, 1087 bp, Homo sapiens
agggaaacacatgtgggttactatgactttgttttctgcattcccagatgataaacagcataaaattaggaataggagaaacttggcaagattggacagtgagccaagtcttcagacaactttaaaaaataggcgcaaattttttcaagaagcttatcagtttttcggtactgcttttcacagtaaatagcggataacggactgatgttatgtcttgtaatggaatctagcttggagtccctgggacaacaaagttatgataagggcagataagaggacgcttgattctttgtctccgttagccatttggagcagaacgtttgcataaatgaacttttcttctgaagtggatcttgtttgtaagagaacttacgaaaggaagagggacattttaagcatgtttcaaaactgagttgctggtgaggccacagttagtttttagaggtccaagggaaatcaggcagtgtctcatctgttgttaattaatgaaacgaaactggagtcactagagtgcagcagtgaatgaaaggtcagtgaatggaaaaaactgtcaatgaaggaggatgtcagcagagtggaacattgtcatagataaagatcagtgaaaatgtgctctggctgaggtagggttttctggaagtgactgggagccagtctgggacatttcaagccaaactgagcactaaatgaatgttctgattgcagctaaatctgttaaatatttttaaatatttgtttgagtttgttctagatatcagttgagaaagatttgtgaaaaagaggcttctttttgttttataatgtgttttacagtgtagtgttgttttgtttggctcttttgttttgaagctgaacaatggtttctttctctcctttctgttctctgtcttagaactttctagagccacacttacttttgaggtccactgaaatcaaagtgatctaggatcactgtaccaattaacgatagaactggacctcgaacagcctggctgatggctcagtttatgattattgcagaattgcatctcctctgaaagttgttctgtggggggtgacctgacagccaaggtctactaccaacttg

SEQ ID NO: 68630 - DNA, 1042 bp, Homo sapiens
ggtggaatgctgctaatgctgtggaaaaaatgctatgctctctaccttcctaggagtaatttaccaaacctgtgtggcttggcttatccagaccaaagtatctacattgaaacattagttacatattttgtttgctttctttaggggtatgaaattatgttgcttttttttttcttttcttttcttcaactagtttcaactctccatgtttactgtctgctgatcccgaaagaattgtgaccatactttagtctgtttttgagtgtctagagaataaagttgcctaaatcagacatgtcagactgaggcataacagaattactcttaagagcaattaaagtactttactgcaaaataaacattttcagtattttccatttttaatgttagagttgtctcctttgtgtgatggtaaagcaacagattttctttccagtatggagagaagagagaactgtcctctacaggtgaaggtgtactctagtttttcacatatattctaaaataagcaaatgaaaggattgtgtttatgttacaaaaagggagttttgttttacaaaagaattaaactacttgagaactacaaaagaatttaatggctgggcacggtggctcacgcctgtaatcccagcgctttgggaggccaaggcgggctgatcacctgaggttgggagttcgagaccagcctgaccaacatggagaaaccccgtgtttactaacaatacaaaattagccgggcatgatggcgcatgcctgtgatcccagctactcgggaggctgaggcaggagaattgcttgaacccgggaggtggaggttgcggtgagcggagatcgcaccattgcactccagcctgggcaacaagagtgaaactccatctccaaaaaacaacaacaacaagaatttaaccgcatagttcaaaaactgtgaaaccatatgaactatatgcagatgatttaaaatacaaaagttaaatttgcatatgactttttaggaaaatgtcttccataaagtagagctttatatcaatattatttctttgta

SEQ ID NO: 68631 - DNA, 1301 bp, Homo sapiens
tagaacggtggttaccaggggctggagggctggggtaatggggagatgctgcttaaagagtacagactttcagtgatatgatgagtaagttctagagacctattgtacagcatggtgactacggttgacaataaacgtaccatatacttcaaatttgctgaaagagtagatcttaagtgttctcaccacaacaaaaagagcatggctatgtgaggtaaggtagtcattccaagtgtatatgtatatcacatcatcatgctgtacaccttaaacagataaaatttttgtttgttaatcatacttcaataaagctggggaaaaaggtgctgtttgctcactggctgctgtgtatttctggctctgtttctgagtctcagttggcatgaattcgtctaaattggatcatcttttctccgattgctatctgccagtgtggagagtcagtcatgtctcttcccagctaccagtggctaagacacatgcttgagattgtcttttgaaacaaacagactagagagccaactaaagcttaaagatagtcctttggttccccatcctgatattgtgcacaaaccaaacaaaagcatcccagatgacaacagtgacatcaatcttcccttgccccaggtggggcagctgtgtagtctagagaaacaccaggtccagcatattcttcagccctttcactcactcagcctctcaatatttgatgggtgcctccatggctgtgccttggactgggctctcgggggtgaagatattggaaaagcaaaaggcttgcccctgcctttgagaatgtagtggttaatttggggaaatgcacctaaagtggatgaaagaaagagaagtatatgatcatttgctaaaatgtatgatacagtgataagggatgattcagagtagtctgcagaagtcagggaagacttgattagggcagtggaattttaatcaaaccttgaaagatgaggagtaagatttgggtagggagggttctgcgcattctgagggggaaagaacatgattaaaaatgtcaggaatgaacatagatttggaggggcagtgagcagaccagagtggattttttgtgaaggagagaaatgggaattgagaggacatgagatcaaattatgtaagctctttaaatcagaaggaagaatttgtactttaaggtgatgggtattgtgagctattggagatatggctgcaatacctgtcatctcttagtcaccagatctttcttccaacctcttcggtctgtctggttttctggtcttctgctaccatgaagtcagttgaatgtt

SEQ ID NO: 68632 - DNA, 1055 bp, Homo sapiens
cttcaactctgttcacctgcttgcaggtaaggctcgtgatggaattaaaaggactcagaatcttgctgagctgtatgagtaagcatatttcactgtgaactcagtacaatagatcatcccaactttgctgtgtaaaatgatttatttatagcttttgattgatgtcaccgttctatttaacttgaatactatatcattcttccacataggtcagtgtatttttgacttggctcaagtgcctctttgcttgctattaactggtagtgccacatagatttgcacacccatatggatagctcaaagccagctgcttctgtctgcctttttccattcacctgtgatgtaagaacaccaaatgatgaacatctcagctcctgctagttcccacccctgtggcaagaaccagaccaatattacagtgtcaaactcttacttaacatttatagttggagcggactccagagataagccttatggtcacctttctgggcattataaacaatgaaatagggggagaatgtgtgcagaatgtttcttctggtaattaggggaattgttttaaaagttacttgtatatttttatttgttttataattaaaaaaaagtctcaacgtagaaatgctaagcaaccagatgatcttataaagtgtgtgggaaggaccaaatattctatatctctcctggaggacggcattgtaggagttaatcccatcaaattccaaagaaggctattcatcctttgcttctcgttttgcaaatgaaaatcctttcccttgccctgtgggctcatagagctgggaatatagtttgacaacacacagtaaccttaacataaagctgctgtgttgggcggattcagcttcagtgataggcaagagtgcttttaaacatttggtctaagaaaaacaaaacattaagattaattagttgttggtgtgttaataattttaaactctgggcaggtttagataagatttccatgtctccagttctctctcacaagcttttcctcagttctctaagaacaaggatagttcatctttttcagattgtct

SEQ ID NO: 68633 - DNA, 1566 bp, Homo sapiens
acatatacacctacccattcatcgcaggaattctcaagccatttcagaaaatatttttttttttgtcctggtaacacaggattgctaactttgtcctcagctgccattctttgtgggatttcaataaataagcaaataaaatataggaaaactatttggaataataatacttcaagcagctttttgtagcccttttaattcaatactacaggtcatttagttctgagccctaggtgattataattcatgatatgtcttgttttgttttctttgagtttttacattttgaggtaaaatggaattatcactagcacatttttctgaagccataccaatttgtcctttttatttgtttgttcaaatgaagcagtgcatcaagtatggaattagattaatggagtaaatattatgaatcatacactctctctaatctgacactctttcttctttttttgacctcacgttttgttttctgtctttctctctccgcgtaggctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggtaaacgctttcctttttgccttttcaaaataaatggacacactgaatgaggaataattttaattgaagcctcctctttaagtagagaaagtaatttgaggaagttttggttgctttttaaattttggtgccttgtggtacctcaaaataatttattgtccatattgccacatttaataatatttctaaactatgaaggattaacttgctttagtttggacaagtgctatattttcttgtggcttgctaaaatgattttattaaacactattctatattatctgcaaatttactgaaaggaaagtcattcttttcaagttctttggaaagaaagtaggaactaattattaggggtgctttttatgtgtcataacacatgtggtaacattggtcaagacttaatgatatcttcaagggaagttattcctgggatactaaaatgttgtctgtgtggtgaggaagttggtttttttcttcac

SEQ ID NO: 68634 - DNA, 1095 bp, Homo sapiens
aaccaaaattctctaactgtaaatgaaagagattaaggccattgttactttaccctccatgatcccttggcagggctctgcctctcacctcacccatttagcactacagagaattagaccttgggcatgaagtcctaccaggaggactccagctggcctcagtacagcactgaaagaatggaacttcaccctcacttcacttttacccctatgcttcacttacatcctcagcttagagtcactttgaccagagcctttcttggtcagggaaagggtctttttatatctgtaactaagctctgattctctgggcaagaatgacattctctgctctgtagaactgtttgttgtaacctgtctttgggtttatgagaattggctgaggggaagcaaagatgagaactttctaattcaacttttgcatgtttgctgacttctccctccttttgtcccttgatctgctaacccagataactgctttgtcccatccggattttatctctttgagaggagccaatcagactcagagacccagtgccattgttggaatcaacttgctcttgttctcggatttccactttctgtgccacctgggtaccctcatggacaattggcatcattctttcccagtccagttccattatgggaacaagtacttagggaaaacagggcaacccagtagtagaagccctggtttgggaatcagacaatctgaatacaggaccttacattgccgtgaactctgtcactgagcaggcagaacctgattgagtggtatggctttggtaggcgctttgcagaagtttattagtggattgactaggacaaattctctcttatagttccttcagttgaaaatagagatgacttttgtacttcattaccataaagctatgctaaaaataatacattaatgaaagttgtttcttggaaaataagaaatggaaatataatgtattaaatggagctggtttgtaaaatatggtgtggttgagacagtatctcaggtgccttctaactccctgtgtgtcagcctctgtgagaaagggcacagtttggttgcagctgtactataggaggatggaattacatctg

SEQ ID NO: 68635 - DNA, 1084 bp, Homo sapiens
ggctgactgctattccagcctttatctgtgggtccttgagatgtatgtaaacaacctgaacctctgattggaggggcggctttcaacagtgtggtatgtcagtgcgaggcaactgggttctacggtgcggataactgctgtctccaggtctagtatcatctaaatagttttgcttcaagcagtctcattattgccatcacttgtcagaatatgtgtcctcaatttttgggtaaggaaatatgatcagacattaataggcagctaaaaagcacattaagtttgtagttttactttgttttatacttttataaataaaagtacatattataaagtatatattatacttttaagttctggggtacatgtgcagaacatgcaggtttgtttcataggtatacacatgccatggtggtttgccgcaccaagttcttagctttcttgattttggtgagggtggttttttgtgtttgtttttatttttttaattgaatatatttgccaaataccagagctcagaatttctatcaagtttatcttaacccacagcttatgagataaagttgctttaatctgtgtagcattgaggcagtcaaagtctaaggagttcttgtttgcttgcagatatgatagtctccttttttcccttttgattggtttttttcctgttattgaaagcctgtgtttagggctctattgaaaggcatttcggtatatcttgttgcctgtttcttcagttttgttggagggaaaaaatttaagtcaggcttgtagtttaataaaagtaaacttctcacctgattatatcctttccataaactgagaatttgaacttgagctctagcccaaccaaataaaactaaatccctctcctcactcaacaggcctgttaagcaccccatagctatgggatccttttcctttccctgataatttctctttgtaaaagaaaatgtttaaaatggagttgtgcctctctgagtgggaccccccgcttcctcctggagccccatcccctgctgtgggccttgatgcaggccttgggagtgggtgttttagggcagcagtagcagtagcagatgaaact

SEQ ID NO: 68636 - DNA, 1024 bp, Homo sapiens
aacagttaccccagagttacccgttttagtttgtgtgttgtagggtataaactctcacaccataatatgactgcttaatgataagtcagccctgtccctgttaggagactttgctgagaactgaggcacacttacagcaatatctttttgttctaagtgaaataatctttagatattagtgatcactgaattcctcattatacaagtaggaaaaacacaggcttggggaatgtcaagtgacactgtatacgccattttagcattttagtagatgagttgaaattaggaacaaggtctcctgagtcctagtccacagtatcttttaaaaacaataacctcacttgtctctaaattcctagggttagttttgccctcatggagcaaagaaactgagcaggcctaggttgtaggtgactggcacaaagagactgagagaaggaagcctgtggtggagtgttctgtgattttagagtttttgtagctcctgcttttgctgttgaagctgagcaaggggcctgcagctacccctgggcctggctggtgtcccatttttgaggccccagagttatttttagccgcagggccttggaagcaggtgtggtccgggcttgaaggccacgcctggaatgtgttcaaaccttgttgtgcatgtctgcttaggagctgagaatagtgacgaagccattgcatatactttgttagaggaatttgcacttttccaagtgagagcaatgaaagtcatcttgcgttgcatttgtgacactttaaacaggtttattttggaaactttataaattgaatgatcttttacaagtattagtgaatataattaaaaaatacattagctataaatcctttgtataccaaataaacttttgtattataagagtcataccctaactgacctatttttaaagtctagcttcatagtcataaacatgtgatttaaaatttcatttttctcacttcccccacccctcaaacattattgctgtttaaaataattctttataaatccatttca

SEQ ID NO: 68637 - DNA, 1019 bp, Homo sapiens
tggctgcacacggatacatagttgaagaagggtggggtattttcatagtcttttcatataattgtgaatatttttgttacaccaaaattcaacaattggtaaatgctttttatttatttatttatttttttgagatagtctcgctctgtcgcccaggctggagtgcagtggtgtgatctcagctcactgcaacctctgcctcccgggttcaagtgattctcctgcctcagcctctcaagtaactgggattacaggcacgcaccaccatgcccagctaatttttatatttttagtagagatggggtttcagcatattgaccaggctggtctcaaactcccgaccccaagtgatccgcttgcctcggcctcccaaatttctgggattacaggcgcagccaccgctcccagccagattcttaaatattagttgcactgctgaatctgaagccatgtcagtgaattttgtgtactctgtaacattaaaatccactggtccatcttgcactttgaatggatctttgacctgtgtgtgattttgtaactgcatacattgatcattcaaaaaataatggtttactaagctgactgggcacagtggcttacgcctgtaatcccagcactttgggaggccgaggcaggtggatcacgaggtcaggagatcaagaccagcctggccaacatggtgaaaccccgtctctactaaaaataacaaaaattagccaggcatggcagtgcacgcctgtagtcctagctactcgggaggctgagacaggagaattgcttgaacctgggaggtggaggtttcagtgagctgagatcgtgccactgcactccagcatgggtaacagagcgatattccatctcggaaaaaaaaaaaaaaaaaggtttactaagttctgcacatctttgaaatgttggcacatttgattatacaatattaagcaaatcacagtcattaatatcaccatcagtctcatccaaaaaatctttaagaattgggaagtggtcaagatcttggt

SEQ ID NO: 68638 - DNA, 2832 bp, Homo sapiens
tgattgtaagtgtgtacctataaaataaaaatagacatgtaaaattggggattggagtctttgggccaaaagcttaatggcagtaactgagaaggcagtaaaagaggagacactgttaccccggttcttttcctttttcctacacgtttaaaaattatttgtgggacagttgagagtggaagtgaggctgagatgggaggggggaagagtaggtgtgagaaggttgcagagtttaggtagggatcagaataagaggcaggatttatgtgttagtgtgttttgatgctattttctgtaaatccctggactgggaatttaatttcatacagtgtttagcatatgggattaatatattgatgaagcagacttatatagctgtccagtattaaattttttcaattttcagctaatcctaaaaatcctactaaatataatttgctagaattaccagtgtaataatttatcctagaactcccaagttttcctagacaaaaataattttctacttcgtgttacctgaactaaaaatttcactggacattcagtgtttttaaaatgcattaagttctcaagcaaaaggtactttaatttgaagaagtaaattaatatagggtgaactgatttggatcagaatcccaagaaaataaggagataacttagaggaaataaaacagattttatgacagatttcaacagatgaaagaaactagttaaaaagatttcacaggaaaaaccatagttggtgcttgattggctttaaaagaaatttactgatcatttaaaacggagatattcaccatcataaaagaaaatccgaatgttggcttaaacaaaaacataattaggaaaataagtcttgcccaaagctacatatgataaattccaaagccagatgtcaattttttttttctgattttcttgtgttgtagacaatctgttatttgtatgcatttcattatccttgatgatcaagggttggctgtgtgaagagaggttcataaaggttggccgaatttaaagaagcaggctcaggctttaagaagagctggttcttctacacaaatggattgagacagggagttagaattttaatcaaataaataactggaggaaacagtggctcaaaagaaggatgtaagacagattaccttggacaggtacaaagaaataataaaagcttgccaggagtatgatcagtaaggaagggaacagaatacatcttgccatgaaaggaaagaggaataagtggaaaaatgccctctgatacctcagcaacaagagagaggaatgaaacttcacgcccttcttgactggggttagaaacatcattataggtattgccacaaagtcacaagatttttttattacattaaaaaatgtaggccaggcgtggtggctcattcctataatcccagcactttaagaggctaaggcaggaggatcacttgagctcaggtgttgagaacagccctggcaacaaagaccttgtttccacagaaaatcaaaaaattagctaggtatggtagtagtacgcagctgtggtgccggctactttggaggctgaagtgggaggatctcttgagcctgggaggtcaaggctgcagtgagctatgatggcactgctgcgctccagcttgggcaacagagcaagacagtgtatcaaaaaaaaaaaaacatataatcttgagggatagtgattgatagggtaaattatgagcattacttatatgagaatgtaaaatttaaaattgtcagaaataaaaagagggattcgctgtaatatcatggcctattttgagttatttgaaagggagggatacattataaactgaaattattaactgaatttctggattaactactgataggaatcaagcaaaacatttgttagcagtatgctgtttacatgtgctgagatggattccaaaagttggggacactggcccatgttatggagaacaggattataagaattttaagggagatacatacatatgcaaagataattaccagacagctggcaagtgccaaattcaggtacaaaagagaaagagggctcagggaggtaatcttcatagagataatagaatttgaccctggccttaaagattggttaacatgtgtatggagagagggaagtgggggaggcgaaaggcggaaggtattcacccatctcattcagcaaatttatgctgatcctctaccaagtgctagaccctggccatacagtggaaaataagagaaagtttttgcccttacgtaacttatattctagtgggagaagacaggacaataaacaaagacagtaaacaagtaaacagtacattaaaaaagtgatgttaaatagtggtcggtagtaaaggtaatgatcagggtcgataaattgcacttattctgtgaatcacttgctttgcctatgatagtctaatgaacagtcttcatgttataactttttaatattcatgtgcagtccaaatgaatttgaataaaaatctacacattaaccagtttttaaaaaaagaaatgggaattaaagaaaaagaaacctatgtgacttttttttaggtcaaagcatggaaacttagatttttttttttttttttttgagacggagtcttgctctgtcgccaggctggagtgcagtggcgccatctcggctttctgcagcctccgcctcccgggttcaagcgattccccttcctcagcctcccgagtagctgggactacaggcgtgtgccaccgcacccagctaatttttttttgtattttagtagagacggggtttcaccacgttggccaggatggtctcgatctcctgacctcgtgttccac

SEQ ID NO: 68639 - DNA, 1033 bp, Homo sapiens
agtgggtgcgctcccggccgctgcgcggcgcttggaccgggccccgccgagaggagcggccgccgcgggacgcggcacctttgcgggcgaagctgctcacttccaggcgcgactgttacacaacacgcctgccaagtggggccctggcctgactgttcccattatccccagttcgcctttggtgtaagcagcgaggccacctgggtggtgacggtgctgctttcttcaaccaaccaaccgaaaaagccctcaattttcggacaggggctcgggtcttggcgttggggggcccgacgcctagtgacttctttatttacactagctgcaaaacgtgagaaataaaaaagcccagggtctgtgtatcacgtgtagtttcatgtaatgaaacaccacagagggaaatattttcagatgctgggtttatttcctaaagaataccaataatgaaccagagaaaaggcaagtagatctgaaaatgaatggatactgcaaaatcctaaagaagtttaggaaacatcaactgcaaggattcttggcgttttgaagtcgtgggtgtctcagattggagaaagcacacctctaaccagcctgtgatgaataagctggggaggaaaaaaacctgttgcataatctcatttgccgtggggtttgctgtgccatccccttgaaccaaagggaagtgagttaagatgcagggttttaaaactctctgaagtttttatttacccagcgctctggctcccacttctgttttaaaagattataagtaaatactctgctctttcaagtgaaccaaacctatcaaacctgtttagaaaataaaccaggtatgtttctttctcttctttcttttccgcctctgtgtgtgtgtgtgtgtgtgaaatttaccatccatgcaaaagtttaggactagtgtttggggaactgagactgtcagaaaaatgcctctttatgccactcaccttatggggctgatggagagtccacgtaaaggataaccgtttcctcaaaggatttatgctgtttcacctcc

SEQ ID NO: 68640 - DNA, 1057 bp, Homo sapiens
ctgatgagtgaagggaacaaggatatgtgtaggaggggagctcggtatgactaagggtcaagagaaggtgaggccagagagagcctgagctgagatctgctgaaacagctcctaaaatgaaaacaaagttggggccagaattttttctggatagtagttatgttttcctgccaacgctcaagtcctacacaaagacaaatgacaatcaatgtaaatgtcaaataagatcgttagcctgagtaatcataaccaatctgtatgacacctttttaacaggaggcctcattcttcttttccccaaccagaattaagagaaaaaaagtgaatatggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgctgaaacccggggaagtggccacagccagcatcttctttgggattctgtggttgttttctatcttcggcaattccctggtttgtttggtcatccataggagtaggaggactcagtctaccaccaactactttgtggtctccatggcatgtgctgaccttctcatcagcgttgccagcacgcctttcgtcctgctccagttcaccactggaaggtggacgctgggtagtgcaacgtgcaaggttgtgcgatattttcaatatctcactccaggtgtccagatctacgttctcctctccatctgcatagaccggttctacaccatcgtctatcctctgagcttcaaggtgtccagagaaaaagccaagaaaatgattgcggcatcgtgggtctttgatgcaggctttgtgacccctgtgctctttttctatggctccaactgggacagtcattgtaactatttcctcccctcctcttgggaaggcactgcctacactgtcatccacttcttggtgggctttgtgattccatctgtcctcataattttattttacc

SEQ ID NO: 68641 - DNA, 1027 bp, Homo sapiens
tctgcctcccgggttcaagcgattctcctgcctcagcctcccatgtagctgggactacaggcacatgccaccacgcctggctaatttatgtatttttagtagagacggggttttgccgtattggccaggctggtcttgaactcctgacctcaggtgatccgcccgcctcagcctcccaaagtgctagggttacaggtatgagccaccatgcctggcccccagttctgtgctatgacaacccatctaccattttccccactcatgtattaatcttaaagcttggatgggtgagaagtagataataggataaatgaatgattcctcttttagatcatatataggtagagataaataaggaccttcaatacctcagccaagggagtatgtcaaatggtagtctcagaactggctgggaagagataggtcgaacaggaaagaggtgaagaagcctttcttgtcactgctaaaattactgcatatggatggctctgaacagaattactaattaaccagatcttatatttcagaaacacccccttgaagatatatttttatctaaattaatggagcaggggaggcctttctgaaactttactttgggaccctagaatttagttataatatggcagacttttttctgggaggaaagtgcaagaacctgtctgaggacacctaaattaccttggctttcccttagatgagatatctgtttcatatagcagttgacctggtagcttcagtttcacctgccctgcttttatcaggagtcatgttttcccctatcaccataatccccaatgtttcacctctctgagaatatatagtgattttctatgtgcatttaattctcctagcagaggcacatagagtaagagtcatttatttcagttctctgtccttacagatccaatttagtaaacatcgaataagcaattattaatgtaaagaacttcagtggaagctgtagagcatggagaaaaagaataacatccccatctccctactggagtccacagtttattggaga

SEQ ID NO: 68642 - DNA, 3751 bp, Homo sapiens
gtggggctgggggcgggaagatggtttaacagtctaccctgcacagcgtcatcttgtctccctaacaggaagcaggctgtgagccaaggggaaggcagaggacagaaatgaatgtgtttccaggctttcctggtggtttatggcattctccaaactcctatgcaagggctattcctgaccaagaagatctaaagagaacgtctctgaaatcaagtccggatgaaggtatgtgatagggatcccttggtattgcgactgaaatttggctcagaggacataatgccttctttttttccaggcaatttggagattttgtcctgccttagatgctggttagaggctttaggtttgttaccagtccagaaaagatgcctaggtagttctgtaaaatgaaaattcatcagagtatgtgtcagttgaaaaattggatggaaattgtgtatagtgataattaatgaaacaaagcactcattgatgaaaaggattttttccccttgaagcctggaaagaggggaaaaaattaccgaaaccaactaggtttcatcatcactgtaataaaagctgtttcatcctttttcagctgcttattctatgcccatgttcccagaggttattggcagggcttggggagctgaagtgggcaggcgtgctgttcctttgtgctgtgtgatcatcttccttctgatgttcctggaaccaggggtgcttgtgattgttcccagctctgatttaggacagtagactgccacagaatttcacatcttgtagaaatgctagcaacaagaccctggggaagttctcaaaggaatctaccaaagttacaggctaaaataatcagccgtgaactcaaattttcatgtctttgactattttcagcacaaagagaggagcccctttaaattttattttgtctttatttaacaaatacttaagaaagttctttctaatgtgcaaggcactgttctaagcacaaacagtcattgaatccttataacaaccctttgaggaaggttttattacccacattttagagatgaagaaacagaggcacagagaagttagggaactttcccaaggtcacacagctagcaaacagtagaagcagaatttggacctacgaaacttgaccccaaagcctgtgctcttaaccactgagctatgctgcttgcctgctcatattatttcaaatgatgtcagcagtcaatttggcttcaaattttgttcagctgacgctactagaagattgaatcagcttgctttgctaaaacagatccccaaagaaatctatatttaatcttaaattatccctgtagtcacattctgtacccccaagtaacccagtaagtaattgccgttctgtttcccttgtgctgtatagatctctgtagtaaaacgctatgttactatggtgaccaattgatgtctcaagaaaaaagaaatctagaattatatcatgggttttttaaaaaatcgaacgtagaaacactcttccatcctagaacctagcaaggccagcctaagcatattttctttaaaagcacctacctagttctcaaaataaaatagattaaaaacttctaaaactatgtatataaattataatatcaaactgactggatttattttttaaaatgatattatacctaaaataagggaataggtatcttttgcaaattattttaggtttttaagggtaaaagaggagatttgctaataactttttttaactgctagaaatttctgaggtataaagatttcctttttttgatctgtgtagatttccttctggcctttgataataaaagatgactgatctgattcctataagctatggaaaaactaagaaaagttaccagttcccttcagggtttcattgcgcagtactttaagacgtaattgtgtcccctacaatattgaactttagtcttttagcttaagcatttgatccctgctgaaatctacatttttctggaacaagtaacactttgatgctattatagtcacatgaagtgagcttcttgagggatggtatcctttcctctttggatttctagcacttatcaccaggcctggtttatggtgaactctcaatatactcttgtgaatgaagactgagaagactcaaaacaatgacatattctgctggtgccaatttgggagtccatgcctgttttattttgcatgtatttatagagaggacagtgaggagacacatgtgtagtaagaacttggcaacagtcaaaattatgcctgaagtttatatagttaggctggccctggagcagctacaaattacagtttagaaagtatacataaattatttcctggagatcaccaatccccctgacatttttatttatatttagaatgaagttctcctgatattttcattcatatctaaatggaagcacccctaacagtcttattttcctctgatgttttgggtggttccatctcccagcgttgaaacagtttaattcagtttgagagtgaatgtcttgagaagtcaactcctgcctcaggcaattctctcctaatccagtctgactcccagtccttagaactctgtatagaaagctcacaggactgcaggactatttcctagggaactctgggatcttgagtatcagtgtgggttagggtcagactacctttcccaaaccatggcatgattgaagaagattgtcctgaatgaagaagattttcctggggcattttgaaagcttggtcaggatttaaattcaagttagcaagatagtaaggcttaaagtagtcaccctcctgataatatacacaaacataatctatgatttttccatctaattaaatcattaaggggttgtggataaagtgtgtgtccttgaattctaccagctcatgctgctcacctcaaacattacctgctgagcgagctgcacaaaacagacaacagccctgacggaagcacaaaccagctggcaagtgctacatgccccccacacatgcagggcttctcagataagcagggctagcacacacatgaggcatggatctggaagcctagctgggcttcctacacatccctctggagtctaaaagggggcaacctactcaaccagctaaatgggaggatagaacagagggagagaaagtggagaggcttccccttgaggagaggccttgccaagtatgatttcaacctagaggtgaggggtgaaagcagaaataagaagagggacaatgagcatgggtaaagactatgagaaagtgatacctgggtcctgcctttcggacacaacagcttgcctgcaagtaaaccctgccaaatgagtcagggcctgccaggggaatgatcagatcccttcctagggtgtatgtagggaggggagaggagagagaaggaccagagtgtggacgtagtttcttctccatcagccaaggcaaaaaattggatgacatgggagttgtgctgagaggatggcttaaaaagaaaaagggaggctgagtgccataactcacgcctgtaatcccagcactttgggaggctaaggcgggaggattgcttgagcccaggaatttgagaccagcctaaacatagggagaccttaggccaggcatggttgctcacgcctgtaatcccagctgtttgggaggctgaggggggcagaatacttaaggtccggagttctaggccagcctggccaacatgctgaaaccccatctctactaaaaatacaaaaattagctgggtatggtggcaggtgcctgtaat

SEQ ID NO: 68643 - DNA, 1051 bp, Homo sapiens
taccaattaaatcagaatctctgcgagtggagcccagacatcagtactttcttaaaaccctccattttgcaacaaaggttgagagccactgctttaagagttccctctagggccaggcacggtggctcacgtctgtaatcccagcactttgggaggcggaggcggggggatcacgaggtcaggagcttgagaccagcctggccaacatggtgaaaccccatctctactaaaaatacaaaaattagctgggtgtggtggcacgcgcttgtaatcccaactactccggaggctgaggcaggagaattgcttaaacccaggaggcagaggttgcggtcagccgagatcgtgccactgcactccagcctaggtgatagagcaagactccgttttggaaaacacgtttggaggaatgaagtttagagcttgagacaggcagataagtagggcatcatgagctctattcaggaggaaggccactgtgataagaatggggttaacgtactaatttgggaaaggtcattgataaagccattagtataattgccaggatacacaggcttagctgtagagatagaagagtgtcagtctcccaagctggtcttttgatctagcacaggcaacacagataatgatgtctttattgcattacacatggtgaatcttgggccatcagcagggctgatggcagtagtgggttggggcggatctttacaacctgcaatacctcattggttggggagggcatcaaggcatgattgaaatgtgtgttcttttccaatgagaggctgctgtacatgggaatgcatgtgcagcagggcattgataatgaagtgttttccggtagcctatcagggttgatgtggcagctctgaccacacaagtggttttgttattattaacagatgagaaaggtgaggttcaagcctgtctttgtagcctttcagggaacacagaatcacttggaatacaagtggcatggtcagcaatttcagcttctaagagacaagttacttgctagtaggacaattctggtttctaggtttataaataa

SEQ ID NO: 68644 - DNA, 1668 bp, Homo sapiens
tcatcccttctttccgtttttatattggccgtgaactctgtgaggggaggtttcagcgactgaagtagtaaaggagtgggagcgggagagccgattaatgaggttgtagaataagagagaaatctgaagggacaaaggagttttatttattttttggctggtgaccaagaggatgtgagtgtgagctaaggtaatacagtgggaaggagaagatgggaagatttgagagataaatgaaggcagtagctctgtagcctacctgggaggccagactagaaagaagttgacagtagaggacatttttcttaaaagagtgtgaacttatgcatgtttgtaaacaggcagaaatggcatgcatttagtacatggtgtatataaggtggaaatcgggacgcccctaatggaatggaatgaggaagattctaaaagccacagtcctgaacacaggccgaggtggaattgcgaagaacagtcgcggtaacagaagtcaggaatttgggaactgtctcgagggatctgaccaatctgacctctttttgtctctcaggatatatgggacacctgcaccggcattggatttggccccgcaacatcttaaaggtaccacccaacacctgaagtgtctgcctccttccgatggagcctcctggcccctcccacctctcaccagctttaccctttagccagaatgaaatgtggatttcatggaatgaaatggtggcatttagctaccacattactcagatgtgtcactgacaccttacagaagtacatacttctagcctctagcctcccagttcactagatattagagtccatcttgatatcggcagcaattctatgccacttagctactataatttgattctttgtatactatctggagtacaaggcagaagaatgctgatggaatacgtaattttactccaacaaaggaatggctgataggtaaagagtatcacttcatctgtaagaaaaactaaatatggaaagccacaggattgaagctagcagtgatggagaaggatcccagtgtgaatatatagaatggaagtacttcagtaaagagccaggcatggtaatcacttaccaagaaagtgacttcatttcattttggcagcctaaagtatatcctggcagctgcgctgtatgtgtgaagtgcataggaaaatgctgcaggaaaaatccatggaggcaatggaataggatttcagggttgaagcctgggtgtcttgttttagggagtgggatcatccagctctgagaggcatgacatctcgatatgatgtcatataaagtgtgtacaattgggaatcagacctgggctttgactttagggtctgccagtcactctgtgtgtcctgtctgaatctcagtttctcaatttataaaataaggataatagtgcctgtgccataggattattgtaatgacaaaatgaggtagcatagaacttagtgtaaagtacatgccacctatcagttgaattgtggatgctctgtgcatcgtaggtccgtctgtatttagggagctttaagacaggtactctaccgggtcaggcgcggtagctcacgcctgtaatctcagcactttgggaggctgaggcggtcggatcacaacgtcaggagatcgagaccatcctggcaaatacggtgaaaccccgtctct

SEQ ID NO: 68645 - DNA, 1056 bp, Homo sapiens
agcgaagtaaaaaaaaaaaaaaaaaaaaaaaagcagccatgcaaaatttgaaacttggagacgactctagaagcattaacccaagaaagcacaagccaacaaacaaatttttgaaatggtttgaagagctcttcaaagtcagtttcaggtggcttagaagaggatgttgcttataaaatgagatctgatggaaacttgttttacagatatgactggattcgtttgaaaacaaaaaaaaaggcaggcaaagtgactttttaaaaagtatttttatggaaggatttctaatgatacattttaatgtgctcaaaaaacaaccttaaataactggtagattcagccaaacctggatcattgttatcttagagctggataagagcataaatgttaacaatttggcaattttattggactctgttatgtttttgaatggtgaatttgaagacttcaacttgtaacaagaaattttctaaaaggaaagtgggattttcaagacatatgaaattaagcagagaatatgtatggacatgtgaacagatggaaccaaattttgaaagctttgcatgtgtccagcatcggtcacagaaaatccttttatctcaagaaactagcctctggattttctcacgttcaatatgataaaactcagtaaatccagcagcttgaataccttttaacacaaatttgtaccaaaatgagaagtaactttaaaattccgctccattatctagaggtactctgacttggttaaggtaaggtgaaaatcggttttccaagccagtattgaactggcattttcatcatgaagaaaaaaaaaatgcagataaagtgaatgggtatcttgttcactttaatgattaagactaactcagaaagctggcttactttgtcaaggcaaacaaccagtattaaacaaactgaatactctcattgcacataatgagaaggcttgaatgaaaattaagtatgggagtggaagagctgataaagaacagtgacttctttgagactcctagttcatttacatgtgatgaaaattatagtgtaagaatagta

SEQ ID NO: 68646 - DNA, 1653 bp, Homo sapiens
cccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacggtaatgaccctttcccaaccatagaatgtgtttggggccccgctttgcctgctggagggtgttaaccttagcttgcttttcggcgtattctgatttagctttgggagagctaactttattggtcttaggtgttcagtgctacctggcccactgcttgtctgtttgtgacttttaagtcagaaactggagatggtaagatccgataatttccctaacttaatacatcgcggtccctctcactagcaactcctaggtatgtgacaaagttgggatgtttatcaacggtccgcctcctggctagggaaagagctctggggcggagaatgcactttctgttttttgaaaacaacctcattttgtgcccttaaaagccactggggatgacggatccaggattgtgggtggaggtagtgggtttttcatcccctgactatggggccaacttctgccagccattgttttttctaataaagattgtgtgttctttttaaaaatttcccctgcgcttagattcttctactcaaaacaaaagagccaacagaacagaagaaaatgtttcagacggttccccaaatgccggttctgtggagcagacgcccaagaagcctggcctcagaagacgtcaaacgtaaacagctcggtgggttgatcactaaaggagcacgcactggaacccggggccttcagacctcacgatacctgatcttactggttgctggcaaattaaaagcttatggggttttgttttgtttatacttcgtgaggtcaaaaaagtagcaatggggaaggctggggat

SEQ ID NO: 68647 - DNA, 1578 bp, Homo sapiens
cttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctattcattgagtcaaattgtaatgtgctttaccaaacaaggtatttgacctggcattctagtcatatttacacaaatgtaaatgtgaagtggcaaatacctaggtaattcaggcccacaactcagatgatgttttatgtagtccgaatgtagttagcagttactgttttccacttagctctgtgtgggaggacaaaactttagaaggtgaaaatggaaaagctacattttcatatgaataaggttgtcaaaagtctgcattag

SEQ ID NO: 68648 - DNA, 1043 bp, Homo sapiens
aagctcttctctgacttgcagccttggactgtgttctgcttggctcactctccttcctttcctcctttcaactggttaactcatgctcagcttccaggtctcaacttgaaagtcatttctttaggagggattctctaaccctcgctctaggtcagggcccctgtttcaaactcttacagcatcctacaggcagccactggaacataggggaaggcactgcaggtgagggggatggaatggcattttttattttgtttgtttgtttgttttagagatggggtcttgttctgttgctcaggtggactggaactcctgggctcaagggatccttccacctcaaactcccgagtagctgggactataagtggctgctcagctaaagggagtgttggtggatttttaaaggcccttttcttttcagtaaacacaggctggcttggggaaagagtttcgattttagcccctgcttgcttcctcagttagtcaccttgtctgggatccaaactgctacagcatgaagcagaagctctgaggtcccttcatggcactcatccttcacaacactcacctaaattccatggaataattacagctgtgacgccttgtggagctccaggaggccagcgctcctgtttgtgaccttgaagcccacagagcctggccttagtaaaggctcccagagactgcacgcgacaatgcagcaatatctggcactactaagcaaccattaggttacacattcacgtgctttttttctagtgagattataaacgtttattgttcagcctacgctattataagatcatcttcttttgattctgaatatgtggtttgtggccaaaaatcaggactctagcttccctgaaaaataacctgatccacagggatggaatgtgtgatcttgactaggaaacaagaatcacagagctgtaagccagaaggaatctataaatcatcttcgtttaacttccccactttacaggaaatcaagaattagaatattctcatctgcaaaatggaaagaatcgatacagtggtctccc

SEQ ID NO: 68649 - DNA, 1025 bp, Homo sapiens
aactgcttgaacccaggaggaggaggttgcggtgagccaagatcacgccactgcactccagcctgggcaataagagtgagagtctgtctcaaaaaaaacaaaacaaaacaaaaaaactagctgggcatggtggtgtgcacctgtagtcccagctacttgggaggctgaggtgggagaatcacctgagcctgggaggtcaaggctatagtgagccatgatcacgccactgcactccagcctgggtgacagactgagaccctgtctcaaaagaataaataaataaaataaaataagagagtgacttgagcagcttcaaataaattttattgtttcctcactttatctaatattaattgaaatccttagtcttatgttggggttatcccaataggacgtgggaaagaaagttcaagctttcgccttgatagttctccatgatgctgcttaacataaacaatcgagttttcaaaaaccaaaactcttgatttcattaagtaaggagggtgtaatgtgtagtgcttgggccgttagaggggatgtggtcacaagtggtatatctgaggcttttgaaggagtgcattcaaggaagagccctgcttggtgtcagctactgaaccagagatccgaagaagtggacctcgccagcctcctgctccaccccgctaccagtcttagctggagctcccttttctttgtcatactcagccagttgctcattgctgttttagagtctggcccatgttttgctctttggctgtgcgattggcgtgaatcttctaagcaaatgaatagcttagaggtgaatactgaatcttttgcttcaagtagctcagcatttttgtctttcatttttactaagtgactagattcagtattcgaagatgttttggccaaatgattcattatttatttggctttagaaagagacttcaaaaggataatagaaataaacaacccagaggttttttttttaaattgaagattaataaaagagagacctctgctggctacagtggggtaacaac

SEQ ID NO: 68650 - DNA, 1726 bp, Homo sapiens
tgtcttctttttcttcacgagggcaggggtcgctgtcctattcaccagccatctagcatagccttagcaaatggtaggttctcaacattattgaataaagtaatgacataataaaaaaatagtattgtaatatcaatccgttccaaactctatggttagaaaagcggggaacataactggcgacacacgtagggaaggctctttaaaagggacctaaaggtcaactggagtccctggtgatcagccccttctgcactcggatctattccgcaagcctacgcgcccatattcactgggccccacctgcctagcggacgggtgcaatccccggcaagcccgcagggggcgcgcagagcacgtcgtccggggagaactaaaactacatttcccagcatcccgcgcgccgcagacccacttccggagacctcacacaagatggcggcacccgaggaacacgattctccgaccgaagcgtcccagccgattgtggaagaggaggaaactaaaacatttaaagacctggtgagaatggatgacgctggcttcttttatgtactctggtgctaggctcagggagaccccaggtaccttagatcccgctctgatagtgtacaaaagcatcttggggcctagcttgggttttccccagaatttcagagggctgggtttcggacgtgctctgagtttgggtggtgggagggctgctgggccctgagaccccctatttgccctattcgccactttagtgtggcaacgtttgtatgtgcatccaggaggttgtacatatggggaatggaattggtctctttataactggagctttggagtcagatgaaccaaccagatttgaattttgacacagtctcttactgaggacaagttgttacctctctgtgtttctctttccacatctgtaaattggggatagtaataagtacttacctcgcagaattgttgtgacgattaaatgagatgatacatgtaaagcacctggccttggccttggtgagcagaaagtgttcgttaagtcttgagctactgtctcatggtatagttaaagagtaggctctgagatgcacagtaaataccttttaaatcaaatacaatggttgtacatgatgggtctgacagtcagttaagtaggagggaggtaggggtgtgctgttcttggctaaggtatatttttctgaattccaagggtgtgacagatgtgttgtgtgaagcttgtgaccagttgggatggacaaaacccaccaagatccagattgaagctattcctttggccttacaaggtaggttgtatgacttcgtacagatttaatataaagttatctcaattagataccccttttgaaagctgttgcttgcatacttcaagtgaaataaggatatggtcactaaaggtacaaagtttgggtaatggtatttgaaaatgtcattctccaattttactgagcttactttctgtcttaatagctgaaagggtttgttctctgccacagatgctgactttaaggaagccctaggttaaagttaaagtatattaacgacaatcttggtagactttatgcatcagtgggcgcacacttagggaaggatgcctggaacacatatgtgtgtcttgaggagttgagaattcttgctgtgagccatgtttatcagatttgtaaaacagtggttaaagcagattgatggctactggaactgaaactaatgggatgaactt

SEQ ID NO: 68651 - DNA, 1068 bp, Homo sapiens
tttcaagacagcattttcttctgtctttctagctgttctttctcagtctcttcttctggttcttttccctttgccttacaatattgattctgtctttacccttttttcttactctgaaatactacataacatttctcattcagtcctcaagcttaaaccctgtctgcatcagtgagtctgtattcttcagaatcatctatggagctttttttttttttttaaatagagatttctaggtcccagccaagacctactgaatcagaatttccaggcatgggaccgggcatatatatatatgtaagtctcatcgattattctgaagcatctgcccctgaggaagtaccagtggtaggatactcatggctcccatgtctgttctaacccccacttttttcctgagctccaaacaagtatgtccagctggtttttagacatacctccaaataattatgcccaactggtttttagacatatctctaaacaagtatgtccaactggtttttagacatatctctttgagtttactataggaatcttaagttccaagttccctgtgtggaaaccaaagtccttattttcctcaccaggactaatttttctgttgcctatattgcagtttttggcttttgagtgtcccgtactaaaaatgtgtgagtcacccacatttccttttgttagtttctgaatctcattcctgtgctcattcctggcctcagttcaggccaccatcatatctcccctgaattacatccaatgtcccagttaagcctttgttttccctgttctggtcatttaagtcatttctgattgtaagtcatgttcaggttatgtcagggaaaagagatttgtttattgtaggattatcttctaggtaaagaaaacttctcagcagttacacagtcagaacaggggcagcaactgtaggggtcatgatttaatagggagcattctcactggccactgtggtagtgcatagctacctcatgggctacagccagctcggagatagtgatctcaactcaggagttaatttccaagtcttatgagttgtggcttgagtggtgatag

SEQ ID NO: 68652 - DNA, 1964 bp, Homo sapiens
taatttcttaagttaaatttggtggagagctgtggggtggggcagataactttatttgtttatttgttttgttttttttttgtcctgttctgaaatgtcactgtttctcctcaacctttcttggtagcaactcctggtcgactgattgaccacttggaaaatacgaaaggtttcaacttgagagctctcaaatacttggtcatggatgaagccgaccgaatactgaatatggattttgagacagaggtgagctctcaatttctttcctcctcttagagcatctcaaggttcctgtttcaaaatttggttcattgcccacttgtttcatgtagaacattgcattagtatcagtttcattcttgatattcttcaaattgcagtttctcagcacccttttatctttagaatatagtctgactctgacttcagaaatgggaaatatcaaaaccggattttcttttccctttcgtttaatttagaccttgacatacaccctgaaatatctttattttctttgatgacccactaatcccagcttacttagttgattaatactttttcttgacttttctcttaaatcagctctggtctactaatttaaactgttcttttctcagaaaggtattttttttaatagtatttggtagggtatcagatagtaaatattcagtaaactttagctgaatcaaattgaattttcgagtcccaaatcttcacagtgatatatttagtttgttagtgtctacctccttcactacctagaggatttgcagctcttccagtctgaatatcatattggcatcttttcctctttgtgctttaggttgacaagatcctcaaagtgattcctcgagatcggaaaacattcctcttctctgccaccatgaccaagaaggtgaaatttgctaggacttttgtttcttctttatgagaattgatacataaagtaaatagtaataacaataaggaaaaataaattgctttagtccgttttcacactgctataaagaactatctgagactaggtaatttatacagaaaagaggtttaattgactcacagttccacatggctgggaagacctcaggaaacttacaattatggcagaaggtgaaggggaagcaaggcaggaggtgggggcagtgccacactttaaaaccatgagaaattgtgagaactcactatcatgagaaccgcaatggggaaaaccacctctgtgatccaataacctcccaccaggtccctcccgtgacatgtggggattacaattcaacatgagatttgggtgaggacacagagccaaaccatgtcataaataaagagtgtttaggcatcagtgtgctattctggatcttcttccttcaggttcaaaaacttcagcgagcagctctgaagaatcctgtgaaatgtgccgtttcctctaaataccagacagttgaaaaattacagcaatattatatttttattccctctaaattcaaggtaaaatgtttactttgatcattcctgcctctccctcttcttttcaccaaagcatctgaaaatgtgtcaactcttgattaggtaagagctgtaatgcagattggcatcctgtctgtttgctttagagtgcatatcgtgcttatattatcaccgataagccagacatgccaggaattcacaacacattaaatcacaatactgaggtcatgatgtaatcatataattccttcccatccccatccttgaggtaatttttcctttgtctgcttattatgtggcttttatttaggatgaagcccctggttttgtgctttgatataaggacttctcctgtttgctgagtacagatctcctgcctgccttaaggctaagtggggaatatgtggttcacagagatgataatgctggttaaggaatgcaaagctggcagctggaggtctggataattgaaaagcgactataggcttagtctttaccttatg

SEQ ID NO: 68653 - DNA, 2763 bp, Homo sapiens
tcctgggttcacgccattctcctgcctcagcctcccgagtagctgggactacaggcgcccaccaccacgcccggctagtatttttagtagagatggggtttcaccgtgttagtcaggacggtcttgatctcctgacctcgtgatctgcccacctcggcctcccaaagtgctgggattacaggcgtgagccaccgtgcccggcctacagcttgtagtgcttagtgtatctcaaggtttctcagccttggcactattaacattttaagctttcgaattccttgttgtgggggttgttctttgagttgaaggattcctagtagcattcctggcctttacccagtagataacagcatcacacagtcttccacctgtgataatcagaaatatttccagacattaccagtgtcccttgaggatggcagaatcacccctggatgagaactgttgtgtctcttgtctttgtatttaactgctgtagacaagatgctgtctcatttgattttcataacaactctgtaatatgggcatgtatttctattcctgttcactagatagaaaccaaggttcagagaggttatgtgatttgcaggtaattgtgtaactggcagatgggaaggatcagagctgtaatccagctctgcctcgagatccagtgctgttttttaaaataccatgcagcctgcgaccatgtagatatgctttgtagatttatctgtctgtgaaagaagggaaagcattggatcaattttgtgctgcaaggagaacaaaaaagatgaagtagatttgtctcaacaaattgccccggccatttattttctccatgttacgaaatgaatctattttctttcaaaggttttgcagcaggactttgcatatgtagttttttttaaacttataatccatataacttgaatttatttaccctttttgttttaggattacatccatcgagtaggtcgaacagctagagctgggcgctccggaaaggctattacttttgtcacacagtaagtaaatcagctttagggccgagcaatgtagagaaaagagcagaactttcaagccactggctgagaacctgacactaccatttactacactaatcactttcatactgaaaaccaggatgaaggagttgaaagatgggaataataatacctatctagcagggttttggtgaaaattggagattatatatgtaaaagatctagtatagtatttggcatgtagaatggtacctagagctggagagcaattgcctttgtgtcaactcagaaagtattagaataactatttccaattgttttttttaaagaaacaaatttttatgtacccaaggctgttctgtgaataaataccttgagggattttctccctccctcctttcctttttttttttgtatttgtctcgctctgtcgcctaggctggagtgcagtggtgcagtcttggctaagtgcaccttccaccccctgggctcaagcaatcctcctacctcaccatagcttcccaagtagctgggaccacaggtgcatgccagcacacctggctttttaaaaaatatttttagtagagatagggttttgtcatgttggccaggctggtcttgaactcctgagctcaagcgatccacctgccttagcctctcatagtgctgggattacaggcacaagccacctgcctggccgatttttgtttctttttctttttttaagcagcaaggtttcactctgttgaccaggctggagtgcagtgacttgatcatagctcactgcagcttcaaactcctgggctcaagtagtcctcatacctcagtctcctgaatggctgggattacaggcacatgccaccacggttggctaatttttaattttttatagagatggcatctcactgtgttgtccaggctggtctggaactcctggtctcaagtgattctcctgctttgacctcccaaagcgttgggattacaggtgcaagccaccatgcctggcctcccttgagtgattttctaatgggctatgcacagagattgcacttaacccatatttagaaaagaaataatatgttcaatattgtttaaacctatggttcctattgcgttgtatcatataataatagtttgggaatggacaggcatttgcgttaccaggcaaccagagctgtgcagttttccttcctcaggtatgatgtggaactcttccagcgcatagaacacttaattgggaagaaactaccaggttttccaacacaggatgatgaggttatgatgctgacagaacgcgtcgctgaagcccaaaggtttgcccgaatggtatgcatctttcttttctcaccagtgtctgtgcaaacaatgttaactgtgtgccactttattatattaaccctcatactaaactgcagaagctgggtattattttattccaaatttaagacgagcaaactaaggtgcagagatggtaggtaatttgcattagaccatacaaccaaatggttgaatcaaggtttggcctcattctgacattcacacattcacagcacctgttcatgtgtcgcacgtggtgagatagttcatcagacttgaggtcagaagatccagctgtgaactgtgtgagcttgggaaatttgcctgatttctcagaatcagaatcagtttctcacctgtaaattgggaataacacttgcctgaataccttatggggttttatgagcaccagagaagccaatataaactacatagttactagtaggggttgatcatacct

SEQ ID NO: 68654 - DNA, 1045 bp, Homo sapiens
tgaggctggggaatcgcttgaacccgggaggcagagattgtagtgagctgagatcacaccactgcactccagcctagggatagagcaggtctacatctcaaaaaaaatttttaaaaagttaatttcataatgaaacataaaataatgcttttaaagactattgcgggctcaaaccttcgcgctgacatggctaaatgcaccaataaagttggaattgtcagtaaatacaggatccgctatagttagttaatttcataatgaaaagttaatttcataatgaaacataaaataacgcttttaaagattattgcgggctcaaaactttgcactgacatggctaaatgcaccaataaagttggaattgtcggtaaatacaggatccgctatggtgcctccttccagaaaatggtgaagaaaattgaaaccggctagcacgccaagtacaattgctctttctgtgacaaaaccaagatgaaaagacgagatatgggggtcgggcactgtggttcgtgcatgaagacagtagctggtggtggctgaacctacaataccacttctgccgtcacagcaaagtctacagtcagaagactgaaggaattgaaagaccagatgtttctccaccattggagacatcactagcctttaataaatgggttaacttatgtaataataaaaaaggaccattatcagcataattccctagggctattgtcctaaacttacttacttttttttctttgagaccgagtcttgctctattgcccagcctggactgcagtggtgccatctcggctcactgcaaccttcacctcctgggttaaagcgattctcgagcctcagcctccagagtagctgggaatacaggtgcccaccaccatgcctggctaatttttgtatttttagtagagatgaggtttcaccatgttggccaggctggccaaaccttcttgatatgcatcctattcaacataatatctttaacatacttgcacatatgttaaacaattacatacataataaatatatacaaatatgccatatccat

SEQ ID NO: 68655 - DNA, 1050 bp, Homo sapiens
gcatcagctcagtgaactccaagcagaataaatacaaagaaaaccaacctcaggtacatcacagtcaaagtgttgaaaatcaaagataaaaataaattattaaaagcagccaaagaaaaattatgaatgatgggtaatttctcatcagaaacagtagaggccagaagacaatagaaaagcttccccatcccctaatatggtttggctgtgtccccacccaaatctcatcttgaattgtagctcccataattcctacatgttgtgggagggacccggcgggaggtaactgaatcacgggagtgaatctttcccatgctgttcttgtgataacgtctcacgagaccttatttctgactggactcagacttagatgtagaagctcacagagaggaaagtctgtgtctcttcgcaatttgttcctggcgcttctctttagcctccttcattcccttgcctaaaagtttagcatattctgcagcctcttccttatttttcttagtacacggcttcttcagagcaatatgctgccctttgtgctgcaggaaatgtggagtaacaagatgctgaatcttgggtgctttggtcctaggtttcttacctcctttgtttgagggctttcttacaacatactggcggacatcatcttcttcagagagattggaaagtttgcagattctgctagcttttttgggccccaggcgacaaggcaccatagtatcagtcagtccaggaatatccttctttactttttttttttttttaacaataatcaagttgagaatgctcagattggcatccactatgcaaccacgaactgattttctctttctttctccagttctccttggtctgtaacaggaatgccccttactcagtagcaggtggacacggccatgggtcaagacaccctgcttcatgggaaaaccttgtttgttgttcccaccactgattcggaccacataacctttccattcttcacccagagtgtcagcagcaacttctgtggccataagcttctcataaaaagtacgaagtttgcattcatcatcc

SEQ ID NO: 68656 - DNA, 1049 bp, Homo sapiens
cctgtctggtctcaaacttcagagagcaaatgatcctcctgcttcagactcctgaagtgctgggattataggcatgagccaacacgtccagccctgtgaagttttttgagattaggcttcaaaatacctcttcagagtgttaggttctctggctttaaggtaaatattaatatagttaaactgggggaagggacatatgggatttcttcctggttcttcaacaggttttagaatttactacaggaggtagaggaaagttagtagctttacttaatgtagtaagctcaaagtcaaaaccctggctaaacatgcaaaattggtttcctaatccttttttagtcttctgtgtctgaggactgtgttaggagattcaataccttctccccactccaacattccttttctgcaggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcc

SEQ ID NO: 68657 - DNA, 1022 bp, Homo sapiens
gcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctca

SEQ ID NO: 68658 - DNA, 1011 bp, Homo sapiens
gctcagaatattcctctgggcaacagtgtcatccccctccttgggaacctcacatttgcacttgatcaggcagccagctgtttcctgtctccccctaacttctcttacgtaaagtggagggatgggtgggaaagagtggggatgtctcctggagcacaaacctacagtgcctctagccctgcctggccaggagtgagaacttggaaggccacatgcattttgctgacccctgcctataattcctccctattaaccaggctttggcctgcacctcgttgtttgtggtgtttggcccaccctctggcttaacacattcatgattccctctcatgttcattcatttcacatgtattgaacctctcctgtatgccaagcactgtcctaggcaattccgtttataagcgaacaaaacaaagatccttacccttgtagagtagggtatatagataacaaataatagacatgtaaattttaatagtatattatattatatcttacaaagtagtaagtgcaatggcaaaatttaaaagtagaccaaagagaatgggcagtgtttgggaggtcagtatggaggcggtggtgtgcagttcctgctgatgtggccagggaagccctcctggagaagaaagacttgaaaatagtgaggggttggccagacgcaacctgagggaagcccatcctaggtggcgcaaaggctgtcggacagggcgggcctgtgtggtcaaggaacttagaggtcggaggggctgaaacagagagcccaggggaagcacagagaggtgacaggagtgggcaggtctggtaaagacctagaagtcacttcagaggctttgccttttcttctgtataaaatagagaaggccattgtaggatttcaagcagagcagtgacaaaatcaaacccactgttgcaagaatccctctggctgctcttttgatcatatactataaaggggtcggggttggggctgggggatgaggtcagaagcagacggccggttaggagtttcct

SEQ ID NO: 68659 - DNA, 1016 bp, Homo sapiens
ggttccggattccaaaccaatttcaaagcgacccaccagctcccagtgacaaaagcgttaagattgaggaacgggaaggcatcactgtctattccatgtaaggagacaatccttcaggcatccatgggtggcgcttgattcccgtaccactccttgcatcacctctggcaagcattcgcgtcaaatttttatggttgctgaattaatttaagtaggaaatgctgaatcctaacagtttctcattttaatttcttcaggctgcagcacacacacatttgcattttatcagaataaatgccttggccagttgccaaattgatgggacgagcttaagctttgcttaagcttacagtgaatgtctacattagccatagcagggttctaggagactcagcaaatatcttaagtcaagccatggtctggattcgtggacacatgggaagcataaagggctgaggaatacctgatttctaccccacactccctttgaatgccagagagcagggagcatttgctagagctgggcttccatcctccttgttgttcctggatggtagtcctttgagcagagcacacatctattctcttgtcatcctggtcctgtttccaggacttcatgtggggtcattttcccttgactgtagagaatagcaggtgcaaatggttactagtttctatcccttgtgctccaaactgccctcagaaaccaagtcttctagatcattgatgactcctcacatttgttaaaacactcccatgtgacaggcaccaaaccaggctcagggaaagaccaggatcttcaccagaagtaatcataggtggtttggctccgctcaggagcaacctcatgaaaaattcacatacatataatattgcactggactgagtattggtccacttcagggacctccaaacttggctgccctgctgcaaccctgaacctgatggtgggaccattttccccggagctgtgtcaatgttctgagaatgtgagtttcaccgctgtgtgtagtcct

SEQ ID NO: 68660 - DNA, 1005 bp, Homo sapiens
tcggccttgaacgtcaggggtcttttcactctaaatcctgagcttttgattccacttggtcagtctccagctgccgagattaagcatgggaaatgatttggcacctataagttgaagataatgtatggaatcttctttaaggcagcattaggggtgatgacaacttccagagctgattcagtacttcgggcagcagctccaagttttttttcctttttttttttttttcctcctaaacctccagagtaggattgtactgttagaaagttgatatttaaataaaagtatatttattccacccaagtaaattttaaacattaggctttagaaaaattgatggctctacctaggtaagttttaagcattaagctataaacatttatttgctgataatttgtattagagggaaaagcagttgctttcatagctatctctagagagggctatttgggttttggttggatagctagtttgagcttgcagggggattacagggtccttgttctcaaggagcttccagtatgctaccctgaagcgaaccttgccatttggatgacgctaggttggatattaatttgcgtttctgtccccagacttcatgacctcagacagattattattttttttaatatgggctcattggaacattggaaggaacactgatagcatctgccttggaatgtgtgcataacactggaattaaaggagagacgtggccctttacctgcaggattaattttttacttttttactttgtatatccttagtgtagaatgatgtcctcccagaggggtaataagatgtcagacatttagctttatttcttttttttttttcttttagagtccttttttaaaatttcagtgtaggtcattgttattctctaagaatgagaatgcatgaaaatcttgctttagcaactcttgaggtcttttgtgttcttatgccccaaggctgtggtgttattactccctggagtattagttgtaggaactggttggggtt

SEQ ID NO: 68661 - DNA, 1052 bp, Homo sapiens
tcacttggtgctaaaaatccaattgcacaattatagggtggcttaagcatgtgttcaaaatgcttggaagttttaattgaatcagtaggtgatgtgaatgccaagaaagctctcaagatcttacgttatagaaattgaattgttgtttgctatctggagtaggtaggaaatagctctgccctccctttctctggtcagactgtacctgggattgtatctagttccaagaaccatattttaaaaagcacagacatatcacattgtgtccagaggagaatgaccaggatgttgaggacacctgaaacaatgcttctttaagtaatgggttgaaagaggtggaggtgtttaagttggagctgagaagagtgggggagggcactgggagatacaatactagcaccagtgatggtaatgataataatagaagctaaaatttattgtgtggctataagccaggcactaagaagcagacatatattatcttatttgattctcatcacaatcatatgagctaaaaagaataattattccatttcataaatagggaaattgatgctcaataaagttaagaaatttgagattacatagttcataagagatatagccaggatttggcttgatgtttgattgtgaagacttgagctcttaaataccatatcatatgtctcttatgattgatacctttgagtgtttgaaggacttacatgtgagagagggatcccagaaattaaaactaggacagataattggcaacttcccagaaaaaaattcttgaatcagtgtaaagaattggtttctagattggaggccagtggattccctaatacaggttacattcaggtgtttgctaagtaactggttgataggtctttgtaagtagctagttgtaagtttgggataggggtggggatagattatgtgatctttaaggtctcttgctgtgctttctcaagtaactctagagttgagaactctgtgtgctttcctgtttttcagatatatatatatatatttaaacattttaaattgtcaaaaaatacatacaccataaa

SEQ ID NO: 68662 - DNA, 1033 bp, Homo sapiens
cagtagagacggggttttgccattttggccaggctgatcttgaactcctgacctcaggtgatccacccacctcggcctcccaaagtgctgggattatagttgtgagccactgcacccagcctgtgacctgcttctttgtgccacttaattttttgaaaacaatttattgagattcatctatattgatgcattatacctggagtttattcattttcactactgtctgatttttccatggtatgaatatctcatgatttatccatttttctgttgatgaacctttaagtaatgcttccagtctttttttttttaaataaataaatgatgctgctaagaacatttttgtatatgtttcctattgcagtgtataagaatttatctaaggcataaacctaggagtaaaattgctggatcataccatagggtgtgtgcatgttcattattagcagtttatgttaaattattttccaacatggttgtaccgatttacatttccactagcaatgtgtgaattctctccaaatttggtgggcatcctctgagtccacacttttgggtggtggggggatggaagtccagactcctcactaggcctctgctgacaccacccccgtggagaggagggagagggctgccttgttgatgctagttggggtggaactcctttggtcctgctagatgaggatgacagtccttgcccccacctggctttctctgacatgaccctgatggtggtggtggtggtggggtaccttgttacatccaggagagggtgggagccaggctccacattcagcctttgctatatgagtgggtggagctgggctgataattttatctgtttggttggagtagagcagttattatctacaactttcctgtcttgctggactgcacctttcctgggcttttggctagggaaggcagccttttctggggctttttttgtctgtatctgtggtgtttctgggttgctggcttttccagcaccctatctgggtattatgaggccaaaagaaaacccaggggactc

SEQ ID NO: 68663 - DNA, 1058 bp, Homo sapiens
ggaacatggcatctgccttttccaaaggcaagaagttgtcatagtgaccagcctatgtgtccttcctcagggaaagccatttggactttaaacccaaactacttgtccaacggtaccttggctgccccagttgtggtactgccagacttggatgaagacggtgttcgagaccttgtggttctggccattggggaattgcaggtatgatctctattaaatgttttttgtttcttatagggactgcttctattttagttgtctcagctcctagtgttacattataaatgctgcttgaaatgttctttttacaagggtttaggtttaagtaaattctctttgtgaggttaagtgaatacttgaccattatgaacccattttctctggcagcctcatggctccatggactggggtgtagtggagctttagagttagttaggtctgtatgcgaattccacctctaccactttatatctttgaggccttgggcaagccgtggagcctgtccaagctctggtttcttcatatgtaaaaaaggcatgttatatctacttacatcattgttatgaaaattacagctaacatatttaaagtgcctagagtagtgcctaatttttgctgtgtatatgtatttttagttttactgtattatatatatgtacattttatgtcaattataaaacaacagaacaggctgatacaaagttcataaaagatacataggaaaaaatctaagtcaagcaataataacaacaatgaccaaagaaaggagtgtcataatctaggctgtgacaaggcagactttgattcaggacagtggcccttgaattatggtcctaaattatgatttgcaggaacttcagtgtactggttactctgcacacagataaaataagagtagtctttcccccaaatcacaggaaggaataaattaatgaacagaataatctcaattttaagtttttattctggaagcgtttttcagagcttttgtcaaagtttctctaagactttttctcagacttcctagtgtgtctgccaaggaaatgcttgtgcacaaa

SEQ ID NO: 68664 - DNA, 1028 bp, Homo sapiens
ccatcccgtctggccgcttattagctggtggtggttggcaggatagtggctcaggcccttggggaccctccatagtaaggaggtctccactggaggaagtggcttcttgcccactcttactctgtgccctttgtgttggtctctactcagtgtattgcccatcttgccctacagaatttacttgttttcacaatagggtacagctagggcatagtctcagttctgcttgaaaagtggtagacagttctaggaaaaccttgtagaggcactaggtatatagcgcagcagcttcatccttgtactgacctcttttgacctctctgccagcaacaagggaccccaggaacctgtataagctcctgagatggaagactctctcttcacaaggaaggaaacctaagtctgtgacttatagtgattgcgttcattgatctgggtttagagtgaagtgggcttggagaactggacctggtttttgattacaggaactgataaggtctagaacattagtgggaagggaccttgaagaccatttggttaactttctcacaccatgctatgatctctggttcagcattacagacatgttggcacccctactctcttggtgcactcaggctgatgggaataacactaatttgtgaggcgatccatttcatttttgggccagctccagaaaattctgtcctaagcagaaagaaatctgctttctcatagcttccactcattgttccagcttcattcccatagagctactgtgaatgagtctaatcccctttctataggaaagccctttaaccattagcctagtccctctaagcttgctactcaggactaaatatccccatttctcgtactgttcctcatgcaaccaggaagtccaaacccctctttttcttgatttctttccctttgcattctagtatgtccaaatctcttttaaaatgtggtacttatatctaaaaacagcattttatttgtagtataattaatatatcaacctaagggaattgtttcttattttgatg

SEQ ID NO: 68665 - DNA, 1052 bp, Homo sapiens
aaccttctgattacaaccagacaaagccttgtgctgcttcgggggcaaaatctgacaccttactgggcattgagacttcaaggcctgcgcaggtttgcattgtgttccttcttgtgtttgctgttttgatccactttcccatgtttaaaaattgtccaggacaattgcttgcaattcttatatctggggccagtgcaagagaagggagggagagttcttagttttcctgtttttcttgttcactattgattgcttactttgtccttatttgcagccagcctactcctggatatttcactgatgatcagacattagatttccttctgcagatacaggatggagttgggatgaaaaaggtaaaactttgggcctcagatcaatcaaagcatatgtaaagtatatactttgtgtccaaccctgtgttaggcacagcagggaataaaaagaacctaaaatatgatctctaacttcaaagaactcaaagtctcattgagtggataaaatgaaaactcacaattcattgctaaaatctgtagcactggaagcctttctaggataatctccttcctatgtaggagtttcttgttttggatccctagcttacagttaggcattgggggccttctgaaatctcttggtggggaaagacaggtataaagaaatgtaatgctttaacacacagctatacctaagatttcagagaagtctgtggtgactggggttttatggaagaccttataaaggagggaaatataagcagctttttaaagctgaatcgtatttatgtagacaggaaaacatgccaggtcaggggtgccaagagcagaggcccagagacagaaaggatagagcatgttccaaggacactgaatagatctttgatattgcatgaagttgcatattgtgagaatataatgattggatggatgactttcatttctttaacattacagcagaattacagagttacaatttttttttattatcgaccttgcattttggtttattttcactgtgaaatatatatctatttctatacattgcacattgtt

SEQ ID NO: 68666 - DNA, 1834 bp, Homo sapiens
atcttgctcaaaatgctaatgttccctccccatccccactcccaagaaatattatagtctagtgcaaagttcaaaagcttatcatggaaaataacaaagtttctgggcctttctggaaggaggaaatgtttacagactattggagctaaagaaaaggacgggaaaatagagaaatattctgacctttagttttcctgcttttctttgaacatctctaccatgaaaaacaataaagtcacgataactctttttccatagatctaatctgatggaatcttcagttgcagaagaagtgaacagagtggataccctctctactctcctgtcactgtaaaatcagttctatggagagaagacttcttcgtcctcatttaccacctccctgatggttgcaaaggcttgggaaggcatgttggagtctttgacggcagcatgatctatttggctggggcatcttacctaccttttcagtccctgcattaatcccctctaggaactctgcgtggatcgtttggaaatgtgaatctcttaagtatttaatttttttggtatgtctaatttatgaagtcttgctgggaaagccagtgaagtctatgactaggaaacattttgttgtacattgtgctgtgtgtgtgtatattttagtgttgtggtgaagttattttccaggtatgtcctaagcttcagggatccagtttcttgtccttctgaaatatatctggtttgtttggtcattttgagacttccagatgccctacctctgatgttgagggccacttatttctctccttattctttcccacctgtaccttggctacttccaaattgtagacagaatgagaaagatttatagtggaagactgagttagccatccaagcattttcatctctcttgttttatatcctatttccttagattttccatccatgtctattaagtgaccacaagaataactatattcctatcacaaggggagcaagaggatgtagtctcagtgacccatctctgaccaagtccacatgttgtgttatatgtggctctgatggttctgccagtcatgatcttttttctgtggcgacatcagaagtgtatgtttgcatgctgtcttcaacttagaggagaactggaagtcaggagcctttgatgtccttatcctgctgtatgtcttctctgcatctttttctatagggcaccctccttagctcccctcactctgttttctcttctattcagggatatgtttctggactttttcttctgctacttgagtccaggatgcaaccattttgtcctgcatctcttctttcctgtagagcctttgaagcattgtattttgggaaaattcttctgtaaatactataacttttataaatggttaagttatttagaattatctccagtgcttacttctcccttcttctgtataaatctgctacttcaattaagttctcctctaaacttttaggtcattgtttatatagcagaaaattcaatgttagcggatggaaaactgcttcttgaataaccttgataggtcatccctgagtgcacctcaggttctctctttacctgggcttgtatcttttttttttttttttttttttttttgagacagagttttgctcttgtcgcccaggctggagtgcagtggcacaatctcggctcactgcaaccttcgcctcctgggttcaagcgattctccagccttagcctcccaagtagctgggactacaggtgcccgctaccatgcctggctaatttttttttttgtatttttagtagagacggggtttcaccatgttggccaggctggtcacgaactcctgacctcag

SEQ ID NO: 68667 - DNA, 1012 bp, Homo sapiens
catgaatatggttccttctttaacctcccacatgtatgtacatagctgcctaacacaaaagctcaggcctatttgggactctcagatgtacatactcggagggacacacccagtgttgctacctactaggtcatggttagatcaatccaataccaggacacaggcttctagctaggccttttggggattgtcccataatttggtccatagttcatgtagcccacacctatacattgtcaccacccatcatagtaattacgggaacaggctgcccatcaaatgtagcctccttgtaattgctggccagcaatctgggtatcagccccttgagaagagctcctaacccttaaccagcgtagaacgggaattttctcaccataagcttcccttttctaatactcttcccagatccgcccaggtgatcttgaatttctggactgcacttgctattcagtaatcaaggaagcccaaatatggttccagttaggggtttacttgaatcttcagcacccagccccgacatacacacgtcctgagactgctctttgcaacaattcagtccctggtgtcctgcctgggtaaaaccatttccttcaatttacctgggagattcactgatactaaagcagaaagatgaaagcacaaacacctgtggtgattgctgcttctctcttcctttttaacaaaatgtttgggtcaaggttttcttttgtgttgtggagatggcatttccctggaactgcaatggaatcctctgctgttggtgcgcttggacttacgtggctgtgacagtttttctatttgctgagcctgtttcatgaattgtttcttcaaaccgggtagttaaactagagagccctttcagcacaggttgaaagcgtggcaagaatcctggagcagatgtaagacagctgactaggaagacagaggggcagtggtgttatcttgacgctgccatgtaaccacaggcgagacacttgtcttcttgctttcggaagttgaacttggtggt

SEQ ID NO: 68668 - DNA, 1652 bp, Homo sapiens
caacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcatccatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttcattgtgtgaatgtttttttctaaaaaaaatgtggagaaatatggataattatgacatttatccctcattaagctgcctatcagtttgatttggacaacttgacatttatttgagacattaagctactttctggtaatatattaggcatttctgcaatagctctttcaggtaactgaatattattaagcatagttttatcttgctttgattaaacctcttaggcaaaaaatggaacttcataagctaatacattagaaaggggttatgattataaatcagaaatgcttgtgacattaagaaatgaggcacttgtgaaatttctttgaaatagccagctcctctaatgtgtcttcaaaatataaagtgattcacaaaggcatgcatcacacctatttgtagcagccc

SEQ ID NO: 68669 - DNA, 1020 bp, Homo sapiens
ttacatctgcataaccacaagtcccactcaagtgtttcacaaataaaatgacagtcttcgccccaaagatgaattctcctggcattcctacgataaggatagggttgtaggggggtgggaacccctccagaggctcaggatttgtcattagcattgaacatactaaaaacatatgctttgactaaggcaggcttgttctgagcccttgaagcatgtttggtgttcttgatggccatcatcttgaagaaaaacctgaggtgcttccaaaaatattctaggcactaaattagtgaagacgtacactttgtggcaatgagtctgcaactgttccttgaaaacatctgatgaggctggaaaataaggtaaatgattatatatatatatgcttcccctcgctacaaaatatactgccataatcatcctggcttgtgtttccaccactttgcagaaatagttttttttgaaaactgtcagtgttctccaagatgctgtgtcatgtggcttttcttaacccacatctcccttcttgactctttaggatgtttgggattattgaaattcagtttttattggatctcctggtccttcagtctcctgattttccttgaacctctgttgctccttcttaatatatatatatatatattttttggccttctcttctttcccctttccttcaagtgtttttatggccaaggttttgtcctggactttttttctgtttcttacattttctcctttagtaacctgattcattgctatagcttcacatataatttctctgtaaatgaatcccaaatttatatctctagctttgacatttcccctgtccatttcatcttttttttttttttttttgagatggaatctcgctctgtcgcccaggctggagtgcagtggcatgatctcggctcactgcgacctccacctcccaggttcatgccattctcctgcctcagcctcccgagtagctgggactacaggcgcccgccaccacgcccggctaattttttgtgtttt

SEQ ID NO: 68670 - DNA, 1050 bp, Homo sapiens
aagataagaaaacggaagtctagatgatttgatgcaggccacaaatgatagctttggcataatttttttgacaggccctgcagactctcagaaccacttttctggtggtctcttcccatcttcttggtcattccagaattccacaagaaatttctttcagaggatcatttatatttttgaaagaattagtttgcatttgtaaaagaataggggaatagaaatattcaaatcaagtgttcagggtaggttctaccttcctagtgatgtatgcaggggaagagtgtcaatcctgggacagccaaggaggctcatctttccggaacagttggctgatggggacacaaccgggtgctccctcagcctttcattagactggtcttactgatagtcccttgcagtggacttcagggtggcacaagggcatgtaggacacaggtgctctgagctaatccatttaagagattccaggtgtgggtgaggcaggctgtataaagaacagacacttggcatagtctcaggaagttctggcactcacccttgtcattggagtctttgttttattgaaggtgttgtgatcatgatcaaagctttcatgatatcctactggaggttcccaccataatccagataaatactcgcaagcttccttatttaaaactagagccaagatgggcacagtggctcacacctgtaatcctagcatcataggaagccgaggcaggcagatcacttgaacccaggagttcagaatcagcctggacaacatggtgaaaccccgtctctacaaaaaatacaaaatcagcccagtgtggtggtatgcaccagtagtacccagctacacaggaggcggaggtggtagaatcacttgagcctgggaggtcaaggctgcagtgagccgtaatcatacctctccactccagcctggatgacagagcaagaccctcttaaaaaacaaacaaacaaaaaaaaaacaaacaaaaaaacaaaaacaacagaaaaatcagagccaagatttcaagtcttgtcttcccccttttttttttaaacaaa

SEQ ID NO: 68671 - DNA, 1040 bp, Homo sapiens
gtgcacatgaaaggactagcttctgtattggggccctctctcttgcatcccttgctctaagggaagccagccacctcgctgtgagcaaccctgcccaagtgacaaggaactgatgtccctgagtagcaacagatgaggactggggcctgcccgctgccatacagccctgtatacagccctgagccacaggacccagctaaagcgtgtctggaagctgaccgacagaaactgtgggataatcaatatttgtgctttataccactaagttttataactttttacacagcaatagataactaataaatgataagacaaaggggcttataaaaagaaattacatatctggttaagggaatcaggaagggttttgagaagaacatgattttattgataggctttaaatgatagggaaggttttagaggtgagtaatattggaagtgaggatgatatttcaggcagagggagtaacaggtgaagtacaatatttgtttattgaataagagtttttttttaaaaaaattgtctaggtgataggtacaaataagggggtagagagacatctttaagtaaagattgagcttaaagagcattagaagcaaagatagtttgaattaactcaagaagcaatcggaagccatgaaatgtttgtgagtgggagagtgatgtgattatgacttctcttcaaaaaattcatccagcagctgtgatggggtgtaggaacttaggtgcctgcaggaatgccgcagtcatcttgggcctgaatgaatgtggacaatcatggagcagaggtggctgcgagagtgatggcagaggtggaataaatctgtaacctactgggaaagatgagacaatgaccactgaagaattgaacttcaggaaatgggacatttatgggacactgggacatcaaaacaaggaacaaaattagtgacggggaagcagtttcatgggttcaattttaggatttctaattctgagttactgttgagtcaggagggaagtagaaatgtcaatttgtggttctggtgtgaagatacca

SEQ ID NO: 68672 - DNA, 1005 bp, Homo sapiens
gccttcattaatggagtaagagctgacagaattgacatttggtaggctcttgattcaggaataaaagcaaagtgagattttcactttaattacgatcttgtgttttttaccattcatgctcatagattaagaataagacctttaaacagaaaagagtttacatgctgaccctcatgagcagcgagaagtgacgggttggaaaacctcattgcctctctatagccaagcttgggcaaagagatttttacaagggataatagatggggtggctgttcctgagaggaggaggaaggagactgtgtctgaaagcctgcatcaaagggaaagaagagaaccatggaagctctctgggcctgggaagatgccttggaacaaggcaggccaaaatgtctcctgctccgatttactttgtgagtgttttgtccctgtagctgtgtggagctgaggcaaacaggactcacacagttctgacattccagtttaggagattcaaaaaatcttcctagggcaggtggcatctgagcttgggctttcaaggtggttaacgctttgatggtcagacatggggaggttgggaattccatgttcaggctacaggaggaaatgtgtgagattaatttggggactactgctgtccatacagcaacatggcataaagctggggctttagatctatgggaggcatgtcggtgtcctggaaaatatgattaaatagtgagtctactttgacctttttattttctctgctgattgagttctccttaggttgctggaagatactttattttatttctaaccatttagtctcccactgggaaagtatgagtttatgcatttttctttcgatcttaacagagttagaatatgatcatattgaagaatggcatttcttatgtctattcagtccttaattctcccactaatccctgctgttttccagccttattgagcctcagtgttttgccagttccagtgtatttctgtgacccatgagataccaataag

SEQ ID NO: 68673 - DNA, 1047 bp, Homo sapiens
caatatcacctttttattttcttgtgttgttatacggtcatgtgccctataatgacagtggttctgtaagatcataatactgtatcgttactgcacatcttctatgttagatgtatttagatgcaaaaatccttaccactgtgttacaactgcctacagtatccagtacagtaacatgctgtacagatttgtagcctaggagtaataggctatcccatatggcctaggtgtgcaatagctgtaccatcgagctttgtgtaaatacactccatagtgtttgcaccatgatgaagtcgcctaatgatgcatttcttaggacatagctctgtcattaagccacgcatgattgtatttccttatactttggtttctaatttgtatagtcagtaaaaattgattctaaaactcaattttttcatgaatcagattccgaccaaatcaaagagaagaataaaaagttagggcttcattaaccaatttgtttcttcagcaaagtcccatttaatgaccacattttccctgagtgaaaatgcactgcctttctctgaattttattttgtagtcattctaataattgcttgctatatttttctgactcccagtgcttttacatttctcattctcaaaatgctggctcccgacggttgttctcttgaaatagtcttcagctgtttatctgttctttgctgaggaccaggcacctggagaccattgctgcttacgatgctgctcagcagggcctgaggataagcagggagtagcatcaggagaggccatactcgactcagtggtggagtggtggtggcagaattcaggtcttgctttcgccactttgaatcaaagaaagcctcataggtattattgtggaactcaggaggaatctgtatcatttatagtcacagcagaacacagaagccgcactcaatttgtttaatttgaagatagttcagtcaaagggctatttaccaaggtgtggacagtgcacagaaaccacaagaaatgaactggcatcctggagctagtagcagctgggtgtagctaccacca

SEQ ID NO: 68674 - DNA, 1048 bp, Homo sapiens
tctttaaactctcacctacctccttccttctttcttttctaagcctcatagagggcgctcacaaagtgctacttattgattgaggaagatccactcaaaaaacacacctcacactgcaactgagagacgcagcgccaccacctcgggcttccttctcttttccacgcaggaggcggggccaatgtccctcattcaaataaaaaaccagaatttgcatggggaatggctagtccttgagcttattggctgatagcacagtgggcggggtacatagcacgaccccccggagccccgcccatattaatttgcataacggccccggcgcgtgcaagggagaagcgggtttgtttttgaatctgcggaggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaaggtatatgtgaatcccaggggctgttaaaaccacattttcttaaattactattgtatttctgaagagtcaagaccgcattatggcggctgcgggagttgtgtctgcgcctgcgcggttgcggagctgcgggcggcgctgcatgggagcacgtgatcttgcggggtcgggctctagctgcagttgtgcagctggcggggcggtggctgcgcaagcgcaatattcattttcaagatctaatgttcttgttggacgccatttgggttctagatttaattttcctcgttcttgaggggtttctttgtgttaaccttaaattctcacaattttcaagaaaaacattactctaatgttgtactcctgggccgacctcaagctcttctctgttttttcgattttttgaaaaattgtggacttaattttctgtaaaaatgattttcatttgtggttcttgattataatttcagttttaaagtattactggattcaggtttatatttacggtggtaaagatcagcacctagtggtgttctcacgggaagtgcatttattt

SEQ ID NO: 68675 - DNA, 1014 bp, Homo sapiens
atttttgtttgctatgatatgtaagctataacatttatttggtaaatttttctgatgaagaattctagaaagaacatccattaccctgaggcctctttgaagaaagtggaccattaataaaaaaaatctgtttttttcttttaaacactgtactgtatgcatgtgtgtaagatacagttgtgtttgattttttaattgtaagtgtgctcctggttttattaatagttttttagggaaggtaattataaatatgctactgattagtttaaaatggtagtgtcaactatagttaaatcttatgtaacacaattgggggaagttatataagatttgatatgattctcccgttgtgcaaattctttcttactaagcaaagaaacttgcaaatgttttccatagacttcatttgtggttcatatatacaacaactggtttcttggttggttataactctttaagtttgaatcagtctactgtcaaatgaagacgtgcctcttgctttataatctcggttaatttagggaaatttttattgcctaaaacaaataccattagtaaatattacctagatgtaattgaaagtaatacttttggttggtggatttttaaatgacgtcacatatgagatagaatggaggtaggaaagattcttctttttttctcaagagaatatttgacctgatgtaattcttggatctctgaggtcttctacacagaagtatatttagagagcagttgtgtaattttctcccttttatgtttctggagtggttacctagcagcccctttctaccacatgctatttcaggcattttcgagttgaacatacacataaatatttcggttaacaaaagaactttgatctttgatcttagggcatggtacactttacatttccagaaaaatgaaatagtttggtgtatataagcgtatgttttcatttgaatatacagatgattgctttttaggttaatattgaaggtagtaagaggtatttgaaaatgctcttgaata

SEQ ID NO: 68676 - DNA, 1059 bp, Homo sapiens
ccttgttgcccaggctggagtgcaatggcacgatctcagctcaccgcaacctccgcctcccaggttcaaatgattctcctgcctcagcctcctgagtagctgggattacaggaatgtgccactatgcccggctaattttgtatttttagtagagacgaggtttctccatattggtcaggctggctcgaacttcctacctcaggtgatccgtctgcctcggcctaccaaagtgctgggagtacaagtgtgagccactgcgcctggcctcctatgtgcatttttctggggaaaaagtgatagctttcattagcttctcaaaagaatatatgatataaagtttaaacagaggttgacaatgactgtatctgggccttattcttagagcattattgcattgttttatttgctgtaggacggtacacaatttaaatatgtgtttgtagtgctatatcctatataaaatccaatacccactcacaattctattttacaattttcatagctgattttgactgtttttgcagatcaactttaggttcatttggttaattaagaaaaaaaagccagctaatggttttggttacaattccattaaatttacattgggtgaatttataaccttatactattttttttaattcatcggtattacacacttcctgtagactaccaaaaagcactatttcctaggaactctgggagaatttgtggtatctgtgacttttcaggaggatgttttcttggtgcagctataattttagtagggatgaattaggagacaatataaggttatatttctgttttcaatctggtttaggacatgatgacataaaagtagtatcagtatgaagttagacgtgggaaaaataagtcgcaaaataaagtattgtacaatattcgaaatcaaaatccttttttgttaaacacagacaattttttttttttttgatggaggaatttgaaaaggtaccttactccttttctggccagggtgaggcttaatctcataataaagataaaaaatttttattttagtttccttggtatcattaaattatt

SEQ ID NO: 68677 - DNA, 1557 bp, Homo sapiens
cccttggtactgtcctccacaatagtgagtgagttcttgtgagatctggtcatttaaatagtgtgtagcacctctcacctttctcttgttcttgcctctgccatgtgatgtgcatgctccccctttgccttccatcatgtttgtaaatttcctgagcccccaccccaagaacccgagcagatacactgtacttcctgtacagccagcagaattgtgagccaattaaacttcttaataaattacccattttcaaatatttctttatagcaatgcaagaatgaactaatacaaccatcagtgaagatttccttcacctgtcttctaggacccttgttttccaaatgctatgtctttttattgatttattctgtccttggcaggagaattcttagaattctccctgcctgtagaaagctacacattctctagtagctttttgagaaagggtgcatgggagatacaggttttaaagacaatgcatgtttgaaaaaggtcattctatgttttcatgcttgattgatagtttggctgggtatagaactctaggttgaaattcttttccttcagaattttaaagacactgctccattatcttcttcctactattatcaccactgagaaatctgaagccattctgatttcagatttctcctctcagtggaagcttgtagaattggttattagtctttagtcttatggaatttcaatggaacctgcccttgtgtggatctgtttattatggtctgctggcatgctttgggctctttggtctggaaattcttgcccttcaactctggaaagttttcttaaatgatttcattggtgatgtatttgtgtgtgtgtgtgtgattccaatttgaatatttggatggatactccaattgtatcttttcttctgatttgtaattttgtctttttgctaaggttggtttcttcaactttatcatccagtcctattgagtttttcatttttttctatcatgttcttaattttcattccttttctatagcattctattcttgactcaagaatgtaacattttgtctgcatatattcatttttttgaagttttcttattcctgcatagtctattgcttcatgtattttttttgtttttgttttcttttggtctctgtcatgttggaaacttttctcaattgccttccttaggtaactgcataatgtgatgtggaagattcaaaagttgattgccttatctaaattcgacagtttgaaacttccctttaggctgatctgggtcagccattttgggagagttctccagagaccttaggtcttatgtcttgtgctggtcagacaccctcagggaatagtcttccatttttatcaatagagaaataggctctgattgccagcactctgggagattcatgaaggggactagggatctctgcagtcaggacttagtccttctctttttgatatagtactttcaggttttgtttttattttattttttttaagacagaatcttactcttgctcaggccagagtgcactggcacaatcttggctcactgcaacctctgcctccca

SEQ ID NO: 68678 - DNA, 1451 bp, Homo sapiens
acctgtggtcccagttactccagaggctgaagtgagagagtctcgtgagcccagaaagttgaggctgcagtaagctgagccatgattgcaccactgcactgtagcctgtctacaaacaaataaacgaaaaaacaaaaagacttgtgaaaagtgctgatttttaattaggaaaagattaaacattggatagtcatggaattgtttactgaacattagaaattggttgcaagtgtttatgcttctgtaaataaacgattggtctcattacaaatgacccaatataaaacaaatttcttaaaacctgtgacattatacagtcaaggtgaatcctgcttttttagtaatattaataaaacttaaatcacttttgtttcctgtagattttctcagagtcatctatcataataagcacatagtagttcccatgtagtgcctgaaaagtgccctacaaaagttattttttccatcttggattctgaactgcagatgtttttaggccaagactaaaatcttagttgacatattagttgacttcttcctagaaagtaggagttgagatcctaaaaatgaaggttcttttgagatttttgtggtagaaacaaaaacactgagaatttcagctcactatttattgagcaaataactgtgttctatactatggaagagaatggaaaatgaatcaagatgcgatttatatccttatataaagattatttgcataaagatacaagtaatgaaatggtggtaagtataatgatgatatgcataaaagatattgagagagtaatgatacctggtttggggatgtgcgtattaaggagagagtaagcaaagaattatcagtgatagggtaatataggttgaatcatgtagaggatatatcaagtaaactataataggatagtttctttgggataaaggtgttggccttgacactatttatctgaataacagcctaattattttccttttctaaactgtttcatcagacacagaaacagaaccaatgtgtgaagggatggataaagctctgtcagctggtactaagtgttgtctgggttgtatttctgcttgtatcagttttgtgaaattatttaatcttattggagaattctggattttcggattagggatgtccaacctgtattattagtagccagcagctttctcttggtagactatgtttagactaagaaaaaagtagtcaggatttacattggaaaagtatttggcaagagaagggaggcttgaagaagatatcatccatttgacagtgtgttccataatttaaatctttgtggatcagacttcctaaaaacactttgcttccagaatgtaagaaagtgttcattaggcagctctgaatattttggctatgtgtaccatctttccccaccccccaattaaacatagattccagtgctacagtaatatcaattctgttccagcct

SEQ ID NO: 68679 - DNA, 2341 bp, Homo sapiens
aaaattttttttgtagagacagacagagatctcgctttgttggccacgcaggtctcaaactcctggcttcaagagagccttccgccttggcctcccagagtgttgggattataggtgtgaagcactgtgcttggcctaaatcttgcttttaatgaatagtctttgcttgagaatcacagttgtatttttaaagaattaatatggcttggatcaagtttaactttttttttctgatatactgaagttgttacatacattattcattttgcctcatggaaaatacataaggaccttttaaagataagtaatttaaaaaacttttattatggaaaatttcaaatatatactgaaatagaatgagataataaattctgtgtgcccattgctcagcttgaaccattgtcaagtcatagggccaatctccttttagctatatccctattactcccctatacccttaaaactttttagtaaatacctatatttagtgatagatagaacaagatacacaggttagctagattttaggaaggtagactgaggaagagagaaagaaaatgtggattctattgctgatgtgaacaggttctctctgtgcttttgtccttcccttctctttgattgatatgtttctgccaacccacatttgttggagctctttcaaatttgtcttgctaatatatctattagactgagttttactcttttttaaaattcccttctttccatcagggtgcctataattctttgtttttatttgcttttcactcacatcaaaaagttgggaggtctttgtcagggcatgaaatgtaatttgccctgggactaaacactcacctggggatgttaatgtttgtgaccatctgtactactgaagagaagaaattatttttatatctatggtaaattactcaataagctttttgccatcttctagagattctgttatcaaggttcaaaaatttaattgtaggctttaactgttctgctagatttgagcactttggggcttttagattctgtggagaaaatctttagccttctataaattgaaattaacttaatcaatcaagtcattttcaggatttaaacaattttctagaaattataaaattgaaattcttttcatgataaaactataaaaggtaaaaaaaaaaaaaaggccttgagcaaggtttaactttttttttttttttctggactgaaatggaggctttctttcaagcgaattccctgatgtttgctctgtgtgatttggctccatctctgtaactgctaatatgtggcatggatttcaagttgtttgggatctggatgtgcccaaagtctgtattgcaagacgggattcacaggcattatgttacaaaactggcttgctgccttctgttttctttttctgtgtcctgtgtagctgcattgtttgttgcagtatatgcattagctgttgtctatgttcagtttcctgcaggctgacaaagtgggaggggctttgtttgttacatagctgagttttcactgtgtgagttcttgagtgcacattgcagccatcttaattacacttttgtgcaactgagactgtgcagctgtctcaaaatggctgctaacctagtctttgtagctgcttaggcagcaagtatgtcagtgaggagacttgtcacatgcatcaggaccagaggtaagaaccaattactcttttatcttaaacattctcatttttttcttttttaaaaaggaatttaactgagtttacttagaggggtgaacttagagcttggtttttaaaaagttgaaatgtttggtagaacctttaagcctttattatggaaacagtacatagcatggtggggtcaaaggttaaattcctgtaatttctcaccattttatgttctgtcattgccagaacatttgatcaccatagtagtgcatttctggccctaattaatgtaatattccttttgtgtaggctattttagtgtgtttggtatttatttgtagaaattaaaacaatatattatctgaatagattttttttttaaaggatccataagtaagccttgttttgcacaaagactacaatttttctacggttttgtgaggtattgtgtggaagctttttggaaagaagggtaattatataaatcatgaaaaaaaatttttaatactgtccaaaatctttttttttggcattatgggttgcagttctttctcatcatgctgcctcctcccagtatccaactctttgacatttttaatgctgctttgcttctttgttcaaattactttttgcttaagttggcattcagattcagattttgaatttagaaataaattcacatctagt

SEQ ID NO: 68680 - DNA, 1036 bp, Homo sapiens
tgtgttaaaggacatcactatcaacttgatgttcttaatggtgatactgaataagaaaaagttaaagtgtattcaagctatgcagtttactgaacagataaatgaaataacattttataaaagatttttgctcaaattagttgagctaagaagtttatcactgaaaataatgagtaaatttcctaatagaatgttttcttaaccgtacactagattagataatggccgttaggccattacaaactttatttttgttgaaaacttacatctatttacatttattaatttaacatttacagtgtctatgtgaagactaccttgatgatgcatgaaacatgataatttataatcttgatctgacttaaatttgaattccacatttcccagagtgaaagccagcttgttaacattcaaataataccacgacattggtaactctaaggaagtgctaaaagaatgttatgcctttttggaaaatggttttctagttagagttcaactttagagaaaattgaaaaagtgattaacttgcacaggaaacagtgactcccctgctttactgctcttcacactttgaaaagagaaagtgatttgagagaaagcctaatgtctattcaaataagtgattgttttttaattgctcaggttagaactctcacaaagagttctctgttggtgatatgtaacagtctgttattagtcattaatatgtgaatatggaaattgtgaaaacagcacaaattgatttagcaaatcttcatcagtttagtgaaagagggaccttaacactggagagaggtctgaggagttgcttctgcatctgcctgagggaatcttgtctttccttctgaagtaaggcagatacagctagccaactgccagtagaactatctgactcgtgtatccctttgttggatatagaaatacctgtaccatggcatacatagtggaaaacattagtatagaagttaggaaaagattacttctgctctcgtactgttattaagtaattgtgtagttttggataaatatttaa

SEQ ID NO: 68681 - DNA, 1051 bp, Homo sapiens
gctgcagacctaatagttggcagcatagaaagcagtacaaagaattctgattctaggcattttcactttgaaatagtcattttgaagatatactctgtgtgttctgtgagcttcattgacatattgtctgacgttttttggcttttgtggtaaatgggatgtatgctgcacaaactacccaacagatgtgaaccactatttgaaaggaattttaatatgtagccaacctactgtattcttgttttttttttaatgaatatgaatcaaacaagaaatttagactcgagaaggctgacctagaagtctgcattagcttttaatgtttatacaaatgaactaagtagcagtggtttacagaagaggaagtccttttcacagtgtcaagctgcccacaggtaagagattcaggtcctttttctgtgacacctaccccccaggctttatgtttttctctcaccattggaagtttttaaaaatttgtttgtttttagttctaatgaaaacaggattggtagatcgtttaatgttaatattcaggagattttgaatgccacatttggatttggtattttttaaaatgtaattttcatcttctcaaaattccttcacatttgaattgaaatgaactaacagtggacttcatatatgaatattactcatgcatacaatatgttcatattacatagaaatcagttttagatctcttttcattatagtctgttactatattctcacttgtagtgacaccaactggtacacgcagagagatgacattttgtaacctcacttaagtataaagttttagtttaaatttaccactttgaattcacctttacaaatcagagtgcttatgttttcaaatatggctcattgacatacattagataatgtatatttatacatataacttggtcaattttctacttccacccttattctttccatttctctatatttaaatttattattattttaataaagtgatttttaaaagtctaaaatgaatgtattaattaggaattccactaaatttcatatttcttaacctggg

SEQ ID NO: 68682 - DNA, 1033 bp, Homo sapiens
gttacatgatgctgcttttattagccaaccacagtgactatgtaaattgtatttcagtttctgttgctgtgaaagaactgataagatggctgcagggggctccctttggggtatgttttttattttaaagagggttttcatcaatatgtagtaagaagcaaaggtagatttcttttaaaggggcattttatttttgaaatgggaaatcaaactaagcaagctttataaaaggctgaaaaatgactctcttgtgtatttgattaattttaatgctgctctgttttgcctctattaggcaacttataaatgggtatattttattactttttgtatgtaaacatgccagcatgctagtttacaagtctgttaaaatgttctagattattgtctttgctttctaaaagaatagtttttttcatgtaggaattattttagatgtcagttacgtgtacatagcgcatcattcttttagccaatacttaattgtattctatgtgctcaacactacgtagttcactaatattatactagaatacttcatattcttcttcttttgtgaaatgacctcagaagcacatcatcatgatatcagcatatttaagatgttttctaatatcaaagctttggacacttaaaatgtattaattttccctgagatttgacagagattaaaatttgaaagaagtaataattttatactagatactcgataaaaatgtcaaagtgttccattaaacaatacataaatgtagtattagagtccatttataataaaaatttctaaaaggataccttcagagcattggcaaatacagagaatggtggcagaacatgccatgtgaataaaaacaatattgataaaatgtgacaaagccatatgtaacatcagaaagttcaagaagtatacctcatttaaaaacatttatcatcattaattacatataaggccttttggttatagtaccattttataataaaagagaatgtttctgtttcacttaagactttctagtctttctggtaaaagatagtt

SEQ ID NO: 68683 - DNA, 1088 bp, Homo sapiens
tatactaaatttgagcagataagtatcaaagtgagtgaacagattcagtagtctatttaatgggcagtaagcagtaaagcagattattagcatcttttgtgcaacccactattctttatgattttatttttagagtattgcaaattctcaagcaaaatttagaagtgtaaaataaaatcatacagttttcaactgagaatgggattcttaaagaatctaatagcagagttgcatttctaaagaggttagaaattatcagcataaagtgattatttaatatttaattcagccatttaatgaaaataaactcaaattaaaattattttcagtagaaaaatgaatgaaatttttattcagaaaaatgttgtactctcaggcaacagcatgaatataattggaatgcctttgtcaaagatagaaatgccatgtccacttaaaaggttttgcttgatgttttctaagcttttgctttagttttattttgaagtatacttcatcagatattcattactttgaattaatacagcatttgttttgtctatgtgttgtatatgctttttgacccaacaatcgtggtacttagttaagtctgttcttggaaagcagtacagaccctagtttatttaatcaaagaaaccctaccatgacctgtttttcaaacagagcatctagagttatattcctaatgtttccatttcattgttcaccttgattttcacatcctttgcatttttaatagagctcttgccctcatcttcttcccttgttgctgggcaaggtttgtgacactgatgtctgattggttttagactatttcggctttgagccaatcagacagtgaatttcagttctctcacaggactgaaacattgaagcagctgttgatatatttttcctgtggggagattatataaactaagagtatggctgcagcaagctccctcttgggtatgtttgaaaaattacaaggttcatctgtaaggaaggggggaaatgaggtttatttttaaaacttggttattaagaacacctaataagtagtgaatttgagaaaaaaattctgataacaaattttccatttttatttt

SEQ ID NO: 68684 - DNA, 3133 bp, Homo sapiens
tgtccatctaatatctgagaaatgcggatattatgaggctaaagttcaaaagaatggcctttcagtattttgaaatacttaaagggtaactatactacttatattataaacttaattattttgtagttttggaattagtaaggaaaagtgacagcaaaatacaatgcattgtatctgtatcttttgcagaaaattttgcagttagcaaaactttgtaatgatgggaagggaaaaaccttgaaggtgtgaaattttagtctgtaattaaaaacccttaacataatgttttgtattatattatacaaattttgtataattttgtattaaggttttgtattattatatatacattttgtattaaggtttctgtttaaatgaagagtaatttttctaaatagttgatttagttatataatttaaataaaatggctagaataagaaatatgttctaagtaattggcttaaagtgagagaatgaatacagaatgtatcacagtctagaaattctctgacaaagtgctagaatctcaagctgaattggcttccagcaagtaggctaggcttattattttatgcgcttcagccaaagaccagcaggaacacctttgtaattgaaaaagttaggtttactatttgctgcagggaggaaataatgttcactatggggaaactgtaaggcacatcaatcagtaagaggatgttagaaaaaacctagtataggatttgagtatagtataggttgggttattttggggagagattaaggaagtagatccttatcgtggattgggtgacatcagaaagtgggggcacttctattcttgggtatctcaataaattttatctatatagggaggacagactattacaagataaagctgtaattgataaagaagttggcctggtgtggtggctcacacctgtaatcccagcactttgggaggccgaggcaggtggatcacgaggtcagaagatcaagaccatcctggctaacacggtaaaacctcatctctactaaaaatacaaaaaattagccgggcgtggtggcgggcgcctgtggtcccagctactcggaaggctgaggtaggagaatggcatgcacccaggaggtggagcttgcggtgagccgagatcacgccactgcactccagcctgggcgacagagcgagactccgtctcaaaaagaaaaaaaaaataaagaaatagccatcactcatttagtgaggggggatgtttggaattttgtgggttgcacagtgaccttgtctgacttgaatgttctctgagttggttttatgtccaaccagagaacagcatggcttaactgtaagcatcagatccattaacaacattgagccctaactgtgagtatcagttaagtttccaggcatcaggggctgcttttctttctttctcaggccaaagcaaatgtattctaccatatcattcctactggtgatggtaatggtaagtgactatccaatgtgaaaacagtattcctgcctcctgtacatcttagtccttaaagcaattttgttttattctactattgattgatgacattgtttttcttcagaaccacatccttgtgctcttttgtttgcctttattgcactggccagatgttaacaaggaaatggttacaggaaacatccttgttttcttctgatcctatttcaatatcagacatgatatctctagttttcttggtagataacctttatcagatttgagtaagtttccttgtattcttagtttctggcaagttgtaattatgcatcagtcttgaattttgtcaaatgaatattctgtatttgttgaggtaatcctttgttgattttgtccctctgttctgtttatgtggtgaattaaatagcttgatttgttttgtggttttcttttttgcttaacagaagtttatcgtctcagagttctggaggcaacacatttgaaatcacggtgttgtcattgccattctccctctgagggtgctgagggaaggatctgttccaggcctctctcctagcttctggtagttgcttggcttgtggtaccataacttcaattgtcacatggcattctcccagtgtgcatgtctgtctgtgtccagattttcccctttttataaggacaccaattgtattggattagggctcactttagtacccttatattaccttgattaccactgtaaaggccctatccgaataaggtcacattctgaggtactggggcttaagactaatatctttctggggatgtggggtgtgggatgctgcacaattcagtcagtaacatcctggtaccagacattcagtttaggcaaaactcgtaattgtacactctgctgggcatgaaataaagtcagaatgcatcatggcttgttcatggtcaacactgcttgatttttgaatgtgaaatcagccttgtatttttctaagcgagcttcacttggtcagaattcattacctttttaagaaacctacttctaaataagtcatagatgaaagaagaaatcatgatggaaattagaaaatattttaacagaataatgtaaatgacacattaaaatgtgagatgcaactaaagcagctcttagagggaaatttatagctttatatgcacacattacaaaagaagaaagattgaaaataacacttaagcttgaatctcaaggaaaaggatgacatgttaagctctttccaagaaaaagtaagtgaaaagagataataaatattagagtaaataattaaaacaagaaagcagatataaaaccaagaaatatcagccaagtaaaggttcatactttaataagtgaatagaattgataaaactgtagcacaacttaccaaaaaaagagaatacacacacacacacacacacacacacacacacacacacacacacaacctttgtatttattttgaaatttttttgtagtggcattactgagataaaaccacatatctactattcacccacttaaagtacaattcagttatttttagtatattcacagagctgtataatcatcaccataatcaatgttagaacattttcataaccctgtaaagaaatcctgtaccctttagcagctactcctcattttctccagaatcttccaaccctaggt

SEQ ID NO: 68685 - DNA, 2506 bp, Homo sapiens
tccttacatgtttcttaattcttcctcctttttcctttatctctatacctgttatttccctactgttgttcttacacttttatttttctttctcattttcttcaggtacttttttttttttttttttttttttactttatctaccttttttttgcttaaacatctccatactctgtgaattccatattggaaaaaaaaacttgtcccttttccccctaatactttctagttgattttctagtagactatggccatttttgattttgtattacacagatgcagtaaatatgataattagtatacaacaagcagtaggttttctatgtcttaaacattacatgaaatgtgctgcttgcatctcttctaagatcaatttgtattaagtctacaattaggtggcttctgtttcagttattaaactctctttctcttttttcttaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccaggttagcatataacttaaatgttaaagattttttattgactttgatgaactgtttaataaaacattatcataatgttttaaatttattttagctgcagagaaagttgagaatggtgatgactctatagaaagatgtcttaacttcatagaattcagaattagtgtgtgtactctgtgagtagcattgtactaaatactaagaagggagataaaataagtagaaaatatgcccttatagtctggaaatagagatgaagtagagcaccataacactgagataacagtttaagttagtacataattgactagagttgtagcagttctttcttgctatcacttagcgaacaaataacttagaactaaaagcctaatagtttaatctatttgcttcaagtgtaacaaattatattttcaattaatattcccaatgaaatcctgttctttaatattctttgtccaggaatgacagcaccattgttgtaagccagaaaccttaaag

SEQ ID NO: 68686 - DNA, 1068 bp, Homo sapiens
tgaagaagccagatacaaatttgcttatgatctcatgaatattaacagcacgtgaaacagattttctaagtgaagtcttctagtctatattctttataaatgtacttttaatgacattaattttatttttatttgaaattcattaggatatgttaagaataactattactgtgctagttttgtaaggctgatgattaagaattttttcctatacttacggaggaaaaagaataaataattaaagctgtgcatagttaaaaatctgacatgagaatgaatactatattttgtcagaggattcatgtgcactgtgacatttagttacaggaatgaatatgagatgatttcatctaccttcttcatgacacaattgtgaggcagttcttagtatgaagatttcaaggaaattctgtgttcacagtgtgcattgcttgaccattagggagttcttatttagtatattgaaagtcatttgaagtttaaagctaaaagctatataccttctaagatctccaaaacagtttacaaaatagttggttgagaaggctattatgatagaaataatattttgctaaggatggataatatgcattaagagctataagaaaaacacctgagtgtgatcattgtggttttccttctcagatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggtattgtgtcaattataagttataaaccatattgaataaatagcaccactatcttcttctaggtttctgacattattctgtattttattgacataatgtggtttatcatagaaagaaagaacttgaagaaagtggttgagcttttaaagtctattactggccagatgtggtggatcacccctgtaatcccaatcctttgggaggctgaggtggatggatcacctgaagtcaggagttcaagaccagcctgaccaacatggtgaaactctgactctac

SEQ ID NO: 68687 - DNA, 1043 bp, Homo sapiens
agctggatgttgtggtgggtgcctgtaatcccagctacctgggaggctgaggcaggagaatcacttgaacccgggaggtggaggtggcagtgagccgagatcatgccacttcactccagcctgggtgacagagcaagactccatctcaaaaaaataataaataaataaataaataagtctattactatccttgataatttaattttaaaattctttctgacttctttttggctacatctttttttttttttaaaaaaggttatgattatcaaaacaagggagagaaggtaacatttttatttatttgctttggtaacaaaactgaatgttgtttttcagcttttctttttccttctcacattgaactttatcttattgtgaaaaggaaatgttagagttttaaatattagcattttaatctttataaagctggtttcatggttataagtctacattctaaactctttattgtgtacttgagggttagtataaaagtggtagagacagggtgttaaaaggactagagaaaggagtatttagaatacggagtttgaaattccccttacatctgtttgactagagatagaaataatgaaaatattcagtattttatgtttttcaacatgtgttcacaaatgtttttacaaagcttttcttagagaggaatattaaacttcgatgataactagtttttcaaggtcttatatatttaaggatgacattttacaatcaatgttttaggacaaaattctttcattaaaatatagcatacatatttgcactttgtagaaaaaagaatagtgaggctgtagaaactctcagtgttgtttttttcccctagtttctttttatttgacatatggagataataatgcttattcagtctttcttacagagctgttagaattatgaaggtagctatgtgaaagaattttgaaaactgaggtttcctgagagtttacttctttagaacagtgttactcaagtatggttcatgggtatgtgccaatgtctttgttgtggacccataatgagaatatgga

SEQ ID NO: 68688 - DNA, 1975 bp, Homo sapiens
taatgggttttttgtttgttttttgttttttttttgagacagagtctaactctgttgcccaggctggagtgcagtggcgcgatcttggctcactgcaacctctgcctcccgggttcaagcgatactcctgcttcagcctcctgagtaactgggattacaggcacgtgccaccacgcctggctaatttttgtatttttagtagagatggggtttcaccattttggccaggctggtctcgaactcttggccttaggtgatccacctgcctcggcctcctaaagtgctggaattacaggtgtgagccaccatgcctagccaaggtaatgtttttatcagattgttaaagactaacagaatatgtaatttaatttgtgaaaaagtaatatatgagcattcatttacacttctgttgaaagtgtcacagtaaagcctatacatccatccatatgtagtattggcaagggatcttttatgacttacagatatttccactttataattctcaatgagaaaatcaagtgtgattacaactgtgttaaaaaaataacaaaacacaggcttacatattcaggaatgtactggtaagtgagcaacactcaaaagttcgaggaagaaataggctaacctaattaagagtgtttacatctgagtactgaatttaggggtcacttagttttagtcataactgtattttccaagtatatagtttataatcaacttaatttattttctttactcagctatcttctgaggatcctgttttctataggtttctttttatatattcatggtttttttttttaatgctgtaatactatttgatttccattcatttttgtcttttttttttttttcaggccaagatagccaggttaaccaaacgctttgaagcagccaaagaagatcttaagaaaagacatgaagtaaaatttttctattcttgcataattaatatttagcactaagtggtaatcttaggaaatgctgaattaggaggaaactgtattacaaatctgaaatttgctttcatactgtgtactcctctatgtaatttctggatcttcagccctagaactaatgaacccctttcaaatcctcatttactattctcatatatcaacatttatattctattttaggttatgcaattcttttttttttttttttttttgagatggagtctctctgtcgcccaggctggagtgcagtggcaccatcttggttcactgcaacctctgcctcatgggttcaagtgattctcctgcctcagcctcccaagtagctgggattacaggtgcccaccaccatgcctgactgatttttgtatttctagtagagacggggtttcaccatgttggccaggctggtctcgaactcccaacatcaggagtccatctaccttggcctcccaaagtgctggaattacagacatgagccattgtgactggccccttaggttatgcaattcttgaagctgtattttctgtccatctttaaaattaggcttcagggatttgtcttaccttgtttctttcattttgcattcttgtcagattcccagtatggtctcttactattttccccaaagtattttagtattctactgcctgtagtattcctgttctccccttcctttcttccccatgtagtcagtcctcttttatgctttaattgtaatatacagagattagattaagtcactttattgacttaaacagtttgaatattttttaaagtatacaattaagtccaaacatagcataaattgacttccatagtctggcttttgcttgttggtgtttccttcatttttcctttgtttatcattttgccactcttctgttatttcctttattattcatattttaatatagtactttgtatattgcattatagtttttagttggatttattttcttttcctcctgaattttttttgtttttaatttttttatttgaacaaggtccatttctt

SEQ ID NO: 68689 - DNA, 1032 bp, Homo sapiens
tagtctgtctagtttttaaaaacagaacaaagttctactttctttatttggtcaaagaatcttgcagtgtaatcatggtatttatgtagaaataagtgtttggtgtacttggttagtatattttctttttctgcttcattatattgttcatctgtgaataatacttttgctaacttattataaggcattctttggtcactatatatttctttaaccacttgtcttaaatagtattctttcaagtaattgagaaatgcttctgttaagggtgagaaagactaatgtctgtatatattaggacctacttttggtattcaggttaagtactgataacagacattagaatacaagagttaagagttaagagttaatgccacagaccccagcatttagaagtctttgtgccagctatgcctcactgtttttgcttgcagtttaggattgtgaaacccaagtctagccaccctttttcccctgtgggccactgcttattctagatatcagttggtattccctgagtggcatatctattgactattggtgtgtatatgtatttcatagaaatgcaggcacagtgagacagatgctggagtccaaaagaaatgtaagcgagagtgcaccaccatcctttcaaactcctgtgaatacaggtaactttttttttaaataccaaaatacattttcttaggaattaaaggctttggttctcttttcttacattcttttgaggttgaaatggattaagaaattgggcacattggtctaagtacaaaaattttgttaaaaattcaggatcaaactgggtatggtggcacatgcttatagtctcagctacttaggaggctgaggaggattacccaaacccaggagttcaagtcagcttgggcaacataatggaatccagttggtctcttaaaacaaaaaaatttagggtcatagataagtatatgtgaaaatacagtatagatattcaaatctctattgtagtagttcacaaactttctggtctctagatccctttacaatcttaaa

SEQ ID NO: 68690 - DNA, 2219 bp, Homo sapiens
agagggaatctcccctcaatagttcctctcccaaggaattcaatcaaacttgatccaaagatacagacatggttcaaataataaaatacgatgagtaagcctacctgttattcattaatggtcatgactctttttagatttactatttgagtttatatattacttgtgttgtaaggcatttataatgtttttaatgtagtttcaaaaatatatatttttacttaactttttagtattttttatttgtttactagttaggtactctaaagtgattatagtaattttcagagaccgttttgatcctcagtagtcttgcatattaatcatcgatcatgtgctgtttttgtaatttactaaaactacatgcaaaatgcttctatgaatttaattctaaattaaattttggaatttaaatctggaaaaaaatttcatgataaaagactttacagtctttgcaatgtattacgcaatgtatttaatttgtgtctgtcatattttcttagttgataaattaatataaccatttaaactgaggcttctgttttctttctatagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattggtaagtcaccatgtaggtttaatactagaaatgcaagcatcttaatagccttgtaatgattgaactttttttttctaagtggctagcgttattggaagtacaaaataaatagaattttcttgattatttttagtaattttttagatacctgagagaaatgatgttgctaaaatggggcttgagaggggttttattttgaattagaagttagtatctgtgttttatcttttagtaattttcctaagtttggtgaatttttaatttatggctttgtggcaagcattatgagttacttttatgatacatttgccagcaatatcgtttaaaacattttaaagtatcaaatttacataatatatgcttttaagaaaaaaagacacgtttatgttccttacccatttggaaaatcctttgtgcactcactcatagcttccaaatttgaacaacttaaaaataagtttttctttcacatttgctataaaatgtttgagtccttcttgttttatcttttccgtgttttcccatatgacatattatatgattgtttgtattttacttagaaatattgcaaaaaggagcacttgattatacctgtttaaaatctgccaaactctgtgtcttcctagttcctagaaagagtttgttttgtatgcattcttgaacttgcttattcttcatttctgacttcacatttatgtgcactacttttggaaagtcatgcaagggtaggcatcatgtgtctagtaaaattgctacagtatttttcttattgatgttgtaagtgaccatgtaatataggaaacaaattctaaagtacaaaattacttttataagtgagatgtacaagccttagtttttatttgtcatatagccattactagtgtagttactccctaagtgttttctcatataaaacaatgacggtatttcacagagttgttaagaaagtaaatgaatggcagatcaaaattaatgttggattgaagctggatatcactcatcattatcatatttataagaataaa

SEQ ID NO: 68691 - DNA, 1344 bp, Homo sapiens
ggctttttaggattcccaaaacctaaactgaaaccaaactttggtacatctctactacatttagtagtttgtgattaattaattaggttatataattaaaattttctaagctctatacttatgtgggtattatgtttacttaaaagaacatatgctatatgttcatgcatttgtatgtattttattgtagctaagtatatccttatggattttaaatcactattttctgtttatagtgaggtaaatgtcctaagggcttggaaatttaaagctcaaactatagctaatttcattcattcacaaagtaatgaatgtctgtattatcttaggttctttagatacacagaaatgtataaaatagtcactatgatctcaccaagcttacaatcaaatagggaatgtggtaattaaataactaattaattataaatgtgatgagtgttagaatttgcaggtttttgtgagaggacaaaagagaacatgggaaatctggaaagatatgaagtaatgaacagaagaatgggggaaatacggttaaagggtttttgtagggggtaatgtgacatccatgaaccctggttacagtatggagaatggtttggaaggggtaggaatagtgttaggaagaccaattaagaggctggaggctcttgtactgtacaagatgagagatggtggtatgaaaaagatttaaaagttatttaagaggtagcattggcagtacttggtaattaataaaagttcagatgtgtggaagagatggagaactcaaagatgactcagctttctaagacattgttaaatgctgttccatttactaaactagatattaaaaaaagaacagatttgggggaaagttatatacaatccatatacaatgtactctctcagatttcattaaacatcttgttctaagactatataaaactagagttggctaggcatggtggcttatgcctgtaataccagcactttgggaggctgaggcaggaggatggcttgagctcaggagctcgccaccagccttgcaatatagtgagacccccatctgtacaaaaaataaaaaattagcttggcatggtgatacatgcctgcagtcccagctacccaggaggccgaagcaggaggccgaagcaggaggattgcttgaacccaggaggtcaaggctgcagtgagccatggtcgtgccactgcactccagcctgggcaacagaggaggtccctgtctcagaaagaaaaacaaacaaacgagagtttaaacacagcaattatttcttcaaccatttcttcaaggacataattaaatgagcgaagtgtttgccttttttctgttcatacaattat

SEQ ID NO: 68692 - DNA, 1023 bp, Homo sapiens
ggtcagcttggatgtgcagttaatagcatagcataccatatgatttcatagtataccataccatttttttagggcaaaaatttagattattttctataacccaattctagctttaatgattgcctttggtgttgtggtagattaatattgataatttagagtagtattgatcaacattttaaatgtcacaaaatgaatagtgtttctgtttaatcttatttgctctatgcaacagatagcttagtttttttaagaaaacgtcttgaatttcttttgaaaattatatttcatatagtagatgtttaacacatgagtatcctgggacatttgtctgacaaactctctttattcaggtacagccatttaagggtccagattgaaccaggttactcattagtctcattttacctcacttatcatctcattttttaacacgtatatctgccagagttttctttgtaaaatgtagaagttttgtttttcagtgtggaaaagccactggcagtgattcaagtggtgtcattgatctcacaatggatgatgaagagagtggagcttcacaaggtacttcaatagtaattgtactaagcaacgttttgataccattttttttgtcttaatacggtacagtattctacaaagacagatgtttatggcattatgcttggtttatttgtgttctttttggaatggaagttttttagattagaattttaaaatttggccaggtgcagtgtctcacacctgtaatcccagtgctttgggaggccaaggcaggaggatcgaggcaagaggtcaggagtttgagaccagcccgggcaatgcggtgaaaccccgtctctataaaaaatttaaaaattagctgggtgtgatggcatgtgtctgtggtcccagctgcatgggaggctgaggcaggaggatagcttgagcctgggaggttgaggctgccgtgagctgtgtttatgccactgcattccatcctgggtgacagaatgaggccctgtctcaaaaaaaaaaaaaaaa

SEQ ID NO: 68693 - DNA, 1052 bp, Homo sapiens
agacttctctgagcctttactatgctaatttataatgtaaatctccaagaatgatttaagatataaagtatttctcaaacttacttggctgtgcaaaataacgttcagctacatatctataaaactggtgattattgcacatggaaaatataatatcatgtgctgagttacttcttattatcttaaagacattacttttttctaaaacacccaaatattttaaaaataatattttggggaatcagtctagttgagctttggaaaacaaaagttaaatagctgtacaactgattatatgacagtaaagtcggttttgttatttaaaactgaattgagaaatgtatgccatccttcatccgggttgaactcaagccagtatgattattctttaaaagtttcaaattatctctattgctttcacttatctctattgctttcactaatttttaatagacagccatgactattataatggatccctaaagaaaaaaataaatacaggtttttgagaggacacaggtaggcttaattctggattaaaaagtaaagtcctaaaagtttgttttcagtgctctcaccatttccctagcatccatgcctcatggggtctttttgttgccccacctttgggtctgtctcaaattctcacattcctaaagcacactgttttccaatggcattaaagtatccattgttaaagccttgggttttatttacatttagtgtggaattctataggacagaaattgatggggattattttggatagaaggacttttgggtcacaatcttcatagtggtttcctgtttttaagagttttttctgagatgcaaatatttatttcataggctattgaagaccttttttgagattagtcattctttgactattttaaagactatatagtgatgataagcaactatctgttatcaaagaacctaaataattgtagtaattgaaattcaagatcacagtgaaaactcatcagtttatagatatttgtctagaagagtgttcttcctataggtaggtagattatatatttatgcaa

SEQ ID NO: 68694 - DNA, 1313 bp, Homo sapiens
ggctcactatagtccaggaaccaggccgaactacagcatgggccaggtactgaataaatggcaggaatatagttagggcagtaggtggctctaaattttctctttttgtttccctggtgtatgtcacagcagttttctgtggggtgaagtgagtatcctcaaccaaggagctgggcatggagaaaatgagaggaacctcattaatacatggcaaggatgacttattctggctttctgtcctggttgaaaagatgagactgcagagatttttatgaagatactcccagtttgtctgtcttttgagtcacactgctccattatggccatttaccttttacatgtggtacacaaccagtgttctaggatttttgttcatagttctcctggtaacgatccatttatttctccctgtgctggacctcctgttgcttgtgtctcgtgtttttctctttattttctcacgtactggtggcacatattctccattgactatttgagaaagggtttgtggtagttagaatttttttttagtgcttgcatgtaagaaagtttttttatccacaggctgattgatagcttggctgaatacgaacaggacctctaggttagaaatatctttcctttcgaatcttgaaaacattgcttcactgccttcaaatatttaatcagttttccaccaaatttacaatagaattatcattttatcctgtaatttttttgtttgtttgtaggtgttacagttcgagtgcctcaaacaaccacatatgttgtaaacaatggactaaccctgggatcaacaggacctcagctcacagtgcatcaccgaccaccacaagtgcatactgtaagtgttgatgcttggttttgcaaaattctcaactgtagaggtataaaatattattgtatttggcatttttctttaaaatggttatatccaagggaagtgttaggtcttcctgctttttcagaagtttatttctaaaaattgatcttaccattatgaacacatagttcctagggatgatgatcatttagaatcattgagtttgcttgtggtgtacagtgtacaaaaacaggtccacagttggggtatatgaagtgaaatatagaccatttctaattcatagttaaattaaaaaggacatttttcatttctccatgtgttaattttattctttcgttctaaactatgccacatctaactgctacattgtcatcaattaattgttctaaagaatccaatgatattgggaattcattagttaagaggtaacagagataaccaaagatttctccttagatttagcctccaa

SEQ ID NO: 68695 - DNA, 1401 bp, Homo sapiens
ttgccaaatttgatatggtatttggtatttcctagaattcttgatataaaatgatacttctacgtatgttctctaaggtgttttaattctaacattctaaaatagttctttttgcaatcatcattaatcagtgtgacctgtttcttcaggagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcccaggctagagtgcggtg

SEQ ID NO: 68696 - DNA, 1811 bp, Homo sapiens
ataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttggaaggaaggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattccct

SEQ ID NO: 68697 - DNA, 1565 bp, Homo sapiens
ttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaacattctgagtactctgattaattctggttattcacccttgtggctttttttctttctttcttttttaagaatcttccaccttgtttagaatcacccattacatactgtatggtatggcttatttaatctacttggcaattccatggcactcagatcacatgtaactctccagtttcgaaagaaagttgctatgcagggttgctgccagattgtataggtgcttttagcttataggaggcaacagtaagctttactgtattgtatgcctaacctacatcacaaaaagactcaacttatgcctgttaatgaccagaaaaatcactaactacaatcaccaactactactagaggttcctttgaaaacgaagctccagcatcccctagggttttgtcattaggcatattcatccagggaaaggggaaagagcataggaggagtacagattcttatgggcgaggcctggaagtgg

SEQ ID NO: 68698 - DNA, 1051 bp, Homo sapiens
cgggcggatcacctgagatcaggagttcgagaccagtttggccaacaaggcaaaaccccatctctactaaaaatataaaaattacctgggtgtggtggcccatccacgtaatcctagctacttgggaggctgaggcaggagaattgcttgaacctgggaggcagaggttgcaatgagctgagattgtgccactgtactccagtctgggcaacaagagcgaaactccgactcaaaaaaaaagctaatattgtgactttggtagtgggagagtggggaaggccatggatttaattttttgctgaacgatgattttctaaaatgtcctcctcctccctctttccaggtggcagatatctacctagcatctcagtacacatcctatgccataagtggtcccacagtacaaggtggcctccctgtttttcgctgggaccgtttcaacaaaactctacatcagggcatgccagaggtctacaactttgattttattaccatgaaaccaattttgaaacttgatataaaatgaaggagggagatgacggactagaagactgtaaataagataccaaaggcactattttagctatgtttttcccatcagaattatgcaataaaatatattaatttgtcactttcatttcccactgactttgttgtttttacagtaagcactcactataaggtagagcactgtagaagaaatgttacatatatatataaataacactaagcttcggcatacatgctaatacacaagagggtatggaagaaacagctccttcattcaccagaattcatgttctcctttcacgcctgctcacacagaccacatctcccagtgtccctcagatagttgtgccacatgacaattctagccattggaacctgagacgagtgccacttccaggcctcgcccataagaatctgtactcctcctatgctctttcccctttccctggatgaatatgcctaatgacaaaaccctaggggatgctggagcttcgttttcaaaggaacctctagtagtagttggtgattgtagttagtgatt

SEQ ID NO: 68699 - DNA, 1172 bp, Homo sapiens
tttttttttcaattaaaaaatgtatagactcttctctttcattttataaaggaggccaaagctctatttattgagtataaaatgtacaatattagttaaatacttaaataacttcttataattccttctagtacagagatgataaacttacatggattctgtatccatagggaagaaaaggagttttgaagaatgattcttgagaaatatgctacgtactgttgtatcgcatgatatatttcatggatgccgtatcagtcactttcccttggtcacgccggaaaattttggctcgtggagctaaatcataagagtagtccaagcccagcttctgaactaacagtggatagccactccagttgtagattttttcatggaaaggaacattgtaggagggccaatatcctgatttggaatggaagggaagtaagggagggattgacagggaaggagacagaaaaggagagagagcaaaagaaatgttatccatgttcatttattttgaaaatgggcacaggcatttaattacaaaataatgtacagaaaataaagctttgcatgtgaaccctggcagccaaacagccttttaaatttcctaaatcagcacagctctaggttatttcattaggggaagaagagcatcagaattctctggttttcacccaaaattcttaatctctaagccaaaaaacaaccatattctctatagagcaaaataaagtataatgcaaggtggtctggggagctcatctaagtggatttagttactgaaatgccaagaaatggttgttcacagtgtggccctataaaggaagatgtcaaatggtaatcatgaagtagtggaagaacatagcactgggaatagaaagcctgaattctaggctcagggcttaagaatcaggtcttaggcaggcaacttcatttgttttgtttctgtttctttttttttgaaagacgtcaatggggagggagaggagaagtccataatgtaaggggattggggatgatcttttaggttacattaggcttttaattcctttgactctaaacatttataaaggctcagcttcattcaaagcttcatagtgtgtgaaggccacatagcctactagtcactgagcaccaaatatgtgacacagctctctcttgtaaaagcagaatttcagaaacat

SEQ ID NO: 68700 - DNA, 1091 bp, Homo sapiens
tctccccctactatgtcttcagaagacccacgtgtgaaaaattttaaattttaagtaattgctttgaaatctcggatgtaaagcttttcaggtttttatagagtttcatagtaagtcaggaattccgtttgaaaaaacagaaggagggagggacagaacaaggaacgtgcataggatctggcctacttttatttaagcgctgagaaaaggcaatataaattcttttagctcatactgttttaactttaaaacgtatcaccatgaacctttctccaaacatcagaaaaaattttcccaaaagagcaaacaacaaaaaaatcaggctggtttcgctgactgcttcctggacttaacaactatagcatgtctccagaggtggggcctagagctccgcccacttttttgatgttttcaaacaggtccgcatcgagagactataagccctggtctgcgactggcaatcacagtgggcagcccgattttctgctgagtaggcgctgtgatttcagaatgtctgggcgaggtaaaggtggcaaggggctgggtaagggaggcgccaagcgccaccggaaggtgctgcgggacaatatccaaggcattacaaagccggcgattcgccgtctcgcccgacgtgggggcgtcaagcgcatttctggtctcatctacgaggagacccggggagtcctcaaagtcttcctggagaacgtgatccgtgacgcggtgacttacacggagcacgccaagcgcaagaccgtcacggccatggatgtggtgtacgcgctgaaacgccagggtcgcaccctttatggtttcggcggttgagctgtccccacagcttctctacagactccaaaaggcccttttcagggcccccaaactgtcacagaaagagctgttaacacttcctagataacgggtaaatatcaaccctttgatgtcgccttccggataccggaaatgggatattcgcggcccgagcatctgctcgggattagacttggcgggcacggggagaactagacctcaaggagggggttccgcctgtgcttaggtacgaccctggaggtgccgcgcaacgcagtagtgacctc

SEQ ID NO: 68701 - DNA, 1133 bp, Homo sapiens
gctatttactctgtggttttgtcatatgtaaaagtcataacacctgttttaaggattgagattgttcatttactgtgtgccacatattagacaataaatggaaaaaagtaccatgttcaatgggggtatgggtttatccttataggttaaattataggtaaacattaataggactttttaaaaaatgcctcattgttagaactactactcacagttaccacttggggtcagtggaacaaaatgcatatatggttttgacatttgagtctaaatttcttaaagggatgaggcatctgagggattgttaccaaaatgatgaagaaataaggacaagggacatcaagacattcataagaaaaagcacctttgccttcccctgggaagattcacaggaatctgtccagctcttattacatgatgagcaacatagacaagatacgaggcattgtaactgccctgtcgccacccgcctctcccaccactacccaaaggattcttagcatcccctcacatactctgcctgcctcaacgttcagtcagcccctcaccatttttgtttttgagagttttttttttaacccgaatagtttacgggctgtttaaaatgcatactcctacaaaatcagctcagcccatgatccatgatgaacaaacagtagttcttgctgatgtgtgattatgaatttaaaaggccagtatttctttaagcataagaccatatggaaaaaggcctaagacaaaatctgatgggaactgaattccagtttttaatagagttataatccatagttttatttacacacaaacacacacacacacactctttcctgcagagataagcaagccgttcagtgtggctgtggcttggccaggatttgtttgatctttgtttttcctgcagggccagtcttgtctttgtgtccccgaggactggtctgtttagttgtgcctgcctggaatcaaaaggcttagtcaggccccataattggtgatgactggcatactatatgcaaacttcacaatgccccttccagtggttgaaaggtcgcataccatgctgtgtaagaactttagctctctgcaatgagacttaaattcagattcactctactccttattagttatctgatttt

SEQ ID NO: 68702 - DNA, 1028 bp, Homo sapiens
aggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatattttgtaatattttacttgtaatgaaatggatcacaatgtcatttcctaatacaaggcaggatatgtgggaagaatatgtacaattatttgattaaaattatttcccactgacctaaactttcagtgatttgtgggaaaaataaataaatgttctacaccaagatactctgtgttactgataatatgtaaacataatacctattttatggacagaaaaagttaaatatttaaaacttgggtctttaaggaactgcctttctggtacagaatgagaatcttactgaaaacatggtaaaaactacattttaaattttaagggataaaaaggagtaattatttcccttttttaagattgtcatactggctttagagaaactgagaggtgttaagaatagtatggtttggcttttattatttaaaagatgtcttaccttcagtggttact

SEQ ID NO: 68703 - DNA, 1057 bp, Homo sapiens
taatcaataggatcttagatttgataaaatgtacttaatatttcatttaaaagtggtatttgaagaactgaaatctgcagttcttggtatatgaatattgtgtatgtctgaactgtccataggacatgagttcttttccagtaatgatgacagattgtgattagttgcattctcttactccatgtgcattgtttttttctttgagacggagtttcattcttcttgcccaggctggagtgcaatggcgcgatctgagctcactgcaacctccgcctcctgggttcaagcaattctcctgcctcagcctcccaagtagctgggattacaggcgtgcaccaccacgcccagctaattttgtatttttagtagagacagggtttcatcatgttggtcatcaggctggtctcgagctcctgacctcaaatgatccacccgcctcagcctcccaaagtgctgggattacaagtgtgagccaccatgctcggcctccgtatgcatttgatgaccagggttaaaattttatttcctgcccattgacctttttgtgcaggggaaatggtatggaatataatgcatggggatcagtctcctgaccttgtccttactaatacctgcactatgcagctggaatagaaccttgggatgtgagatttgagatagtaatttgaaaccagttgatgtccctttatattttaaagtaggatgttatttagagaagaagagaacataatactgtaagtacaggaatataggctgaaggtaaatactgttttataataaaatattcctgagtttcaaatagcaaccaatatgaattcagcttattttctgtaagttgttatccatttatttaaaaattggcaaccaatatttaaatgtccttaatagtagttaaattttattagttcttacagtattcatcttgcctattttattcatttaggtattcctccacctcgtcctggcatgatgcgcccacctttggtgcctccccttggacctgccccccctgggctgttcccaccagctcccttgccaaaccctggggttttaagtg

SEQ ID NO: 68704 - DNA, 1054 bp, Homo sapiens
taagacggagtcttgttctgtcacccaggctggagtgcaatggcgcaatctcagctcactacaagctccgcctcccgggttcacaccattctcctgcctcagcctcccaagtagcggggattacaggtgtctgccaccatgcccggctaatttttatgtatttttagtagagatggggtttcaccatcttggccaggatggtcttgaactcctgaccttgtgatccacccacttcagcctcccaaagtgctgggattacaggcatgagccaccatgcccggctgtactcagatatttattgaatgaattctgtttccatgtatgtttcattaacttcttgaagttaatctgatttcaggttaaagtcaaaccatatttgagttacttttaagccataattattacttagtgtacatttgtgtgacattaatttatcatttttctcttttcaggagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtgatgctttcaatttctataataaaaacttagcctgctgtttatttaatttgctctaagacatatggtcacatttcagtattctgaaatctgaggtcatcttacagtcagtggtggtttttaagttgccgttgacctggcttgaagtacagttcttccagtgggtatttgcacttggttcacttgaggaacttgtagccagagaacatgggattaaattctctatttgataattttttggttttagttgtagttacgaagccgtttcatgcatctgcatgagtaccaacttaaagtttaaaattagagtgtttttttcccttacctctacctaatgtcaaggttagacatgcagattttcttgtgggcttgttttatgtggtaggtatatttctagtttacaacactgaaatgtccca

SEQ ID NO: 68705 - DNA, 1640 bp, Homo sapiens
ctggttggttgatgacatttaaattagtttcatatttttgcaatagcaaattgtgctgctataaacatgtgtaacttgcttatattttatgttggccagtagatgaattttggtatcatggttaggctagtttcatgagttgggtaacatttcatcttttcctatgctctttatcagatttctgtaacttaatgtttggctgaatttcctcctaatattatttgtagcctttaaggagtagatcttcaactaccatttaagttttgtatattctgggcttatcacttctttggccaactttagtaatttatcttttcttgaaaattgtttttatctgggtgttcgtatcattagtatagctatctcatcctgcacctctgccaagtagtgggtagcaatcatatctagtactttatagtgctacgtagtaaacatttactgaattttgttgatgccaatctactccactccctcctttgtccccttaggtctgagtgtacggtttgcagatatgcctggaaaatcaaggaagaaaaagaagaacatgaaggaactgactcctcttcaagccatgatgcttcgtatggcaggtgaggcagggaaaaaatagtgaatcaccttttggtgtatcctcacgctaattactttacatacgtttttccatttagtatctcagcaaccttcaagtaagtaataagtccttgttttacaaaaataaggtttggaaccattatataggctgcctaaagttacacagcaagtaaatggtggggctggcatttaaatattggtctgtctggttttaaagcctgagttcattccactatgctgcattaacatagataagtagaatgttatttctttcacatctaagtattttattgaagaagactatttggtttttaattttgagaacacatttattaaccatgtgtattcagtcattgctgttctccaaactgtaagaaaatgaatcaactccatttactgggtttaaaatttctttcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgccgcagtctgttcctccttctcagatacaagcacctcccatgccaggaccaccacctcttggaccaccacctgctccaccattacggcctcctgggccacctacaggccttcctcctggtccacctccaggtaaacacttacataatgtgaataaagtttaaatgaggttagaatgaagtcattccaaaaaatactatgtgttgttagtgttcatgttttcttgtttcctcctaattggattctcttaagatgtgaaggattctcaaaggacaagtaaaggttgttcattcccaaaccattgtttgcaactcatagttctactgacagccacctgtttttctccagagcactcttgttttcacagtttttcttattacagcagacagaaacttgaacatgtaatggaggttttctttagtattgctttttagtatgataggttgacctagctctaaattggcagcag

SEQ ID NO: 68706 - DNA, 1003 bp, Homo sapiens
ctcagctcactgcaacctccatctcctaggttcaagcgattctcctgcctcagtctcccaagtagctgggattacaggcacccgccaccacacccagctaatttttgtatttttagtagagacagggtttcaccgtgttggccaggctggtttcgaactcctgaccacaggtgatctgcccccctcggcctcccaaagtgctgggaatacaggcatgagccaccaacccagccagatttttcttatatattctcatcaacacacatgttctgaaaatggccgtcccaactctgagttgatactcactcagctaatatttattgagtttttactatatacggcattttttctaggcactaaggatacagggtaaacaaaactaaagttctgttcacatggaactattctcctaaaatgtttaccaactaaaaatactcctatccagtgtctaatggatagcctttgtcagttaagttctttttattcttagcttgctaataggttttttttaatcataaatattttttaggtatctgttgggatgtaactttttttgttttttttaagttctttagtgaattagattgctggcttttagaacacttggattcaacttgcttgtattttttttcctttttgtaaattttaattttgatagtttttggagaacaggttgtgtttggttacatggatgagttctttaatggtgatttctgagattttgatgcatccctcacccaagtagtgtatatactgtacccagtttgtagtctcctttccttcactcccctcccacccttccccactgagtccccaaagtccattgtatcattcttaggcttttgcatcctcatatcttagctcccacttataagtgagagcatacaatatttgatttttcattcctgaattacttcacttaattgcctccaacttcatccaagttgctgtaaaggccattattttgttccattttatggctgagtagtattccatggtggat

SEQ ID NO: 68707 - DNA, 1143 bp, Homo sapiens
catcatacataagtatagaaatgtttatcgtgttttaaattaggcttttcctggagatgtcactcttgctgctaatcctttaagacttgtatatctggttcccttttagctttattgtcatcagactagagcgtcattgtatacattcactgactgtgtatgtgtatacaaacatgattgttgctaaaggaggaaatgggttttcaaattagaactctttttaaaaaaatcttaaattaccaaaaagaagtgtttaaaattattggcagaggaaaattttgttagactgtatgagtagctatatatacaagaattttttttttttttttttggtaagaattaagttgttacagtctgagttgaatagcataattttctgtatttctgggtaccatgtagtggagggtccaatcatactacttctccatgttcccttcccacttttcagcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtatgtgcagatgaaggattcatggtattgatcaataaagagaaaacaagctgaaggtcctaatttattaatgaatctgtgagagtactctgaaatctttggaagtcgggatcatagctgtgttcatcttatatattaaaattttgaaagtttttgacacagtaagtactcagtggatgtttatgaggaaaagcattaaactgtatgtaataaaaatgtctatgtaataaagttcactttggggtaaaaggtataactattcaacagcataaacgtattatgggtatgttacaggaaagaaaggagagtagccatattaagaaaaacattgatgttgtattttataaatctgtttaaatatctacctttgaagcccttttatggtatcttacatgaaccaggatcataattataacccaggtacactcatgagtggaatcatgaaacatattatatctataatgtgtgtgtttgattattaaaaaattcaaataggacatttg

SEQ ID NO: 68708 - DNA, 1096 bp, Homo sapiens
gatctgttataaagattatagttaagtggtgagtcaaacaccactggatattttatttgtaatcccattgtatcatcatagctttattacaaagtgattaacgtctccattttttagatgaggaagcaaaaaatcagagaattcaagtaaaatgcttaagatctcaaaatttgacaggactaacgtagtaggtaaacacaaatctgacagaatcttcacgaggttttcagcacagagcagtgaaaattgatttttattacaatgaagatgaaagtcaattaggtggcatttctgagaaaggtaaaattagtggccatctaaaaagggtggggattttaataaatattgtagttcttcgaataaaattgaaaagagtatgtctggtgtctagatctcttaaaaattttttagcatatatggaggtttttatcatgtaacctattgatacctaattgaagtggcctcttatatttaattccataatctactttttctcttagagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaaggtaatcaaggttttttttttgagagataaactaaaatattatacagattgagtatcccttatgcaaagtgcttgggaccagaagtgttttggatttagggttgttgggttttttttatattttgttttgtttttgtgtatatttgcatatattttggggatggaaccctagtctaagcatgaaatttatgtttcatatacacatagcctgaagataattttataaattttgtgcatgaaacaaaactacgacccatcacattaggtcaggtgtggatttttccaccatggcatcatatgggagtcaaaaagtttaggattttggagcattttagatattcagattagggatgctcagcctatacttagatttaaaaagttaatgggagaatgtcatgtt

SEQ ID NO: 68709 - DNA, 1949 bp, Homo sapiens
ggaaattttgagcaaattagttttgcgagcccttgtttcgcgttttatgttatgtttttccttcagattcatagttgttttttatgaaacattaaacaaaaatgtcttgacatttttggttgtcataattagagggatgctcttggcatgtagtggagagaatccaaagatgctgctcttttacagtgcatactgtaactttccacaataaagaattacctgtattaaattggaggaaatgctaatgttcaagattcaaagattttattatatctccctctctccttttaaaggaaaggaagcccggaagagagaattaaagaaggtatgattttagaggcatcttataaaactttaagtattgtttggtacatcttgtgatttgggattagtgggtttcagaataacatttctaatattttctagaaaaggtactttatgctttttataaaaactgtaagatatactaagccaaactttatttaggaactgaagtaactttgcagagaagctcactacaggttataatgccattgtttgattacttttcccagtgagttaaaaaatacttttgaaaataattcttttttttactcattaaaacataactgttttaaagtctactgatgaggatggaaataaacatgatgctagatagctttatccattttcctgattagctgtctattacatatattacattagcttaaatatatatatgtaggtttataatatttatagatatattagatttatatatccattttcccaattagcattctcctcttagctgttgaatttgtggcaaagtacttcaaaagaattagaaaggatttgccttatagtattgtgctttatagtattatagtataatacattgaagcaacacagattttaaataatgttcgattgtgttttcatgtttagcattaactcctgcaaaatttttaaatattctttatataattttagaatttagcttcaacctttgctttggacttcaactagcagaggttttacaacagggggcaggaacaatcacccaaggtcttcaagaacataaggggttaaaaaaaagaaatttaaagtgtatgtgtgtttaagtaactgctaaagatctcagagttcaaagaaatactttactaagaaagcacatcttaaaaatagcatttctttatctttttgacaagtgtaaacatttttaaggcaaaaaattacatagctgtttctggtggttgaaacaagtgatcagaagccaaggagttattctgtttagattcttaaagcaagttgaagtaaaactcctgagtgcctgacttcttgacatctgcccttttatttttctaagaacaaaaaacagcgcatgatggttcgagctgcagttttaaagatgaaggatccaaaacagataatccgagacatggagaaattggatgaaatgggtaagaatttacaaacaggcagctataacagtctgacacgtacagaggcaggcaggtaacgagtgaagcagcataggcgtaagtaaaacagaacagcatgatggcatttgatgcttggatttaatgttagtttcagggagacaaaatggagtgctagagggctgttgcaaactggagaccccagataccagaataagagggaagcgattatttggctttcagttaattgttattgtgagataacagaagcacagtttggccagcttgctttttgggagaagacttaatctgatttatgaaataaccttgggttttttgtttgtcgtcttttatttaatgttggcaactaccatgtaaatctaagtattaggcccctgtgaatataaggcaatttccaatttttccaatcagaagatccaaaaagatacttatccatttagtaaggatatagaaaaaaatcatcaaatacctaaaaaccaaataataaaatactataccaggattctc

SEQ ID NO: 68710 - DNA, 1072 bp, Homo sapiens
catctggctttctgaaacatctggctttcggggcagttggacacttggtgaaagagacattaactgtaataaactgggctgacaaaatcttccctttcttacctttaaaaagtgtctacttgcaaaaggaagcaaatttgtccgcctttattactggaaagactgcgcttcaaaaaattaagccccattattttggaataagaggaagaagtcatgtaatagggtactgtgttaataaaagttttagcttacaaaatattttttcctcaaacaaaaataagtattccctttaattaccttaagaaatatatattgggagtcaggtcttagtaagaaaaatatgtgtcttaatatttaagttttggggagctctcagtatagcactaatttcaaatatttgcatttttagttgtgttttgaactcttgagagtcaagcattatatctgaactagaactgaatctgaattaaatatgcttaaattaatgagtttttagtgtcttagaagtattgagaatgtacagcatacatgccaagaaaaaccatggagagaggcaaaggtgaggtatgtgttttgagcctagatccattacccccattcccttcttattcttcttttacaattacatgttaataaagggaggttatagaagaaggactaatgaattctgatgttcatggtttgtgccatatcgttaaagcattttctagttgtttttatcagttgacaaagtcagtgctgtgatccataagaaaaaagctaaactgatgacttgaggatattcaaagtggtcttcacactcatcacatttctgaagaatgatagagatctaaattttcatggtcaagaaaggtgatgccatctttcttggacattaaagtcaaaactaaggaaagaacagtctcacagaatttctaattaaaggaattttttttcagagattggtagggactagaaaaaggaagaaatacatttaggagatataagctatttctttgtcttcaccttcacaggtttttctttttttaatgaacaagtaaaccatacaaattgtcaacatgggacggagatc

SEQ ID NO: 68711 - DNA, 1149 bp, Homo sapiens
gtagctgggattacaggcacgtgctaccatgtccagctatttttgcattttttgtagagacggggttttgtcatgttggccaggctagtcttgaactcctgacctcaagtgatccacccacctcagcctcccaaagtgctgggattacaggcctgagccaccgcacccagcctctccctgttctttaaatatctcttaatataggggggcatggagagaaagtctctccaatattttcttcttcttttccatttttgtatttttccactttatccttctcaattttggcctcttcttccactttctaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattacagaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttcttttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaat

SEQ ID NO: 68712 - DNA, 1044 bp, Homo sapiens
cttcttctacaggagatctggaagccctcaaaaaggaaaccattgtgttaaaggaaggttctgaatatagagtcaaaattcacttcaaagtaagtatcctgccttgtgtgtttttgtaaagtttaaatcttttctttaatcagtgactacatttcttgcatgatcatgttgaggtactttttgtttgtttctcccctagtacccccaagctgggtctggaatgtcctcttcccagccctgagggctacctgttgagacccacgtttgcctcctgtcttttcctagccaggacttcttaaactcttcattatctcttaagccaatgggatccctctgtgaactccaaacacatcctcgaggcacacactgctttgtgttgtaccacctgtgtcatttcttcttcatagaatataagcacctcaatctagggtgaaattgtacatctctcctttccaatatttcacacaaaactttgtaaatagcatatagttcatgaatatatattgaaaagtggacaaacaagtgaatcaaccaataggaaaagaaaatgggacagggcctcagctctaattgctcaaggattatataaatccaggaagtgtgatctttgctaaagaactggaaattacaattatagttgtggaacaggtaaccaggaaagaggaaactaaataagaaataaactgacatctaatatatcccaatgagccatatatcccaatgagcagccaaaatcacaagaaaaataactttgactttgaaaacaaataagttagaaatgcagtgtttgcacttcgtggtttatgtttgctttggtggcctctcattcccacttagcctcagtctccagggcctgggctccaccaaggaagactccatctgctctctctatttgcacactgggaacttttttccccaaggtacaggatatgattcagggtttatggatgacctccctaccccatacaaatataactgaaaataatttcatcctggaaatatttgttgatgcctactctataatggacactgagctagggttca

SEQ ID NO: 68713 - DNA, 1040 bp, Homo sapiens
caaacacagtaatttaaaagcaatccctagacccccatctggaactaatttacttctcattttaacttctggcattacaaagcatgcattttatatagcattcattttaaatttccattaaattgctcaattttattttttataaagccaaatggttttttttttcaatgtcaatttattttgaccttcacagggaatagaaaaagaggacaggtgaaataaggggtaagagaaagggttccttcagaaataatcactatatgaagagatatttgtcccctggcttcatctgttaacttttttagtttagctaaaacatctgaggagtttaggtggaggagaacataaaaagcaagagatgccaccatgagatgaatctgaaaatagaattataagttaagtcctcttctacttaaactatctacctggaccatgttaaccatgcccactgcatgccaccacccaccagaaagtggcactctggcaaggatcactccctacagcttcaggctttgatgtccactgcttatggggcagtgcctagcacagtacctggagcatgataaacattcaataattgtgtatgtatgatagataggcagatgaatggcaggataaaggatggatgaatggatggatggcaattctctacattatgttttcattaatgtcttatgttcaacatgttcaagtccaacatcatttttaatttgttttcccattatattccccattatattctcaaagaataatgctacccccagacttttatttcatgtggagtctttgcactaatccctctccctcactgtccatttataatcaatgaatggtccccaagatgatcagatcaaattgagccattctcctacccagaacccctgtatgctcaaaaacttcagagtaaaatccaagctccttagtgtgacataggagctactttatagtctgggctctaaagaacctcacaacctgaccccctaccaacatagctccccctacatgccactctacccaccctgaaccacatgtgattccta

SEQ ID NO: 68714 - DNA, 1025 bp, Homo sapiens
cttcaaaattcctgcaatgccgaatgaaaaacggaggccatccactacagtggaaaatgtagagcaactccaagaaaagaggctggaagaaaagacaggcttagagatgtctgacagacttgaagatggtttccattttcccattttgcaagaggggcaatggatcctctaacaacagagcctgagttagtatgttatcatgtattacctcgtttaatcccctcaatatctctatgagataggcactatttttatccctattttgtagctcagatacaggcttagaggtttagagaagtaaataacttgtcaaatgtgagtagtagggttgagatttgcacgaaaatgcgcctgacttcagggtctgacttaagcttaaactgccttgttttattgatcatattgatcactctatttctttctcctgaggactcgcaaagcaatgataataccattctgctcttgcatcatttgttgcacattcttgtttagaaagaaaatactaacaactattagagattttctgaacctagtaatttcattaacaagcattccccaagtctacagggcaaattttttgatactcacaatgttacttcttgtgaaaattttgaagtgatttctgaatcatcagagagatagagattaaagtgacactgttttaaaagttggtaattatcatacaattgcatgaaagctgatgtggtatttgtggtaaacttccgtattaggatgggtaagcctgtatggcagggttcttaacctgaactccagatccagcaaagggtccacaggtagatttcagggggtctgtgaacttgtatgggaaaacatttcatctacattttcatgcacccttaaatgacatttggcactgccttccatgatgaatgtagaaacaaatcacagtgttagcaatacctgtgactttgtccctaatagaaatgatggatatttccattcgtatcagttgttgctgatatctcaaaatgttatttttcgtcatcattaatgtgaaatcataa

SEQ ID NO: 68715 - DNA, 1775 bp, Homo sapiens
atccaccacaacaccaacttctctttgttagattctaattgacagttcatcttcttgaatatataaggtgaattatcacaataaattttgtaaggaaaaaaagtaatttttatatactttttctttctatcaccaaaatggagacaatggggctttccaaaagagtcattttagtccttaagtcctttaagtactttagtccttaagtacttcaaataatgcaggctgttctttggaggtaaaatggaccttgggtagattcaccataatgataccttacctactgtatactcataaatgtcttcttagtgtaattcctgagaatcattcaatcaacactatgttgatgctgagttaattatcagaagtagaaaaattttctttgttgaagtctagggaacttctttcgtagaatggcttttatatggaaattatacctttattttcttgtacatgacagatacttgatgatcggaagcaatggtggaaagttcgaaatgcaagtggagactctggatttgtgccaaataacattttggatattgtgagacctccagaatctggattggggcgtgctgatccaccttatactcatactatacaggtgagcatgatttcttagtaaaatgtagtatgtacacatttacgaagttatcactcttaagtaggatttaaacacctttgtgtattgatcattttgagatgtagttggttatatattttttctagagtaattggtgggggagtggcaatggtgagagacacagggaagaattacacatatgttttctgatttacttctagaaattgttcaagatgtttagcagtaggtacctgattctctgaatgctttttttccccaatctgtagtatttctgacatttgaagaaatggtatttctgtctttttacccacagctctgctatccaccaggggcttcctcttgatagaggatggcactgatatcacggcatggtgtccagcagttcaccttcaccagcccttgctttcagtctcttaaatgttctgccactgaccagccttgaacttgcactcatctcaccttacactaatacatgagtacctgttcacctggattacaatatttttcctctcttgattttaagattaaaaggtacttaggatatagattagataggtcaggctctctcttcttgttcattgaaggcccatgaaggtccattcttatggcccatgccacattttcaggatttcagtgaccctggtcagctcattcaccctaacatctgaattaacttgctcttaaactccggaattttagacctgtgccaggctctctagagttaggtctgtaaacaaagacagaatggatggactctctcaggtacagccagtgaacctggggtggcttctcattcccccagaaagaactcttttaattttcaaagtctcgagaaaaagatcacatctgacctcataataatgtcatgaatttgagtagaagctgcgtagaatatgcagtgaaatagttaatttttatgccagatctaggcttaaaaaaatacagattgtccaaagctggaattgtggtcatacttctgctgccgtgacaatttatttcagtacttttggctcctcatgacattcatgcctggtgtcagtcctgtgcttatccagagggacttggccttactagaatccatgaatcaagcaaacattcaaaataaagaatttgtgtatagtttctctatctcggtaacttaaagtgatggcaatggaaattatttgctgtg

SEQ ID NO: 68716 - DNA, 1071 bp, Homo sapiens
ataaatgcatttacaacaagacttgggtaattcaggatctgatgatttttgtttaggattgaaagacataggtgacttggagtgacaaatatgggtggcagtactcagcttccttacttcctctgaaccctaagcaaactttggtagtcatcacagttagtcatttgtcatcatttctcttctccctttcagtattcgcagttgctctcaggacccagtgatttcctactgctgacttcactgttatgttcagagctgggcaaaaggtgtgggtgcttccaacagttagagcactcccctctttagaacagcctttaattaaagattacctaatctaatgtagtgcctctactctttcccagggaaatgataaactgaattaattgagctcagatttttttaatttaaatggctgaaacttgtttatttttatttatgtattaattacagtatcctgataatgtcacctgctttgtccatggataaactcagccctcctcctgatcactttgtcattagaattaactgtggtaaccatatgtccaagaattttctgaaacattcccagtttcaatattttgccccaatgaatccataaacaaatatacaaaatccataatgaaaacagccaaggaattccagtgcttcagtgtctatcatgctttctccatacctcattttcatataaagaaacaaagtaaaggctttggggagtttttatttgttttctcccaatctgagcatgtattctctatagcaggggtccccagttcctgggtcgtggaccagtactagtgcgtggcctgttggaaactgtgcctcactgcaggaggtgagcagcaggcctgcgagcattactgcctgagctccatctcctgtcagatgagctgcgcctttagattctattaggaggaagaatgctcttgtgaactgcacatgcaagggatctaggttgcacgcttcttatgagaatctaatgcctgatgatctgaggaggaacagtttcatcccaaaaccatccccatcatccccggccctggggtccatggaaaaattgccttccatgaaacc

SEQ ID NO: 68717 - DNA, 1819 bp, Homo sapiens
tactttttcatgctgtgagaacaatcttcttaaagctctcagtcacttcattcttctgctgtaaagcacgctagttccatgttctattgatttaagtacaactgttcgccctggaaatcaaggttatccacaatctaaccttgatctacccttccattctcatgtttctctccttttgtttgttgtttcgtatacatgcaattccccctttccttgtttttgcttatgctgtttttatccaaccatgatgtttttcccaccacatcaccctggaccaaactttttcaaatcccatcttataagctactttctccatctaataccttttaagtatccatttccttatctcccaaccaggtaagtctcttctcataacgattggtacttctcttgttatttatctgattcatgtattttattagcttttaaggcccttagagcagggcttgtcagttactcacttgcacaatgtctgccatagagaaaggctacaatgtatgtttatggaattaaatgagtaatttgtagtgcctaaggatagagcaatccattttgaaatttgtatcttctcagtttgttacagtcagactatgagatgtagcacggtaactaggtagcatgtctgatgagatcttcaaactttacagacataaatgtggtttttgtttttccatttaataaatttccttggattttgctctgatcctctcctctcgcttatttcattagagggtgttttaacgctgcgggcaaaacctccacctcctgatgaatttcttgactgtttccaaaagtttaaacacggatttaaccttctggtaagtgaaatttatgtatatagaattagaagaaataaatggaaaaggtgaaaatctagtcaggatgtttctgattaaattaagaaataaaattgtttttatagattttgtgggggtgtgtatgttttgatttgccttcagttaaaacagcaaattttaaaacatatatatctaagagacttgattgaaaaacaatgacttctattctcactctatccatgctaaagaatatattaaaactgaatctggtggtaaagaccgtcccctctgtgtctatgttggacctttctgagtgtctgtcttgcttgatagtaatctgttttctgttttcttcatgttgcaggccaaactgaagtctcatattcagaatcctagtgctgcagatttggttcactttttgtttactccattaaatatggtgagattttattagtttaagaaagaatcgttcttagtatattttttaaccccaagtgtctgtctggattatctagactgcttttcttcattaccttgcgtgggtactatttctttgccatttgtgtaaacatcaagaatgtaaaatttgagaatttaaaagaaccctgtaaatcatctagtttaagcaccttattttatagttgaggaaactggtatctctgacagtgctagggatatgaaaagaaataaagatttattggataccagtatttcaacgtatactagtatataatatccagtgccttgaataacgtagatgtttttctcattctcacaaaataatcatgagaagtctagttcttgatggatggtttgctccatgaagtcattcagagacccatgttctttttatcgaggtgttccttcatctcttgaactgtctctgacttgtttattcatttatgcactggttctacaaatacaaattgagagccttctatgtgcttggctttatagtagcccatcaggaacaaaacagacaaaaattcttaccttcttagaacttatattgtaacatagtg

SEQ ID NO: 68718 - DNA, 1051 bp, Homo sapiens
ctcccatacagatagcctgctgtttaaatgctgctatgttcagcatttaaataaccataatagagtgtcaaataggggaaagtttattttaagagaatattatttaagctgttaagaatttgttttaatgtcatgtttatgtagttcaacatggctccgtatgaaacagatttaggtatcttatgagtcaaaacaccatttcttctattcaaaaaaaaccttggttggctttattctctcattaaaatagtcatgaagttttaagagtactttgtgtttgtcgttctctgctagctgacctcaggttatttgattttcttttggaaaatgtatactaagaggttgtatgtgtttgtatgtgttataaatctttttcctttttgccaattgtaagcacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaaggcaagtgtgtaaaatttatactattttattttcaagaaactccacaaatattaatgtttacaatcatttcagattgtttgaaaatggatggaagtttgacaaaataaaatgttcactttatttatagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggtaaaagaatggtgaaatttttgtttcttctttaagcagattgtctgggagcttttgaattacctattttgataatatatctgcatattagttactagatttttagtttctgagcatctcgtaaggaaaacaaataccttagtatcttctctaggatttccatggcaagtaaataaagaaattagggtgatgttaatcaaatcagtagttcacacttg

SEQ ID NO: 68719 - DNA, 1017 bp, Homo sapiens
attgatacaaggacatggagattttaatctaaattttaaaagtaaatataaatgaaattcatatgtgttgtaaaatgaaaatttattaagttttcttaaaattctgtgttaatgttctgagtctgcatatgtatatatgcactttatatttttgtacttgctcagcttttatgttcagcagaactttccaaacaacttatctattatagaatatctatactaactaaaagaaataggtttacatttacaaaaaaataggttgttgggaaagctaaggtatatctatatgtcagaatgttaatggcttaaaggcctttaggtttgaccttgtttaatccttttattttacagtaagggtgctgaggcccagggtattaagtttcttgcccaaatttagtttcctacttagtgacagagccgaagctggaacaataaatcttataattccctctcagagttatttttcatcatagcattctgtttagaagaaatagggcaactctgaatttacaaataagcaagttgcttgattagaaaagtaacaaatagtgctcactttggcagcacatatactaaaattggaatgatacagagattagcatgacccctgtgcagagatggcactcaaattcatgaagtgttccatattttaaaaaacaatacaaattttaaaaagagagtaacaaataccaaatattgccgacatacattttatattttaatgttatttttttggttttgcagcatttcagaaaagaaaattaaaggtttctttttgctttttaagtagtttggtgcaataactttctacctgactttcttgtttttcctatcagcttatatttataattctaagtatcacatttgtgtgttttgtagatgtgtgaaaactgttaatatttaatggcaagccatgtgattgaatcatgttttaaatctcctctaacactatcccaatttggatattgcaaaaggagatgttccttgtaatgcctattattttaataatgtagtcta

SEQ ID NO: 68720 - DNA, 1053 bp, Homo sapiens
gggcaaattaatttacctgcgtgtgcctaattttgcttatctgtgtaatgggggtatctcacagggttgaaatgagcattaaataagttagtacatgcaaaatacttagaactgttcttggcaagtagaaaacactgtatgtgtttgctattattattgttgatattatcgatattatgtgctataggaaccaacagcattttctaaattgtgaaattctttttttacattatctagatctgcaacttcttggctgttgtaagaataaacaattctaaggttttgtgattgtttttctacctatgttagtgaattggcattatcactgaaatcagacattcataaaatggatttaataccatacatgcctatactttttatagccttattaatctgattgttgttggtttcagtttattaagtattgtgacattattaccatggtctaatagttatgaattgtagatctagagaatgtattcaataaatattttgtcattaatatgtgtacagaacaggaccaaaaatatatgatccctgactttaagggacttaaagtctggagaataacttgaagataacagaaaaagattttttggataagaataaaataattcagtctttcatttctagacagatatttattaagtgcagtatttattaagtatgctatgccatgatcttcatagtctttatttctatgtgctttcattcatttcaaagatgactaagagaaggctgttgcctatgtgccattttggtgcaatagactagtaaacacattgttataataaagggctaaatgtgcttagatagtagtgtgtaggaggtgcactggtgagggttgatcagaaaggatttaatagaggaattgagccttgagctgagctgtgaaagttatattgtgttcttcagcatttcaggggtcggaggatgctacagacagtatgaaacccttttaagcaggactatcaatgctgtgaaggtggcccatatttgtcttgttcacttcaggattccctgtgcttactggcatagtggctagtatataat

SEQ ID NO: 68721 - DNA, 1729 bp, Homo sapiens
gtgactacttctggtaaactgccctatcatagaaaactgaaggaatcagcaaatacccatgagctttgcttagaattgttccactatcattgatatcctgtgtatggatatgaatgactatggatggtttcagtccatgccatttttttaatatttggacaatgatttgtcatatatcagtctgtgccagattagcctttcataagacttcattatcatctttactgatagataattcaggagccaaaggtatatcagaattttgtttaacagcagggtattaactgtacctgttaacttactattaggaaactgtctgtttccaagcagcaacattttttggcatttggcagacctatggaccatttttaagagacagtatcttaaaaatgacagggattggaattgggatactctctcagatttctttcagctctcaagtttagtgatactttgaaatgttgggttggaattttatgattatagtgtttattttgattatattcttcgttttgaagggttttcttcttgctacttttaatactgattttctcatcgaggaattatattagtactttctgctgttctctccattggtttcaagacttaatattattatcctcttctcactcccttcagtttctgtgtcctgccgtgtttttttttttccctaatgtccttctgttgcagtttgggttccccagaaagcagattttgagatggaaattagtgttcgggaaagtttattagaaagtgttcttgggggccaggcatggtggctcacgcctgtaatcccagcactttgggaggccgaggccagcagatcacctgaggtcaggatttcgagaccagcctggtcaacatggtgaaaccctgtctctattaaaaacacaaaaaattagctgggcactttgggaggccggcagatcacctgaggtcaagatttcgagaccagcctggtcaacatggtgaaaccccatctctattaaaaacacaaaaaattagccaggcgtagtggcgcacaccagtagtcccagctattcgggaggagaatcacttgaacccagtaggcggaagctgcagtgagccaagattgtgccactgcacactccagcctgggcggcagagtgaaactccatctcaaaaaaaaaaaaaaaagaaaagtaaagaaaaaaaaaaagaaagcgctcttgggatcagcccctgtggacgaagggaaggaaggaaacactgttgggccaagggggatgttgggctgccatgtagtctcaaataaaatctgaccctgtggggtgcttcaaagctgagaggccacctcacccttgtccccagttggagaaaggggaccaaggctttgtcttccacatgtcaaccaatctttggatgtgggcttccctgggaagggagtgtgatactgggtgaagtgaggccatcctgaaagagctgatagttgaaggttgtctgcaggcagcaccacagcagttggggaatcagtccttcagtcctgaaaggagatgtgggtggcatgtcacagtttccattcaatcttttttgcaggggtgctggagatgggaaggaatggcccaggggatgggtcagaattttcaggaataaggagttgcagcatacagtggtcaggagcttgagagatggtagagaacaaaagtggatgtagaataggttctgccaggcaattgacttctgacattgactattgcttttctaaata

SEQ ID NO: 68722 - DNA, 1023 bp, Homo sapiens
atcactaatgaaagtggagtaatcatttctgcttcaaggatgactatatgatttcatttatccctaatatagtacacactacatagtaggcactcggtaaatctttattcattctttcaggaggcaaagcaggaacagattaactaattaccagctcagaccaagttaagaaaaataaagctacagattgtcatttcaaaatttgcctctttttgctgtctcactattttaaggagtgcccactatatcactaatatctctggcaagaaagcattccatgtgtatgtatgtaagtgtgtatcttcattttttgctgtcaccacacagacatcaggctttttcacaaaatctgaccccctcccttgaccattttttataactacctggcatgtatcactacagagcttttgttctggtccttctacttggactttggcagatatttgaactcttctgagccagtgctttcctcttcagggatttgtttttaagattttcttccttgccaaccacagagactgaattttatatcccacagatgagtctgagatttccagccccctccgtaaatcccatcactctgtcactcttgacagtgtaattatcccttttgtttcttgctgctttcctgcttgtaatctttgttcctcaacatgtccttcatctgaaaaaaaaggcacccaatccttcttgctttgtcagctctttaatttctcttgtgaaatagtcctcagatatcagctccccacaaaggctttctggaggagaagtggcattttgcttccttaaatctttctgtctattcaattttcatgagtgactgataactagccatcatattaaagtcttctgatcttatatttaagtatgattttttattagatttatgttttgttcagtgtttatgctgttcagtgtatgcatgtgctatgtgtacacttttaatatgtgtatctatacctgtatttgtaaaacagagaaacctaaaggccaaattctgcatcttatttttgaaccaatcaa

SEQ ID NO: 68723 - DNA, 1060 bp, Homo sapiens
catcatttattaaagcattatgggagaaccatcttgataaaagcatcttagtaaaggaaactagacttatttattttattttattttttttggggatggagtctcgctctgtcgcccaggctggagtgcagtggcacaaccttggctcactgcaacctccacctcccaggttcgagtgattctcctgcctcagcctcctgagtagctgggattacaggcacgcgccaccacgcccggctaatttttgtatttttagtagagacggggtttcaccgtgttggtcaggctggtctcgaactcctgacctcgtgatccgcccacctcggcctcccaaggtgctggaattacaggcgtgagccactgtgcccagccttattctttattttaatgagtcagaattttaaataccttgctttactgtatttacaaaagttgtagcaatgggtcagttgtcttaagttaaatttattagtatctaccaacattaaaggaaatattaaagtgtttcaattatgtttaaaataaaacacaagaatgaggagtgatggacacaagtaaaacaatgaatttgggatgataaaatgagttgttgatttagaaatatatactatatgccaaatggtcagatctacttggggatatagtgagagttaatctacttcgaatcgttgcttctaaagcaaacccagttgtgtaaagtcctacgtataaaggtagatattaaatccacgagggaagtaatcagaaccccaggtgcccaggctttgtaaaaaatttaaacagtaaaaacgtagtcacttgtacttaacttagatttaactaaacaaattcataaaatttcctgagtggaatgatggtttcagagagctagtgagtttcagaccttgaaaaaataccactcactgaactgtagtcattcttaactgtttaacaattgaaatctaagttgtcatatgtttaaattagtacagttctggttatgctgtgtcttttccaactcataactttcagtaatgaaaatagctttctatttaattagcctgaattaaattttcctctc

SEQ ID NO: 68724 - DNA, 1035 bp, Homo sapiens
cagtgagctatgataatgacactgtacttcagcctgggcaatagagcaagaccctgtcacaaaacacaaaaaaacacaaactctttgtctttgtcctattattggcatttttttctatataagtttttaaaaatattgccaattatggattgtttaaatatttaattgatagatacatattcaacatatattttacaacagtaagttacacagatataggttacatttaataacatgcacttttaaaaggtctacaatttaaataacctgattactatgtttatttgtaggctttgagctcaatatacatgcacatctacatagaagaagtacttaaatgtgcctattttacttacagtttataaaacgctagaaaaatattaaaaagattcaaaattaagtagctttgaggcatttaggattagacatggattcaaatcatagttttaatcttagaatgttagctttttcagtacttcctagggttactgtaaggattaagtcaagtagcattaacgtgggatgcgccataagacaatatttgatccttcatgatctctttcctcttcattttttccatctatataattttgaatcttgataaaaaagagggagcaaaaaagtatagggaagaatgaaatatatttcttaagcaaaagcaactatggtttgcatattgtgcttcaaaatgaatatttttcttttatcattttgttacatgcagaatacctttaacttagccttcattggactaaagtagaaacgtaagaattggagcttattttcatttctgaggtgagttcatttgtagaaaaattagtatacttaaatcagtctactgtttctttggaaactttgtcatttgcatgtacctgggaatactacagttatccatgaaatgctgttagtgtgaagtcgtggtgagggttccaggctaggcattcggagctccctgtcaatacctgggctgtgctacagatgcccttcagtgttgtgaccctagttccttgacatctttgtgtcagtttgcttatt

SEQ ID NO: 68725 - DNA, 1911 bp, Homo sapiens
ttgaggaatttattacagagcagtaaataactaatgcacaggttaaacagtattacaagagtactgcataaatgatggtctgcatttcctgttgcatcacattagggggcatgtaatgtcagtgtgacttgttactgatgaggcttgatcacttaagtggtggccacttcatctttttctttttctttttcttttttttttcttcagacggagtctcgctctgttgccaggctggagtgcagtggcgcgatctcaactcactgcaacttctggctcctgggttcaagcgattctcctgcctcagcctcctgagcaactgggattacaggcatgcgccaccacgcctagctaatttttgtattttttagtagagatgaggtttcaccgtgttggccaggatggtctcgatctcctgactttgtgatctgcccacctcagcctcccaaagttctgggattccaggtgtgagccactgtgcctggcccatctcttcatcttaaataaatacctttacctctttgttattaatatgcaatctgaaggaaagtttaattttggatagaatcagcttccaccaagtttcttgtcaagaacatttcactctacaccactgttttgagggtatttaaaatggtaacaattttagaaatcattttattcagtctctccattttgtagcttgatttaataaatatttctaggtttctattacagttactagggacataaaatttatgagatatgatcattatccacttggagcttatggatgaaaactaacatgaatggcatttaaggggtgtagattgggtaatacttaatttgtatttcaagatgattcaactgaaaggtttttattttccaaaagactaaaatgatgttattatgatgactgtagactctagtctcccaaggctggtcaatgctgttttctgaattattttcttatcacacagaattaaaagaaaacacattttaagtgcactcttatgttagacgttctgttagtcctgtagtttaggggtttgactgtatctttttctgaagatagaaatatatgtgttttaaaatatagatctgtcatgttccaaatttcttcctacgtaaataagaaatagtgagctaaatgaatgtctgtgaagtgaaggctgtcaggatactgttgtatgatttttgaaaaaatataaggtacaatgtattaacgaagtatgctagtatctaatatattgtcctaaatagttgttgattgggtaaattctatatagatgaaccatgctttttaatactggttgcatgcttatgaaaaaaagtggatcaaaggtaactatatagagcctttaaagtttttctgccaatatgaaaccatagttttcttattgtgtttgtttatttggttctgatataagaataattaagaaatacatttttcatttgtttttggtttgatactggcaaatttacttatatttttctgtcccaaattctatttgaatttcttggtagaacatataattgaagacaaagaagaaatatgtccatttatttcattgttatctctttctggtagaaccctgttgtctagactactttgctaatgtggtcagactcatgatacttaatttctttgtaggctctacagtttcacctgttacttgctgctagactgaatatttagcaacattttttcctaagtaactggctacaggaaaaactccataaatgattgaataaatcaatcaacagtttagtaagttaagtcagactacaactgttgccaagtaaaatggtgttatatctttatacagagggaagatgtgattagagctgcttcagaattataggaagatataagagtaatcctatctaggtggggaaggagcaatcaaaatacaaatcagttctggaaagtgt

SEQ ID NO: 68726 - DNA, 1041 bp, Homo sapiens
ctttgtaaaaaagtatggggacataaataggggtagaggcattggattatgtatgttctgtgtgtgaaatcattctggaatttgtgattttgatgtctagagtacaacactggctatggtatgggaaggctacataaaaatttcataaacaggatggagaaagaagagtgccatgcagcgtgtgcatatatagccttgggagtttagtttttttctaattttatcatctagatgagagcagcatacttttctttataaatactgtttaaagttgagaatctctgagtcttttccattaaggaacagaggccccttgttgtgaagctggcacagtcactggtgcaggatggtaaattgccttgctgtcaactctcctctgcctcttattttgttgcctcaaacatacattgttggaagactaaggcaatgatcaggctctttctgtgttctctgattagtgtactttctccatttattttggaattgacccacatgtgccatcttttagggttgttgaatattgtattccttatttcattgccttgctttgcatttttatttattttttaccaacttggaaagtttaatgtttgaacccagtcagatatcactattaagcattagcatacacactcattttccctcctatccaggtatgattatagtctgtcttaggaaaaaaaacaacaacaagcaactcctatctattttaaaatataagcctgtatgagtaatactaactgtaatcttttatttaatgttttctttttaaattatgtatttttgctttttgtgggtatataaaaggtgtatatgtttatgggggtacatgagatgttttgatacaggcatgtaacacataataatcacatcatggaaaatgggctatctattcctcaagcatttaccctttgtgttacaaacaatccaattatactattttagctattttaaaaatagctgtaaccactatgcagaatagtacaattaaattattattgactatagtcaccctgttgtgctatcaaatactaggtctta

SEQ ID NO: 68727 - DNA, 1070 bp, Homo sapiens
tctcaaaaaaaaaaaaaaccaaaaaaaaaaaaccacttttctccaaaagtagatatgtgtcaaaaaccaaaatactgttgccttttacaagacttttgtaattcctttaactccctgcagacattttgaaaatcacttctttgtaacactaatttactacagtttacttttctgaagaaatctctctccagtttctgttggccattttttatttagttcttctctacccccaataatttcagtatctcattttcttttaataattaaaacaatttttttttcttactgaaagctactgaagggtacagtttcttgatcctttcttctctctttctgggtgcatctgttattgtttttttcctgtatttatttatttttgccctcagcaagggactatttttcaaactctttaacatctgattgctgtaagatctgttggagtagcatgtaaaagtcaccagttgatatgggtagaaatacaagtatggaattgtgcacccatgacccttggtagtatttatacatgagacttttacttgtagtctacagtttattgtattcaaataacttataaagtgaaggaatcactactaggcatcactttttgggataaaggcttattttgtttcatttaggtacttttttcaggttcttttgttaaagtctgcctggtgtgagttttgatttgcaaactgaaaaagctttaaaatgctaaaaattggctctgctcctttttgtttggatttctctgggaattctaagttggctatgacctcataacttcaagggcttctaaggtcaattataacctgatagatatcattaaacaaggattaatctcagtttatagaaaaattctgactttcaatataaaataattcaatggaaaatgattaatggtcttctgtttttggagagtgatattgtacttgacattgataatgtttagttttaatggttgtagatactacttgtttttttattgaattacttgtattagatcttcattccccagaaagtatgagacctgatgttcttatctcaagatgagagcttaaaggaagaagagg

SEQ ID NO: 68728 - DNA, 3619 bp, Homo sapiens
tcgtttctgacaccctttttcaatcctcagatggctttaatagaaaagtatatttttcataactttgatagctttccaattactattctaactctttctcactgcctggtgagatctcagtcatggagagagaagtctgaataaaagagacattcatagtggttatgacagtgaaggttaagtttaggctgctagggggtttgaaacaaaggagggattgaagccttcatcgcctttaccttatttgggtactaagtaagtgattttggaaatagtaaaatctcattatgaaaagagtgaaatctagtccggaataaatgtgttaacagtgcttaactttaactggaatgcatcttaacaccattcagtttttatactgattagaaaggtccactgtggttttggtcatatattagaacatatgctgttggttttttgttttgttttgtgtgtgtgtgtgtgttttttttcattctgctttgtaagtaccccttatcactgtagggaattttagaatttgaattaaaatatatcttgagttatataatgtaaaaaaaaaatttatataggctactccatggcattgtaaagaatcttaaaatagatataaaagtgacttcatcttacctccaatgtccttcctccatctatatctgttatctctagctattttcatcttttctctctgccaggcagttagtagaatagttgaagaatgattttatcagctctcattggactacaggataaaagacctaaaaatatgggataatttaatccaatggctagcaaatacattttgtgttatgtttatggttttcaaaggcattgataaaatcaaactatcattactgggaaatatgaaattttcaataagattccaaactaatagataaagtgataaaatgattgggaaaacaagtggtggtagaatctgatataaaaatagtttggcggtagcaaaaggggaaacgctaaaattctcaagaacccatcagccatttttactaacactgtgctcttcataagctatatctagggaactttgattatatgctgtaaggaacaatatattatttaagtgtatattgaataagtattcaataaataactgcaaaataaaagacagttctgaatgtggaaattcctattcttgcgagattgagccagacatttctagctaacattgacgttattgggctaacgtgggcatcatttgggttttgggtattaggtgtaacaaatgcttgctgatgcatagaggccaatctaggtctgtgttagttcctgagagtgtgcatgtgaacttgaggggaaggtttttagagtaggtcactcacctaagccagctgtttttttctctcttccaaaagagtaccggattgctcctttgcaggggctgacttgagaacatggcttaacttttaaggctagataaactagttcagccagaagtgtattatttccccccaaaattacatttaaaagcttctagctatgatcatttcagctgcttcttcctccctttctaattattcttgctatttctgttactgatatcaaccataccaatcactggaaaggagaatacttgggcaaaaatttcttttaaaagaaaaattgctggagagaaatatgtacacaaatttatattgaatatataataaaatacatatggaactgccctttgtatgtgaaggtgagttttgtttgttgtagtggtgtcagatctggtttgattcatttcagctttttccagtgttctttcttgtgatacgcatatatgagataggaattttgctaaatcattagcaggcccattggcttaatgtaacccaatctagtttcttgatctaacagtcctggaatatacaactttacctaatagaaaataattttgtttcagttaatgaaatttatctgtcaataaagaaatattaaataagtgcctattaagtgctagtactaaataatgagaatactctaattgacaagatagacaacattcttatccttgtggactgcgtgatgttagacacctaaatgaaaagaagcataaaaacttaacagaagcatcaggttctaggtaagggctcaaaaatctggaaaataaaggctaatcttttttgcttttctcgccctctttccttaatatagattcacattttttcctattcaaatgtaatgatattcacattttgtattgtttttctacatatactggtactgtggatttataaaataagtctatttccaaattacatgtattttacaatgattccacaaaggaacgttggctatttatgagctttggggaaaattacagtatatcagtactccctttgaaagattttaaactattaaggtcaatttaagatcagaccagacaagtgtggtttgtgtcatttttatatacggtattcagtattttttcctgcaagcttttgggagtgaagaagccattattcataaaatgaattcatatgtaacaccttaggctgatcgtaaagtgttaaaccttagagatggggaaaattctattgtcttgaattttgaatgtgggtaactttaagactgccatatgaattgccaagttgcaaaattgtttttgcatttcacttgcaagcaaggaaaatgtggactccttctttagtggggccaagcgcattctaacacacctctcaaattacacaccactgaaatgatactcacaatgggtttggctcatatgtttctagttagctactatgaatgaaagattcataactatctgtttcaaaaaacttccttatttgcactgcagggagcttaattgtttggtagcagggtcaagaattgcttttaaatactaagcatgcatggattgggccattatacactgaactaaaaaaaagatttctgtgcacaaagaaggctttagataaatatttgtcaaatcattgattactttgttggctgtggaagaataaaagtccctgagttttcccaccctgttggtaatttggaccaaatattttggtcactattttttatatatatatatatttatatatttatatgtttaaaatatatatatgtgtgtatatatattttatatgtatgtatgtatatttatatttatatatgtatatatattttatatgtgtacatatatatttatatgtgtatatatatatatatgtatatgtataacaaacctgtaacctttcccttaccttgcctattgagcattgtagaatacaggataacagggaggaagaagtcattcatacttactagacagatggttggcgtccctgtggcaaccttgtgatctaataattttccaagttctgtctacctaactgaagagtaatagctgtttactgtttgcttaaataacactaggcctgtatgcaagttgcagggggggtggggtgaaggaggggggtagatatataaattcatctctgcagttttatcaaatctgtaaaagaggtgtagcatacaggcacctcttttccaaaagaaaaaattcattagttcctcattttggttattccttcttattcgtggctcaagcaaaccattaccagagaatcttttttttttaattgatgacacgctaaaaattagttat

SEQ ID NO: 68729 - DNA, 1043 bp, Homo sapiens
ccttcttttttggggacttggatttcttgaaattaattttgtgagtaacttggtaaattgatgacttattttctgcctgggcatgcaaactctgcatttgatagtttctttcatatatggaagaaatgaaaacactacctttaagtagatttactacctttattccccccataaaggcatgaacagcttgtttatgtttatatgcatgcgtacataatctccaatttctctttgcagtgtgttttcaaaacttcaactgttttatgacaaactatatgtgtttgggagtttacaaatattattctttaatccaggaatgtgaatttttgaaaccctatcttcagattgagttgtccttactgttttagtgtttatctgtattctcagaacctctgttgcgtggtctgttttcaaaaaagtactgtgtaccataaactacagtgtttttgttttgttttttgcacatcaagatccttttagtcgagagaacattaattttgtcagtagttcttttatttagctcctttgtggggccttgttagattctgaataatttaatagcaatggaatcctttctgtgataaaaatctggtcattggtccaatacttgtagcattattcacatgatactcatgcatgcaaaggtgtgggattaatgcgtatgcctgaagagtgtgtgtcagagtgtttttaatcattgttgaaaatcaccctctgaagattttcgtgtgcattaattctcagatttgcttaaagtattatcacttctattttaaaatgaataatccatggtggcctagcctgaacaataatatgtaagaaaaattggaaaaattataacttcctttaaatttaggaataaggtctatattttttgtatatttgtatgtttgctatgtttgcagaattacagaataaattgtttaaagcatatttctttctatgttattttaatttttttacatttcttacccaaactgttgaaacaaaaagtttcagtcccagttagtacaacatccataaactttgtccacatttcacat

SEQ ID NO: 68730 - DNA, 1488 bp, Homo sapiens
gaaattagcacttattatcatatttttacataaatacttaaaagggcatgagttttcctcacataggaagttgagcattactacatttcatttgtttattcattcatcttttatcgagtgtttgttgagtatctgttctgtgccagacaccaggaatacaaagatgagtaagacaggatctctgccttttgttgtcagaaggctcagagaatggaggcagccagacacccgttttagtacagtgtggagctgaaggaagtatatattaaaaaacaaacaaacaatggactttggaatcagaccttatctgccttggttttcttatcaaagaggtggaaatgtcaagtaggtactattatccatggaggatgttaaatgaaaagtgtgtatgcctgtgtgtgtgtgtgtgtgtgtgtgtgtgtgtgtgtgtgtgtgtgtgtgtttatcccagcacatagcagaaaggagagcctcactgtggccgagggagtcagaaaagtctttactggggaaggtgatgtttgagtctcatagaatgaatttttgaggcaaagcgagacgctcatctctctccaggtagaaagatgagcatgtttgacatgtgcggaataggttggcatgatgggagtggtgggaaattctgcacattcccacattcagagcttacgggagtattagaaagaactgaatgagcagttatttttcatttttgtaagtaacaatacaatagagtattcattacattgtagcagaagagaataaagataccaaacctgtttaagaattgcataaatcttctcttctagtcacatggccttctaaatgtagctctttatgtagcaaacaaattcatgtgttctttttcagtcctgtgatactcaagtgattatatggaatttaagaaagagaacttgcatgtttttgggtgaaattggaggtcctgtttcaaaccattcttacatttagtagcatagcaacaaaagaatgtaataatctatgaagccagatctagtcctgtttaagcctgtctaaaattctaagccatagtttctgaacagaacctgaaacatactatttaggaatgtactaaaaaataacttgttaaatgaattatgtgcttgataagagatcagagttctataattgaaaaattgtgtttttaatataaggggagaagaaaaagagaaagaaaaaatagtgagaaaaaagattgatagaaggaagagaagtttgtacttaaatgagggagaaacatttttcaagtcccttattgagggctgttgaattatcttctgttaacaccattagaatattactaagttattccttattatagaaatacatgtatattattgagatatttgttggtttaatgcaacaatagaatgtttccagtatctgaagtggaaaaacaaagctgcaaataaaaatatgtgtaaaatctgtctcttttgagaagacattgattacagtttatctaattttctg

SEQ ID NO: 68731 - DNA, 2411 bp, Homo sapiens
tctttatattgaaaaagcccctcaaagtaactgtgttgtgtattgcctctagtttattttcattgaaaggactccattcttccacagctccttgggttctggaaagtgagcactagtaatggacgtcatgtggtagtgagtctattggaattaaagtcaatgtcatcctgtctcacctagtatagattttttgtttgggatcgcagttttctaaacatattgctgtagttcttaagttgctggtgtggaaaatttttggtcacgaattcacacttttacttacaatttgacagttaaaacagtatagaattgtcacataaagggtaaggtagaatgtatcacaaatgcaatagtgataatataatgcctttattgcagaatacacagattgagactttgtaagattgcaccacaagtcattcactttatagcagaaaaaaaagaaggaaaatataatttgcttttaattctactattctgagataaccgctgtttacaagacttggtgcattctctttgtaatttttttcacttcccaatgtcattgaatattatatagtaatttccagtaagtgtaatttaacttatactgttagtagccccactcttaatagggtgatgtttcttttgtttcctgtcaggaacctaatgtctaattttgaatattttgcttgtttgtgatcaaacttaaagatttattttgtttttatttctagctttttcctgctttcaaggttttatcaatactgattcttttcagataccagttcttttctatgctatggcataggcttgctactctctactttgtgtttattacattccaaatcctagttattttcttacactctgtttcacaccctttaccctactgctttttattcttctctctactcccttcttttacatacctcttttaattctgcagcaggtcacttgaaccaaggtttgtataagaaaacatagtatccagaataggaaatgataggtttttaaaagttgtctctttaaatacttgaagttctattggatgaatattttaacactgatttatgtaatatttatatacaactcagctttcctgagttgtgtgaaacatacttggtagttacacggatcatcacaaaacaacataagttaatgataaggtacaaacttttggacatctgtagaggtatgtcgggggaaaaagtggaattttaattaaagtattctggctatagtaaatccctcctgggaattattaatactacatgaaattgtttgcagctgttagtgattgaaaatatttttgtaagaaaaattctgcattggaatagttgcaaacattttaagttgaatatatgcaagaaagtttaagggtcttcagtgcttcactacaaccttttcagtattttctagatgtattcctaaatgggatttaaaaaaatagaccttatttctcagaagttttggatttacaggaaagctacaaatacggtgtctatatacccccataccagcttcccctcttattaacatcttgtattattggtatttgttactattaatgaaccagtatcagtacattagtattaacaaagtttatactttatttagatttccttagtttttaatgtcctttttctgttccaggaccctaccatccaggacaccactaaatgtatttcctcgtaatgtctccctaggctcctcttggctgtgacagtttgttagacttccttgtttttgatgatgtttgaggagtactggtcaggtattttgtagaatacatttgcattggaattcatctaatgttttttctcatgattagactgtgattataggtttttggtagaaagatcacagaggtaacgtgccattttcatctcatatcaagggtatatactatcagtatgatttgtcactgtgatactcatctttatcacctggctgagatagtgtttatcagatttttccacttttctccacctttttcatgctgtgctcttagaaggaaggaactgtgtatagcctatacttaaggagtagagagttatgcttccccctttgatggtagaaatctatataaattatttggatatttttctccgtgggagatttgtctcttctcccccatgtatttatttactcaatcatatttattttgttctggactcatggatatatatatattatataaatataaaatctatctatctatctaaatattttgggttataatacaatgctactttgttacagcttgactccagtgcctctttgacatactaccatcaatgtgaattttgtttttttggaagcatttccttactttctggtattatgagatgctctaggttcatctgtatacatcttgccacagtcctagaatcagtcatttctccaaggaatctggatcattttgttgg

SEQ ID NO: 68732 - DNA, 1042 bp, Homo sapiens
tgagccaccgtgccaggccttgtctctccaattctaatcagtgcaactttttgcctatatctgcccagatgtttaaggatagtaggaaatttctttaatttcctataccataatatcaaatctaatgtatgtatgtacatgtgtgtatacatgtatggtatgtatatgtgtgggggagtatatatatattcccaaaacagtatctaggttaactgtcaagtgagagtcaaatctatacccctgtttgtcagtcagcatatcatctttccccctgcccaggttttgaaaaaggaaggaaggaaacaaacaaaaaacttcccaacatagcttcaaagaataaatcttacataagtgaggtagtcaaatagataatctattcagtttatgttctttctgctgaaatggccaatttttagaagtggtcaccaatttccaagcatgcaaattgtgttcctcagtttatttctgtgaaaatgtaaattttaaaagattcaaaagaattacagtcagcacctaaggaaatttaaatcagtgaccctcaaaattaacacttaatgtctcactttttaagatttgatattgttttaattttaactcagcctccctgcctaaaatagcagagtgtaacttttaggatcatctgtcatctactacagatagaaaataacaaatcaacatgtcaacattctcatatttccagggtcataaaaatactgctgtttcataaaagacaaaagaaagcaaagggaatgttatttatttccaaataaaaattatacaaactataatattgttttcccaaaaaagcattttcctgagtccaaaactctcacattagctttccaggaagagccccaattctacccagtagcaccctgcccaggctatggatcctttgtggactctatggatatatggacttgctgtaacttacttagcttgatggtctacagaaagaatttaaaaagtgattcactttccctttttgtctaaacatatgcatttactttatggtatcaattttagattaaataaataaaat

SEQ ID NO: 68733 - DNA, 1377 bp, Homo sapiens
agcggtggtgtggtgaggggggagggggcgatattaacatctgagatgagagccaacactggtccggtggagaaaggagtgtgttagggaatccgcagctggagccgagaggacgcttttgtagaaactattacctccaactaagacctctctccttattttatttttattgctatttttgaaggagctggtcagcatttgcctagactctcgggacaacacggtaaatagctttcaaggatttggggaaaggagaaattaggccaggccgtgcaataccttacaaagacgttcgctcttgtctcactggatattcctttgtggtattagcctcatttttcaaatgggaaactgagattcaggctaagatgtctgtccaaaataagactaaaatctagattgttttgacgcagatcagtattcccagccaattacagatgcttttcagagagaatgatctgttcagctcttcagttaatttattactgcacattccttagtgccttcagtgggtggtggtagttaaatagctgaaacaatttttccactttgtcattgaacatcattgtatatttacatttgaatcttagactttaagtaatctgaacttataaattacatgttttaaaaaatattttctagatggtaaacctatgctacgccagggagatacaggagactggattggaacatttttgggtcataaaggtgctgtttggggtgcaacactgaataaggatgccaccaaagcagctacagcagctgcagatttcacagcgtaagtgtagccaagatggctaactttggtgttctctgtagcttgtgtcctgaaataatcaaaaacttcagtgtcagatattcataaaattctgactcactggctgccatacagaacgcatgtttgatcccaccaaaattccatcgtggtccatcgtggtcctgtgtgcttctttgtcttcagtggttctcaaaattttcagaggcctaaatgacttattccgtatattttgattgagactcaggaatctgcattaacaaacgcaccagataatgaatgttgatctcctttacgaatgctgctctgtgtgtactccttagtgatatcctacattgatggccctaggtttttatttcaatcccggtttttgttaactggctttaggcatcattaaaactcattgtgtcaaaaacaaacaaacaaaaaaacaacaaaaaaacaaaactcagctgctcgtcatttcctaagtttttaaaggttgaaatctaaagcattcttgattttcccttatatctagattatcatcatcttttttgattctgccagcgggatgtctcctgactccaatgttccttcatgtagtaactgtggctgcctta

SEQ ID NO: 68734 - DNA, 1025 bp, Homo sapiens
aacagtgtgatcttgattctactatttattttcaccttaaagttttagagaaggaataatcttatttctgttcctgagtatttgcagacttaatgaattttttaaacagatttgaattttgcgactttaaatgtagtaaatactcttggagaaagactggaatatataacataattgaaaaaaatgtacccacaatattatacccataggtgcaagagtgataatggtagttatattttctgctagtccatttttctatgttatatatgtgggtgtacagtatttgtgtttttttttttaattactaggaccataatgaataccattttgatttgtttaaaaatattgttagccatttaaaacttctttgaaaacatttttacttgatacactgtatttgcatcataggttgtactaaattatgggttagtttccctgttttagcaccacggtgaatgttctagcacatctctgagtgtttctttacagtagataggatcctgtaagtagaattatcagttcaaaggctagaaatgagtttaaagttcttagttatacatgacacttaattgatttccataaggattataccacattacactttgatatttgaccagtgtcttaaccttgtgtctaaagggctaactgggagaaagaaaaggcggtaaaattggaggagagcaattaagcaatgtcaaggagtttatacacatacagtaaactgatagtagtagaatactatggcctggagccatcaattggtttattaatgctcttcactcactcctgcagttaggcaaatcccatgttggtggcagaaattttctggaccattgaatattctagcatttgagccagcaagttgctatgtagtgatcctgcataagtcatgactaactttaattaacatgctttaaagtatatgatgatgggaagtatttaggagctgggatactataatgttttgtattggaggcctttcatgatttttagggttaaactgaaaaagctaatgtccaaactgt

SEQ ID NO: 68735 - DNA, 1048 bp, Homo sapiens
ttcagcaattaataataatatataaataatcctttatgttaattacctactgtgaaaactttttctgtttacaaagataatatgtggttgtagaaaaatgaaacaatacaggtgaagtttatttaagagcaaaaatcccagtgtattattcatactgttttaattagccaacacactcatttccgggaagacatccactgcataaactggatatccctccatcaagatgtctttgtattgctgagatgagctccacttgggcatagtatccatttgatttttttttttttttttttgctaacagctttttttacatcagtgtttatgtttgagtaaatgagtatttaattgttccttgggtttcagaatttaagaacagttcaaatgtaactcgttatttataccatattcaagatttgtaaatactacttaaattttttttcagtttggacccaattaaatcctttgaagctcctgcaaccatcaattctgcatctcttcatcctgagaaagaatttcttgttgcaggcggtgaagattttaaactttataagtatgattataatagtggagaagaattaggtgagttgtccccttacagtgatgtggttacctttatcatatgttaagtcccagtaattaacacctcatttatatatatatatatgttacatatatatgttgaaagtaaatttttcagctaacttaagcttggtgcttacaagtgaaaaagtaaaggagttttaaccatttgggtcagatgcttttatagatctgtaaacaaagtatgcagaaatttatccttttaactaaagttcatcattatgctgatgttatgtattatggtacagtgagttttaggctttattggctgggagggaggggggaatcttatgtcaaagtcatatgctaaacacatgcaaggagatccgttctttctgaactatgttgtgggtgtataaccccatctacttggcccgtcttcctttttgccaacttaggaattcctaagactccgtaaagaacagtgtgtgggggaaaaatcagt

SEQ ID NO: 68736 - DNA, 1484 bp, Homo sapiens
tagaatgtttttggtttcatattttattctttttcaagattgagagaactgaattatttgcccaagatctgaagtcacagtgaataccagatctgcctagcctttctctttccaaaaccttgtgttctttgtactcttacaacttttctattctctggtgggacacagatgggagacagaataggaacattggtctagtaaagggctttgagaactaataaggtgatgaggcattagaaagtaaatgagaaaggttcatacttaaaggtactacttgaatataacagtgctcctaatctatacattttctcattaggttccatggattaaaatatttatggatcattgttgatctatatctcacctttctgtgtgacagaataattagtggactgtaggaaattaagaggcaaagtgtgtaaaagagctccacctggtggctctctatagtcataataaaaattgattccctgagaaataggcagtgagttttaggatatggaaattggaggttgaactggtaagactttaaatctactttctatagaattaatggggttttcatttacctctttttctccatccttaatgagacatgaagcctcatttgctttttttagagggacagtttgaaactagaatgtgtgctagatttggaaaggaataatcttacagagaaagggtcaatgatataccacttttgtgatgagaaattaattaagtacaggttttaatgtttgccttaagaattttccatctccccagtaacacagacagtattttttttttttagcatatcaatatttaacctaatagttaaaattatctaatagccctcttctttttcagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctggtaagaatttttattcagaataataaaatttttaaaatgcatgattttatgtcatttttaatcattaattttatttcagggttcctgttttctataaattttaaattatatattatggtttaagcagcgagaagcccaggattataaattggccagagaaagggtcatgttcctttgtttaaattttttttggtatggctgggcacggtggctcacgcctgtaatcccagcactttgggaggctgaggcgggcggatcacagggtcaggagttcgagaccagcctggccaacatggtgaaaccccatctctactaaaaatacaaaaattagccaggtgtggtggtacatgcctgtaatcccagctactcaggaggctgaggcacgagaattgcatgaacccaggagccatgcattgagctgagatcacgccactgcactccagcctgggcaagagtgactcagtctcaaaaaaaaaaaaaagaaa

SEQ ID NO: 68737 - DNA, 1030 bp, Homo sapiens
tctggaacgtggtctttagtaataacggcattatttcttagattggaatatccttgaaggtggtggatatggggcaggtttggggtggtgtcttacctgggtattcccaggaatatgaccatgtgactatgcatacatcaaggatgtgccctaaatttcccaaaacttagacattttaaatttttctttcaaaaaacataattgaaccatttttaaatttatttatttgcagtaattagaatcaatcacttccattcatttgttgaaaagtaatagacataaataattgccaggtagaacaatagtaaatgtggtttttatgcagctatcgaaatgatcatagctttgtatttattatcttatttgttaaaatcagatttttttccttcacgggtattaatccttaatccaaacaggtttaaactgaaatgctaaaataagttatttgaattaggtactagggaaaaaaatctttcagtattaatttatgcagtatattaactgatgatttttaaaatagttttctaattgaaagtctttttaataaacatcgtaactaatttctaaaataaattaacatttttgcttcccttttcttattacaaaaggaattcatggttattgtaaaaattctagaaaatacagttagcacaaaaatgttgtaatattattactagtccaatcactgttatttatgatttggtgtatgtacttctagttcatggacttaaaaaaacattgagttcctttgagactaaacctgaccctcatgattaaaaagtctttaaggaaaacattggcatttggatgtatgaaagatgttttccaaatagggaatgtaccctctagctttcatattagaggatggggcccagcattctgagttttaacaaatcctgtgggtagtactgaagcatacccaagtttgagaaccaatggcttaatgatctccaaggtactatcaagttttgtacctagactattatgccctatatagtctattaaaatgtacagatattcttctatttta

SEQ ID NO: 68738 - DNA, 1050 bp, Homo sapiens
ttctcagtctttagttgaagaaaataattgagttagtgagtaacagccaaataattctatccagaaatatttgaatgatgttagccaggtaagaattctaaagactgaaaatagagttgtctataaaattctattaaaattatatatgtggttgggttaggtggcttatgcctgtaatcctaactctttgggatgctgcagtgggaggatcgcttgagcccaggagtttgagattagcctgggcaatatagcagactccaacaaaaagtttcaaaattagctgggtgtggtggtatgccgctatggtcacagctaccttggaaactgaggcgggacaaggttacagtgatgatcatactgctgtactgtagcctgggtgacagagcaataccctgtttctaaaattaaaatgtatatatataaaagttaaataattgaactcagtaaatatatttttcactgtagagattacaaatacaatattctagaaataacttgggtttttgaattatagagatctgtgtttccatcttagccctgacaagtatggtgtgaccttgaacaagtaatttaatatctgagcttcagctgtttccttatctgtaaaatggacctaatggctacctggtagagttagtgagactattaagtgagatatataattaaattacctttaacttgatgagtgatcaataaatggtagccattattgtaattccaatcgatcctatattgtgaaaatacttggctttcaccatttcacctcctccctgaaggcttacttggtctcctctgctagacttttcaacactgatctgctaagatactttgccttcttttatggtacctaccaatttcagccttgtgtttttatgttctaatgctgccttattaataggctgcttgagggtaggatctgtgcttatcgggcgtctgtatcacttatgtcaccttgaacagtacttttcataatgtgaagacttgttttcatcagtgtttgttgaatgaataaggaagcattgctccccttgtctgggaagttagaatggc

SEQ ID NO: 68739 - DNA, 1048 bp, Homo sapiens
aagataaatcaagggtaaatgagtaaatcaagatagctaacttgatcaagatttggacccagaactagtgtgctagataactagtgttcattaagatagggctaccactactattttatggctatcactgtgaagataaaacatctttgctggttacttaatccaccttcatgagcatctctgcagcatcttaatttcaggtcttccagaaaatgatatttgtcctaacactaatatgagagaacattcaatttcttcacacttatgcataagtgatgttcttaagtgtcagtgcattggtctttaaatgctgatgtttgggggtttggaattctttgatgaactactactgaccaattgaaatttgttttcccctcccccccttgcttactttctttcttccctccttccctctttcttcatttcctttcttaactctattagtggccgctggatttccagctggacagactcatttgaagacacgattagaagagatcagattggctgtggaagatggagctacagaaatcgacgtggtaattaacagaagcttggtgctgacaggccagtgggaaggtaggtgcatgcttttacctaagagagtttcaccattcttccctggtgaatcagatgatgaggtaagatgtggtatgttttagaggtcactgttctaggtgacaagttagtagatcaaatggtgagtttaggagaaagcaggctaagattacccatccttgtgcccctcataaatctaggcagttgcctacctacatgaacttttcagatccttttgagtgcttaggtgaatagttacttccatgcaatagattcataacttttaaaacaattttattttaccaacatgctttttcttcagaagggaaaagttactactattctatactgttttgttactcaatacatacttcactccaggcaagtcttttatgcaaagtttatttgaatatattggaggaaacttcccttttttatgttaatttttgcagtctttaaaggtatgggattattaagttgactaagttta

SEQ ID NO: 68740 - DNA, 1114 bp, Homo sapiens
tctgaaatggcctgagcaagagagtgagaccctgtctcaaacaaacaaacaaacaaacaaaaactattaaaaagtgttttcatttccctgactttcttaacaatttttattaaatacaatttaattttttcttgattattccaaactgtttcattactgattatattatcccagaatacagtgatgctttcaggggccagtggaatctctgagatgattggcctcatagctcacagtccagactcttgtgctttttgatttatgtatcttcttatttgttactgtttttttgcctactccttagtggttaagctttttactgtcagatcatgttgagctcgtgacggcacactgtccttccctgccaatccttctgtcactcctgtctagctggacatggaaacgtggataactacatttctcacttaccaccatagttttaaccctatagggtgtggcatgtattgtaggctctcaaaattacaatacctgacaaacattttcaaatgatttgccccagctgctttcctgacaggattagcatatccccctgggcatttgtgataaaagaattgaggtgtgtatgtgagggaggaataggcttctaaatggggaaaatccctccaggtgattttgttctccttccccaccagtcccatgtccttattaagaagtactaactcaggactctttcttcttcttcttttttttttttttgacataattccagttcttagttgcatatactttaggtgccagataatggaaacattgttgaatttacatacaacaatgtacgtaaattcatacattgaatacatttatatattgtatgttttattgtattactaatactaatcagttgattaattagtacatcttgtatttcctgtatgtttctatgccgttagcctggatctgtagttagttgtaaacaggagagtttgatgaataaagtgttattctggtgaatttagctaagaagtgcatctgcttcctgtgctcttgagaaaagaagactttcctctccctgggatggctgtgctctctgataaagatagcatccaagtggggacatcacccggccaggcagccaggccacccagtcattgct

SEQ ID NO: 68741 - DNA, 1112 bp, Homo sapiens
ctctgaatttaagcttttcatttatctcagagatatatatccatactatctgagacagcctctgcttttgtttgtgttaatgttttaaaatttagtgcagtatcattgatttttatactttcaaatataagttgacttattctttatctctgtgaacagcaggtctatccatttagacatccaagcttgcagcctaggagtcatgcttggttctttctttttctcacctcacataaatcagtgaagaagccttgagagttctctctagacctctttgctgtgtctgacacatcttccctccattctaagtgctgctgtcttaggccaccatcctcctccacagggattacttcagctgttcccctgtcttcctgacttttgttcccctccaatctgttctccacactgtcaccacaatttttttttaatgctaattttattatggtactgcttgcttaaaattccttcagtggtttcccttcatctttatggtaaagtgtacattccttgattcttattttaaaaaggtccttcctaagaccctggctgtgcctctgctgtgtcattttcccttcacaccatgttctccagccaggtagagttacttgcacttctctgcagatggtgccatccaaccttttgagtctttgtacgttctgtgcctcctgcccggaatgccttttgcccaaataactccacatcttggggttcagcacaggtaccacctttttcaggaattatttcccctgacactgcttctccccctgctgtttggcccattatctcctctgtgtgtccccacggcattcaagtaaaagccctatcatataacttatcacatgacattgtgattgagtgttgaatttctaggtgtccttctaggggccctatatttggatgaagatacctggtttctctggtcttgaatctgggccagccatattcttgtgtacttcttgagtgctctgtcaggcctagtagatcattccttggaactctactgaaaatcagcctactagtcagcaatggtgctgttgctctgggcacaactgctgtatctagaaaatatctgcagttgttatctgagagcaaaatctcagaaaaacctaagg

SEQ ID NO: 68742 - DNA, 1017 bp, Homo sapiens
agatgtggcttgttggatgcagctgcccctgggagcacagggctcctgccctaccaacatggtagagggtggagctcccacctgttcccagacctcaccagctccacggagtgtgcagccctagccacgcctcccccgctgcaactggcatccccacggtggctgctccagacaggccactgctgccatcactttgatccttattttctatttcaaattggcttttaagcctatccagtgaaatgtatgctgctgtacatttttagtttagaatttccatttgattcttttttataatttttatttctctactgacatgtccccactttttcactggttgagatcatattttcctttaagtacttgagtatatttgtaatagctgatttaaagccttatgtgctaatttgtacagctgggttatttcaagggtctgtattttgagcttttaattttttagtgcctgagttttattgttatttatagcaggagggcgagtctggtgacattctgttatgtctgttattcttctctgtttttgttttcccattaatttagaatcagaatctcaaagggaaaccatttgtcattacattcataacaatttattttataatttttgtagccatttagattatggtcaaaaagaaattctttggagaccaggtagagatatctaactatgttagtctggtcttacacatcattgtaagtaaaattgtgttaaacaactttggtcaactaaatgttagtagtctaaactgtaaggattattggtttaatcttgtttagaaatctttcaaaatgttttagagcaaggaacacagtcagaagaccagaactcttgttctgtcttgcatattttgtgaccttgaacaaataaattaatctggttatcaattcaaatgcagcaaggtatgtgagtgcatcataaactgtaaataaagtactttgcaagttattgaaaaatattagtataccttccttctccatcctacgtcaataagaaaggaaaca

SEQ ID NO: 68743 - DNA, 1041 bp, Homo sapiens
agatgctttgtagaagcagagcagtgatcagattttcattttagggacataacctttgggcaatgtgtttaggctggagacaggaaggccattaggaagctgtgataacacttcagctgaccatcacgagctcctgaactgagatgcaatgcaggcaatgcagtgggtatggagcagagtagatgcctgtgggacatatcggggggcaaatttgattgtgcttggtgagtgattgcatgctgagcagggaagggaagggcagatccaactcctaatggtgccatttgtcaggatagggaatttaagaggacgaagtctttttcccagcccaggaaccagcgcctctgtttccatttataagacctgcacccgttcattctattattggtttattgcagaacatagcgcagtctaaccgcttttcctctacttttctgttcttgcaacaaggaaaaacatagtaacgtttttaaggaaatctgatgaaggctatgaaggtgaaagaaaggctattttttggtttagaaaacattagcaagataacacatgtaaatcaaaatgcagaactaatacatttgttttagtgattcaggaggaaaaggaaattcatgcttttacttgaattatcaggatgatgctttgctttaccagtgacccaagaatgagtgttatagtatgctttttgtaaaaaatttatcaccaactggggcattgaaagtaagtttcctatgttacgcggctgctaaattggccagggacaacggaggaggaactgaatagtcaatgaaattggaaagaatttagatcatccatgtcacacaaagccagcaaaggctgtttgtagaacgttagctgctatcacactggcttgatattaacattctagtgaataattaaaatattcctgtttattttttaataaaaagaaaaagcatatatgttacctcagagtctgtaatgatacctatagttgcatccatcagatgttgagtttttttttactaggattgtagagtagataacttagacaattaaaaagca

SEQ ID NO: 68744 - DNA, 1013 bp, Homo sapiens
agatgggaggattacttgagtccaggacaggagttcgaggctgcagtgagctatgattgcaccactggtctctagcctgggtaacagagagaaaaaaaattaaaaagcttattctgaagaccagctcgcttcaaccgagtgaatgaagaaagcttttatgtttggaactattttctgctaaaactgatttctgagttgtgttctgttagacaatatctcaatcaaaacttctttgacaaaaacatctcatggtcatgcaagtttggggaatgctgcatgaatatacccctgcaagccattcacagtgcacaggcatttagaaaagaccctgcaagtttacaaaaagaaaaaacttctatatttttggataaattcatcataccaaacttattttaagtatggctaagttcttctcgtgtatcatttttaatattgaaccaaagaatagagcaagtgaatagttattaggttaagtcctgtagacatagaagattatgctctgtgggaatataaatttttaagcagacaagattactatgaacacataactgtaagagcataagcatgcaggtataagtggtcaattttagaaaaccttccttacaatctctttaaacatcaccccctccccattcctgtggccattgtctgaaattctgctgttcggtccttacactttcatttaagcctattaaaagttaagtctatttaaaggatgtaacacgttcagcaaatgtgtggccttacttgtggaaaaccagctaatagatgatgagaactagatgtggactttgtgaaaatattcaataaaaacaaaatccattgagctgagactgtaggtgacaatcccttccttaccctctcccctcttgctcccaatgaaaagaagtcaggacatttgtccaacccaaatcagaaacccaaaaccagaaaccaagaaaagaggaagtttttctttaggctgaaaattgcgttgccagtgagatttttttgtattaatgctctgactaaag

SEQ ID NO: 68745 - DNA, 1031 bp, Homo sapiens
ttgtatggttgtcaatcagaatgaactagaatctaagatgcttttgggtgagtagcagaagagaacaatggaatattggattaaattcagcccctggagagtggaaatcctagggttttattcttttagcaggttttgtgatgaaaatgtcaccatcaaaccagtcttaactgttcatcctatatacaatactttttagatctttatactttaaatttttcatcatctttagtttccatgtattaaatacaaaaaattgggccaagtcaacccagaaaacctcttctcaagagtaaatttatgatatttgtgacaaacaaccaaataaacagatctccagcatatgttgacactgttcactgtctctaacccagtttcccaaatgcctttttactttgtaggttatcattgtgaatctcattttccattttggtaataaatttaacagctgaatttttttctcactaaggttttatatttttaagttatccatgtattcattttggattttgacatttaataaccttcctgaaatacatgggagaaattatatctacaatgtagaagactctaacatgtactctaaggggaggaaataaatgccacactcaaagcaattatacaggaagtattaaagatattaaatatgtatcaaaaatttaaaatgcaggtttaaaagaaagtaggtaaaaaccctaactttggcagtatacatgttaagaaactatttatattgttttctgctgagcagaaatctaaaaacaaatggcctttaaatcagacctattagttttgtaataggaagttctgtgagagacagataaaacctctgtattaagtgtgcagtataacctattcatctgaaatatacatgattactgtatggttgtgtgttatttccatttaagagttttagtaaaggaagccaagcccttctgctgtgagggaaatatagcatgtgagcatatatattcgtgggcaaggcagtgccttgaaaacaagtgtgtggcatccagggagatcctagatga

SEQ ID NO: 68746 - DNA, 1050 bp, Homo sapiens
cgagttgtttagacaagagagaatagtcaagtgctgtcacaggggatcttcttattctattctacctctaggcagaattaagccttttttctcaataaattttaaaccaacattttaaagatattggtgtaaaatggtgtcaaattgttaacctacagagtgattacatgttttggtgtctcattgaagctctgtaaaaatgctgttgaacagatatatttaatttaaaaatttttaataaccacattaattaaatgaagagaaacaggtgaaacagtaattatattttatttaataaatctgcaatatatcattttaatgtgtagtgaatataaaaattattgagatttattacattgtatttttttgtattagttcctcaaatccccgtacttcagtttaaactagccacatttcaagtgctcagtagctacatatggtgtgtaactatcatattggactatgacgtgcagccctagacaaatcagtagagtcagtgactcccagttggcatcattgagctggtcctaaaaggtcctttaaccagaattctctctttggccagtgtgaaatttccagtgttgataccagtctttaaaaatcattttaaagaaccataattatgaatgtgttgaagtatttttcttcagtagtaatgcttagtttaatgtgtgactgcacatgctgttcatttgtgatatggttatgctttgtatccccacccaaatgtcatcttgaattgtaatccccataatccccacatgttaaaggtgagaccaggtggaggtaattgaatcatgagggcagtttcccccatgttgttcttaccataatgagtgagttcttaggagatctgatggttttataaggagttctcctacctttgctcggcacttcttgctgctgccttgtgaagaaggtgcctcactaccccttcaccttctgccatgattgtaagtttcctgaggcctccccagccatgctgaactgtgagtcagttaaacttctttcctttataaattacctagtctcaggcagttcttcatagca

SEQ ID NO: 68747 - DNA, 1033 bp, Homo sapiens
tagttacagccacaataactgtctttatatggagaagttgtgaatgaattacctttattaagataaatgtttaatttacctttcattataaaagaacacactgatggagaaaaattgtgatgaacagaaagtgagttgtgagtgtgggagtgagtatgtgtgatcaagatgtaaactcactttatgtccttttgttaaccgaagacaattttgtcactgacaagagattcctaaatgggttctttaacgaactaattctgctgcaacacagaggctttctcacaaggtgttggccagtgaaaacaggttaatgcagaaattaaacttccttgaggaatggaaagaattgcagagtaacatttattgaatgataagctgtggtggtgatatgaaaggtatgcaatataatgggaaacaatcttttcctgtcattattgaaggacacacataaattggtttttctgttgggaaacccccggtccagaaaaacttattacttttaataatatgaggtgaagagaaaattctcgaggagatgaacttattaaacaaaataatgaaatgctgtgaaacagcagggaaaaggtagctagacgttatatagctcttgaattaaatatcaatttttgcgttttatggaagttggatgtgctctttggaagactgttaagctgaggagggtgtatactagtttttgtcagcttttcgaaaaatgatacatattttttgaaacatatgaagttaaaaggaaaaatgcgtatgagttgcttttttaaaaatgagtttggattttccttttcatctcaagttacttgtttagctgcaaattatctcaaaggatttttttttttacatgattggagagcaaggttgtgtgtgtgtgtgtgtgtgtgtgtgtgtgtgtgtgtgtgtgtttaatgacactttcccttcctgagaggcatcttttaaatccagtctcttgatttgtgccaaatagaaacccaaaaaagacctttaatcctttgtccattggatgtgatgactttatatg

SEQ ID NO: 68748 - DNA, 1023 bp, Homo sapiens
tcccagccctgtgcatcggttctcttcaacatctttatctctaatataatgttcatatcatattaagaaaaaatagaaaacaaatgagattaattttgcagtttgtgtttttctctgccatcaattattaaatagtggcacatgcttaaatattttttaaatgcagatttcaagtttcaagggatggggaagctatttcaaagagcataataattgcaggaaggaatacatgaatgtgtacttcttattcctaggaatgcaattcagcttctcaaatttcattatacagtattcttcaacccaaagttttatctgatttagaaaaagaaaagaggtacacatgttctgacagagtacaagacacctttcccatcccttactcttttatgcttcttgcctgttctctaaaacctttggcaggtaaacatattactttcagatgagccaatcgcttggaaatgttaatacacttgagggaaggtatgtcaacatcactgtgaaaaagataccagtgaaccatactaatagtcaatgacttagaattatgcctttccccatatttgcttccttttcactatttttattcactggtttttgttcaagttcttatttatgcttctctttttacaactttgcattgttaataaaaattcagttttaactatagatgccttcttctcctcttgtgtttgatttattgctccaaatgggccaacctggatgtctatatttcttccactaaaatgcaaataacttactaggtagaatatccccatgttatttcttggtttgtttgttttcttttttttgaggcagggtcttgctctgtcacccagactagattgtagtggtgcaatcacagctcactgcagcctcaacctctcgggctcaggtgatcctccaacctcaacctcctgagtagctaggaccacaggcatgcatgtggcccactaccatgcaaaattttttttaaaaaaatttgtagatatgggtactccctatgttgcccaggctgatcttgaa

SEQ ID NO: 68749 - DNA, 1041 bp, Homo sapiens
gctcacaaaaccaaaaatatttactctctggtgttttacagaaagttttctgattcttgctccagtaggttagcctgactgtgctatcacagcataggagcaagacaggaaatggaactgcataaatctcctttcaagagtctgcaatcattacatccaccaacatgcccttggccagagaaagtcacagggctggcctcagaactaaagtgctgggaaatggactcaaccccctcagggagatgaaccgcaaagtcacatggcacaggggcatggatgcacagagggatgaagatttaggccacttatacagtcaatctattgcacttgtccgctttgttatgctagtatgagtttcaattcagacacatgtaaaagcattttataaactttatgacattatgcaattaaaacagcatttattctaatgtgtcataattttatcagattagtggtaatctgtgatatgctcagtatgagagcaatagttacaaactaagtaaaaaacacaatacagggtttgtgaacttggccttctccctctcatttgcaatgtgctgccttaggaagacagatgggacaaggaacaaatatttggacagccttatcgcctctataactaagttggttcccaaactgtgcccagtctgttctcttgaaattataatatgcaccctgctcccaaccaagtgtttcatcaaatttaatcagtttctgattattcacatattaaatgtagaccagagaatattgctggcccaaatgtaaaatttttgtgttagtgtttgctgaaataattgtatattatcttctatgggttgtatattaatcatgaaaataaagctgtgctaagttcttgtttgagctacccaatttataacttgatagtgaaaggaatataatttcctttgtaactcatctttcatgacaatacagttagagtctggatcctagaattgattctaataatagttttgccactgatacacatgagaaacccaggcaagtcacctacttatgctctattcatttcttcacatt

SEQ ID NO: 68750 - DNA, 1044 bp, Homo sapiens
actgtagtctcaaagtcctgggctcatgcgattctcccacctcagcttcctgagtagctgggactataggcacacacacctggctaatttttttttttttttttttttgtagatacagggttcctttcattatgttgcctaggctggacttgaactcctggagtcaagccattctcctacttctacctcccaaagtgctgggattacagacatgagccactgcttccagcctatttatttatctttaagagaccagtgtctctgtcactcaggcttgaatgcagtggtgcaatcatagctcactatagcctcaaactcctggacaccttctgcctcagcctcccaagtagctgtgctactacccaacagtcccatgttttaaaatatagtttggaactgactggtttcttcatcgtttatgttaaggtatgaatgacttacaatcttccttcaaatgccaaaaagagattgtttaatgaataaaaagaacatccaggtagtaaagttttaggcaggggaagatgtttttggatagagggaacaattagcttgtgggtaaaattcaaatgcctagccacctgtgttctgtttaggttcaagaaccttgcaatgtagttctcttacttggcctctccttacaactaaccttggaaatatactaccgagtgtatgttttagattgtctctcttgcccctccttcaggtcccctgtcagttctgtttctttgttcttctgggagttgggccattgctccgttgacattgatgactgtccctagcttacatatccatggatccttttcctagatccacaccagtaaaagtcatctccagtcctagccatgtcccaatttgggtagatggacccagaccaagaagattttttgaatattcaccatgatgacctgtctcaccccatgatctaatattaatttaatataaacaccacattaaatagggttgtgtataggttgttgtccatagcactatagtaagtttgctgttctgggaagcccagaaatattctgttggcttcccctctct

SEQ ID NO: 68751 - DNA, 2537 bp, Homo sapiens
agtaaattataattacctgtatggttctttaatcttttagaaagatacttagataaaacgtcaagggcttttttataagtattaggaatgcttgcttttggatgtagaaatagagaaagcagaagatacaggaatggaatagtttcatggtatggtctttctgtgaatatttttgggtgaaatcttttctttggagattatactatacattattagatggcctaaaaaaatacttgagtgaaatgcagtcatcaaatgtttttctattggttatttccatcctaaattaaagtgagttgatattgccacgaaaagggatacttcttttcttgtcaagctagtagtatggtatatgtgaagaaaaacagttttttcatttcaggtcatttattcaatgtaattttgactactgtacattaagcctagctcatcttataaaaacagaggtaacatttcaattttcaataacattttaatttctttgcgtgcattcttggatgaatgtttatttgatagtacaaaatcttattctgtgtgggctgagtatgtatgttttaatttagaactaagctgttaggaagacattgagtgagtttcttttgttttacgagccattttgattaggttttcttttatgtttacttaaacaaattagaattttatttgagtgccatgtctaatgcctaagtaggtttctctggaaaattaagacaatattaagaaagctataataattttactttaaagacatttttaaacttgtaggttttaatcattttggtattcatagccagtaattgtgtccaaaagtagcaataaataacttataatattatggaagtaatttctcctaaaattgagcatagtgttgcatatcactcattaaacttttaaaaaaactaaccattgataaatatatgatgtactgaatgttaggtgctactgctttatcttctgggtaatgtcagaagactaatttcttttaaggttagttaaatccctaatgtgcactgtaatttcctagaaactttttacttgtttgtattgttatttatcattctaataggataggggcactacttttatcttaaactttacaatttagagtaccttcacatacattattcattcatgaagtagtcagagttactactcccattgtcacacacataataaaacagcagaaacatgcctttggaacttacagtttgcaaagacagcaggatgagaaaccccaggaacataaactatatttagaatattcagagtggaggaaaagataggagtctgaagtaggaaagtgattcgtgttggtggctatagtttttcattgtcatttctttctcagatgaagaaaggtggttattgatcaaattgtatgtaaaggaggttacagggttatcggggtggattttgttcacatgggaagtggaaagataggaatgccaataaaagacatgtcagccctttgactattcctaatcctgtgttctggaaagttctcactgcaagaagggagacctaaagaatttcagttgtttctgcttccattgtgaagtgaaatatatataactcttaaattattcctctcctggacaaatgttggttggtgttaaaaatggcaggttaccagaaagaatttatctcttaattatattttggtattgacacttgcatctctgtaggtggtaagaggagaggattgtagtggggaagtcataggaactgaaatgtggtcttgaccttaatgactttggagctcagtcttcacgtctttaaattaggttacctggaaaaggcaacctctaaattccatttctaaatttctttgaattttgtactgttctgggatttataatattctggaaaacaaggaactcacaatgccaagcagagatgatgcgggaaatatggaaagctagcttttctatccttcttaactattttatcctccctctttaagctttggatagacaatcacagataagtatgatgtatgtagtgccagggttgtgtgtactttcttttgctgctttttgtgcttacgtttccttgtaaaatgtttgtatacatatcttcatgtaaacagatagtactgctaatgtaaacaaaggacctgatcagcgtaagagttgtataggtttgagttaatcagtttattttatacactttgaaattggttctttaatacaagtttgcagctagattaaaaaaatatgtaatatagagaatgtattttccttcacatccatttggccaaaaaacagtaaaatatgaaaaatcttactttgtttttttttttttttttgaggggggtttcactgtgtcacccaggctggagtgcagtggctctatcacaacacactgcagccttgacctcctgggcttaagcgatcctcccacctcagccttacgagtagctgggaccacaagtgtgtaccaccatgcctggctaatttgattgattgattgattgagagagacagggtcttcctatgttgcccagcctgatcttgaactcctaggctcacgcaatc

SEQ ID NO: 68752 - DNA, 1052 bp, Homo sapiens
tcgatgacctggagacagggccttacataggacctgtctgtcctatacaggatggaatttctttgaatttgttagcagatgctcttttcttgtgactgtttcatttttttaaataacagataaatataagatgaaattaagggtgaaaagttatgtgtatatgtgtatgtgtaagttagagttaatggtgtaaaaaaatggcacggcatggtggctcatgcctgtaatcctagcaccttgggaggctgaggcaggcggatcacttgaagtcaggagtttgagaccaacctggctaacatggtaaaaccctgtctctactaaaaatacaaaaattagccgggtgtggtggcgggctcctgtagtcccagctactcgggaggctgaggcaggagaatcgcttgaacccaggagggagaggttgcagtgggccgagatcacgccactgcactccagcctgggtgacagagtaagactctgtctcaaaaaaaaaaaaaaaagaagatgctagtttgagtcataagaattcagaggaggaagaggcagcctaggctgggctgccctggaacgacttgaagaggtgggagttgagctaggcctgagggtatagatgggattcactttcagatgagttgataagactgggaggatacattcatggggctgggaacacgtataatatgtgaatatgtgtgatgagtaatactaactaggcttgttagtgatggttctgtagaaaatgctaggatgatgggaggtgagtctaggaatgctgtttggaaccatactgtgtccggtctttgaatgtcaggctgaggtttttattttccgggcaagcctttgcagatgttttttagtatagcgttaattatgcaacatgaaggttttagggagatttcaatacaggcagcatggattggacaggagcaaagtgggaatcaaggagaccatttctgagtctgttgccataattgggtagttacttgaactaagtttgtggcagcgggaatggaaaggaaaggccattgatcaaagatgttaaagacgagctgaca

SEQ ID NO: 68753 - DNA, 1396 bp, Homo sapiens
ttcttcaaggctcttcctcacctgctttccacccctcccccccaacagaaagcttctctttaaccagaaaaaatggttacgtgcagccccaaattacacccgtttagctttttaacctaaaatgtaagttttcttctctagttgcaaattaaaaaaatctcggacaaggacttttgactaccttggatcacatgcctgttcctagagcagacattggcctgctagtcttcagtcattgtctgtccttagctagagccaaggcactaacattggcaagccatccagaaacatacagttagagaggaaggcccagttcatcattggaagtcaagatgtgaaagactagagatcagaggtcttcttataatatagtgcaaaatgcctaaaggccagggagacctgagcatctgtaaacttctgagaaaagaagtaatggtaccagtgatattcagggaagctttttgccttgtgttgcagaagtaatagttgaagttattcgggatggttcaggccaggaccagggaggatgaagagaaagtgctgaattttgaggaagaatgagtagaagccagtcctagattggctgtcctgagcaagtgagtttgaagaaactgatttagcacaagtggcagtagaacttcactgtggtggaaacctcaccctgctaggtgaggccagggattctcttcggtgcttctgaaattactggccacttgaagagtaattcccaaacagtgtcagtgcttgagtaatattgccaatgcttgcttgctatgatgctgtctacatggggagtggtttttgttccctatcccttccaaataacttggattatttacatatattgtttctttggatagacatgctctaaaaaagtttgcctctaaggtgaaaattccaactttcgctaaagtggttgaagttgcatattattaaatgttaaggccaggtgctgtggctcacgcctgtaatcccaacactttgggaggccgaggcaggaggattctttgaagccaggagttcaagaccagcctacacaacatagtgtgacccccaatctctacaaaaaaaaattgtttttttaattagctggtcatggtggtgtacccctatagtcctggttacccaggaggctgaggcagaaggattgcttgagcccaggaactcaaagctgaggtgagctatgatcatgccactgcacttcagcctgggcaactgagcgagaccccatctctaaaaaaatttttttaaaagctattcaacataaaatataaaactcagtaaaataggacatgatgacaaaattttgaaaagaaataactccttgcccaattttcacaatacaaagaaattatataacatggtaaaattagtgtgaattttttctctgtggaaa

SEQ ID NO: 68754 - DNA, 1187 bp, Homo sapiens
aaaattgatactgttatataccagttttctctcatgtaaagtggagaggataattcttgtcttgcccattttaataggcttatgatgttgtgagttaatttatatgaacaaactttgaaaaactgtgaaacattacataaagagataaagtacgtgggtatatgttttccaagtttatgccattggggttctaagagaatatgcctcaatatcatttatgctgaaaaacaacttaaaatgcatggcctgctcagagtggtttagaaatgtgatcatttagtcttcctcttatatagattttacacctcttgaaagtaggaactgttacacataagtcaatgagtatttgttgatagtgtagtgttcacttaataatatacgtatttcttttttctatttaagaaagccttgtgacttaggaattagaaatcagtttctttgtgaaatgcctagacagtggtactaaggagagctttccttaaagagaaagtttagggctgcacataaaaggcaggacttagcttgaatatattctacaggaatgaagaattcaaggtgttgtaacgttagggacacttacataggtgagtggaactgaagtgtgaggaggcaatactaaaggcagtatgtggtataggatacccaggagtgactatgaaaagacaactttgaatgaaggtgttgctgctgtttgaaaaagatattttgtagtttcttttttctttttttttttttttggcaaatgaatgaatttaactgcagaatgaattattaccagtaaagggggatggtggagagagaagtaaaagaaacttatgcctcaaattgggattgcaactgtataattaaacaggtttgaaatattgtattttatttttagagacagggtctcactctgttgcccaaggctggagtgcagtggcatgatcagagctcacctcagctttgaattcctggcttcaagtgatccttctgcctcagcctcccgagtagctgggaccaaggcgtgtgccaccacacctagctaatttatctatttttttttagagatggggtctcactatgttgcccaggttgatctcgaactcctgggcccacgccattctcttgccttggcctcccaaagtgttaagattataggcattgagcagctgcacctagcttttgaagtattttattttatttat

SEQ ID NO: 68755 - DNA, 1050 bp, Homo sapiens
aagttattttaaatgtattaatactcaggctctgcaaaggtgctggagattaggcatgctcaggcacgtactgctggctgacacaggcagagcccctgaccagtagtagcccctgaacacactacgtgtgggcgacgggcctagcaggtcacattccttctgaaccctctcttcttctcatttgattctcaggacaaccccacagagtaggaaacaggacaggcctggttcgattcaagttagtaaactttttatgcttacccagatgaatgagaagaggaggtaacatgtatattatctactttcaaaaacttaattacttaaactcttgaagaaggtggaagacttcaaaaaagaaattcttttgagaatttggaaaagtagatgcatttctcagaaatagttcactgaaaaaattgtgtatcagaaaagaaggatgaaaataaaaggaaatcagctagttattttgttgttaacagaataatctcaggctctttcacacctagtcatctggatttttacaatatcaagtcagcccctcccctccattattcttatgaaagtctggctgctattcctttctcagcaggttctctaaaagaagctctagaaaggaaacaaacattattattggtagtagaagtaaagtcctttggggttgtgagtctttactgtatataacacttcctttctgacctgctatttaagcctcattacagaagatgaccctgaaattgaaatatttcacaattattggtttcagttcctcaaaaacattaatggagacaattaatatattatcagagttgaatagaggtaaatcattataatcttgctgtatcagttattgctctatgacaaaccattcaaaaactcagtggcttgcctgtaatcccagcactttggggaggccagcgtggacggatcacgaggtcgggagatcgagaccatcctggctagcacggtgaaaccccatctctactaaaaatgcaaaaaacattagctggatgtggtggtgggtgcctgaggtcccagctactcaggaggctg

SEQ ID NO: 68756 - DNA, 2044 bp, Homo sapiens
tcccgtttgtttctttctctagtttctgtggggcctgctcttatctgagatcacctagtcaggtaagaggctttgctgatcttggcaggtctagcatggccttatccaggatgatgggaatgactcttcctctaataggttccggcttcatctgctaggcccaggcttgctgtgattgatgaagacaggcatccacccgagtgagcagaagcacctaagggtctcttgaggcctagattcagaactgggacagtgtcacttttactgctttctgttggctaaaggcagtcacaaggtcagttcagattcaaaaagtggagaaatggactccatctttggataggaggagttgcagactaacattgtacaaggttgtagatacaaggagaggtggaagatggaggcatttttgtaatccatgtaaggtacatgctgaaaaaattactgaacccagctaaagtttaggttcttcagtctgaaatatgggattacacttgatcctgaacacactgctgatcatatatgtactccttagattatatagaaatctatgtggacatgtgtgggatgaccctctttattaaaactgttaattcctaactcctgtagaatagagttattatgtttttttcttttgatgccctgtttagttggtttggtactttcactggggctgtgtcagtttaaggtccaaaatagatctgactgattctgttttgggggatggaggaaggtatcttaggtctcagtgtgcttctgagaagtctttcaagtagatgacctcccctgttctgcccacacccaaaacccactgaccaagcacttgctgtcatgttaccctgttttgttttccctgtggcacttatcactggttaaaattcttattcacttacgtgttttctttttctgccttgtgatatgagcctcacaagagtggggacctcctctgaccctctttgctgctaaattctcacagttaagaatagtgcctttctgttcttaggaaatgctcaataaatatctgttgaacatttgtaataaatattttgtaataaacaagtcagcagtttgttaaaatacagtgtgtttaaatgctatgtcactggtgcattgcagacacttgttgggtatttatggaatcttgagggagggccgtggtcagtaggagctcaaggagaatgaaagcttgaagccacaaagggtttttctagattaatccagtgaaagacagatgagcaggagagttagggtatgatagatttgttgaaatgttgaactgttagacttcaggctgggaaggagggaagtagagcaaaaagtgatctgatagattgggatagagattcttccaagaccagagaactcccacagggaagtagttaaacatgtatactgcaaggttggagatttggtgttgcagtgtgatcattgaagtcatgattttagatgtgccaggttatgggtatgacaaggttctgggattaagagaatggatggctcaggtagttgaaggaccttgggggaatggggaataaatatctgttctttgagagaatgcagtaggacagctgatgggagaaagtccttaacagccaaggtactgaggtaatgctttgaaaagaggttgagggtatagaggagtttgctaattatggagcaccatttccataggtagttaaatttgtaagatagaaggtggactgtagactaggtcagggatggaaaaaacaaagccttgtagggttaatgccaggtcagtagatggattgagagaggaattggagataaagttaatttgggcattgagaggtttgctgaatttagtttcagtagactcctagagaaaggtgaccctgggacttacagaggccgtgactcatttggccaagagtggtggtcagcccaggaatttgtgggttctgcctgtgctccttaaagggtatttgggtaggtagattgtgaactcttaatagcttacatactaagcagatacatagtcattagcagcttccatattttcactatggtttttcagaatatttta

SEQ ID NO: 68757 - DNA, 1075 bp, Homo sapiens
actgaaaatacaaaaaattagccgggcgtggtggcgggtgcctgtggtcccagctactcaggaggctgaggtaggagaatgacgtgaacccaggaggtggagcttgcagtgagccgagatcgcaccactgcactccagcctgggcgacagagtgagactccgactcaaaaaaaaaaatttaagtttataaacttagatttaaacttagactatgtcctacaatcaagcgtcctgtgtaaaggtggctgtggtatgctggtggcattgaaaactggtagcttgaagaatgtgtactttcagtacattccgtggatgtcctcttcttgatttttcttttttttcaggttctgagcttccactgactgtggttttccatttaaaggaacaaaaaagcactagtacctaaaatttgctgtaaaagacatttcacctgctttggtattacctcactgccatctgactgtatccctgcctttcctgatttctgtggctatagtagaagtcttgtggagtttgtggagtttttgaagtttgtgtagttttgaagttttgagaacagacctgtttgtagttatgatccagtggcataagctgacctcaggatataccagcttgctttattagtgacttaattttcttactgtagtaaattgggtgtgattttaacttgttcattctttgtatatgtatactttaagtatacatattttgtatatgtatattttaacttgtaagtgatcagacatctctatcatcatctctgaattaaaattaaaattgtttaactcctgaaaaattcaactgatgttatgcaacttggaacataagaccggacaaattactgaatctgacatttcaaatatttcctaatgtgcttttaacttttgctgggcacaaatggaatttctcagcctctgtcataaaaaaagagtttgttattgtttggtaagacagattaaaacacagctgggaatgaagtagttagcccagtctcaaagacattagcctccctctgtttatttcctcctgtttgtattcctagaagcaaacagctgtgcattccattttattcttt

SEQ ID NO: 68758 - DNA, 1987 bp, Homo sapiens
agttttgaagaaggttcgcaaaagggaaagtacagtacatcctcacttaatgttgtcagtaggttcttagaaacttcaactttaagcaaaaggacattcagcaagtccttgaaccttgttttcctccttgtcattttgttacgaggttgatgaaaaaaatggttttattgtacttcatttcattttatagatggcaactgaggcaaaaagaaggcagtaactgcccaaggtcagacaggcagtaagtggcagagttgggatctggctcccaagtccctgttcttcagtaacattatgctgcctctcataatgttctttttttcaataaactgtgtgtgggcttctaaaatagtaacagttctttatataaaaggggaaaaaagttttaaattagagcagggttgaagaaagttcaacttaaacttaacatttgactgaattttatctgactttttccatgtaatattgacgtcatcgaaacatactgtagttatttaaacgtgtcgtggttctaaatgtcttgcatctaatgttatataactaaatggccaaagataacagtgttacctcgttatccctgcttttgcctctttttatttgagtgtctgtggctgtcttttcctgcgggttttttgcgcccgtactcatctttcacacattattgattatcacgcctgagtgatctgccacatcccaaatttgtccttttataccttacctgactagtggctgtgatccaggaactttcctccctggcacctatgcaaagatcagtggctgccagctctaagttccagatcatgatttctctactctctgcaatttactagttaagtatcaactttccatgtttgtaactataataatgtagataatgataaactgaactttaaagaaaaccctatatatttcactttttccaccttctctttgaaagtagtaatgaccatggcaacataaatttatttttccctaactacgtgaatcatctgacctttgatttgtcaatctttgtgactcctattaatgtatagtccaccttatatttgtttaaattaagttatcaaattccaaataagccattggttttaaaactacaaagtattatctttttgctaccaaaaacataaacaattaaagaagtcactaaacatatattcgagacagatgataactactccctgtagacttaacacttcattagcaaactaatactcttcacacacccatgccccaccttccccacctcattatttacctgttgtatctgttaaggattgtttccctttttgcaatccatgctttgtatagaaaagtgaagaaagcaatctccagagtaaccttggagcagtaatctgatctcagattgttctgggagctaagaagaatagagccagagaggtaaaaagaatgtcagtttcaaaagggatactgaacatagcctacttatatgatatataaaagtgacatcagatgcaatcgcttgtttgatttaggaacctatgcaggaagaggccttgattttaatgttggcatcatacttgctaacaacactctgcaagtcttctgaggcttaatttttttttttttttttttttttttttttgctttggaagcatggttgtgggcagagctgggataattttgtgtgtgcgtgattcttagttatgctgacagctttcaggttttgaaatcctgtctcttccctgttggtttaacctgtgttatccacatttttttatctcatttatttcattaatttcattcactcagcccaaagatgattatttggcctctactgtgcactaggtgatgtgttctttactgggctttcttgttgtgagtgaacatagacatggtcgttgtacttatggagtcttcattttactggggcaggtagtcattaaacagttgtcatataaataaacataaaattacaactatgatcagcttggtgaaggagaagaatgcagtgtcataagatgtc

SEQ ID NO: 68759 - DNA, 1042 bp, Homo sapiens
ccacttcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccttgatttccctttcttgtatgcatacacccatacacataaaattttgccatctgtttatgaaaaagtacagctttaatttctttttattgccagttttcaatctctgcccatcagaatagtaaagaaaggattctccaaaaaaaaaaatgtgctccattatcggagccagacacagttgagtgtggggacgaaaccagtgctagctgggagcagtgctttttacttttttcccccaggtaacagtaatgacatggtactaatactttttattagcagtaagacctcaaagattctcaaatcactcactatttgaagctgtcattatcccacgaatccctttggctccagggaacaggacaaagaagaggaatacagcctaggggatagcttaaggtgtcatgtttgatttcttgtaattaactttatcatttaaaaaggcatcatgtatttttatactttttgaatttggccaggtctcatgcggatgatagtggtctagatagttcatgttagtagtgataaaaaattaggagccaccatcaaaaatcaaacattaggttttaagtattggaattaggaggtttttacctttcaggactcatagactgaagctactgttgctatagaaatgattttccacctacataatttgtgtttgagacaattctttcttaaatacatttttaaaactataaaatgaataagcgtaggcatcacagcacagaaataattcttcagatgggagaaaagtgatttgtttttaataatatcatgagtagaaccatgaaaacccaactacaaatctaattttattttaagatattt

SEQ ID NO: 68760 - DNA, 1051 bp, Homo sapiens
aactgaggatgcattcactggtagcaagccacatatttataaatgagtacaacacagaaattggtttgatttttctcttgtacattatattttgttcagaattcattattccctaggtaaatgcaggagacatcgctgaaacatcaaactgatcccatcattaaagacagtagcatattcagggattatgccagcataattttgtagaaaataaaagaagtcacaagttagagagacaggtgcagcattgcagctacacgaagtggagcgtgcagttttccaagtaggtagttaattttatccttagttttcatgattgaagtaataacattgataaaatgaaataagttaaaatatgacagtgttgggaaaatgtagaatgataatactccgtagcttttgagaacctgcttacctctttctagtgagagatccaggatttttctggttgatagagatctgtcctgggcagaaaatggcaaaactgagattcggctcatgacttcattgcttttattgtgtccttagtctgccttactgggcgttagtttccttaatctctacagaggagttgtgggctaatatgcagtgatgtctgtggattgatttctttaaaacaacaacaaaaataaaaaacaaacaactctcaaaacacaaagtagtagaagtagaaatatttatagtggctggtggagtgctgttggatatatcagtctaatttgttgaaacctagaaatcatgtatgtcctagttggtttattctacttgggattagaaaccaagtgcttagggtaaaggaggagagattctgcatttgttttattttcattgcagatgcacattacctctttcagaaattcctgagtcatacatgattacattatgtttttatgcgagacatttaattcctttgcactgggaaataagtttttcagttgcagttttttaaaatgtgaaattggctgctttatataacaattgtttaatgctctttttattattccatttttgatcccataggttgttgttagggcctctgtttaacagtatg

SEQ ID NO: 68761 - DNA, 1972 bp, Homo sapiens
ttccctggtatatgggggagaggtgggtttattgcagtaattacaggtgagttaattaagtagctgaaagttagcctctcatttgtaaagacacacaataataaccttttttagctaaaaattagagacactgaaaaaaaattagaaaaatattttttaaagagaaagggtctcgctatatttcccaggccggacttcaactcctagactcaagatatcctcctgtctcagcttcctgagtatctaggactacaggcatgtgccatgcaccaccacgcctggctaacaggataaatttatatgaaaagacttgtaaacaaaagtctttcaggctgctctcaaaacacacacatgattaatgatacttagtttttgtaccttgtatcaaggtgcagtatgctggtgattattttttagagcacggaaatgccagcggtagtaagcaaatctcaaactgtcagcttagaggtttattgtgcgtgtctgctctttgagtctataaagggattaacagctgaatatagactttaaatcactgttgggatttaaatttttactctgaaagactaggtcatttgacagtaatcaagggtattttcattctcaagactgttttgcaggcccagcagaaaacccctctatttaacccatgaggggagtcatcctcagggctgaggcatatgaaatctggggtacttcacacagaaaaataataaaaatgtagggggatttgccttgtggttgaatccaggaagttctaaattggcaataagcagatagggaacaattttgtcagatactgtggattaatggtatttaaaaggcaccttgttattatttttgatgcacaaataattttacatctgcaagcatattttagaaattcaccaatatgatgactaattatttggccaaaaaaattgacagtgattgttgcaattatatttctaaagacccatgcaatacaatggtgatttaaaatatgttggtcatatgagtttttaaaactgaattgtttgttatagaagtaatataaatatttaaaaaatatatatctttgaaaaatatagtgtttttttttttttaaactgtattccaaagccgattcctgagactgtgctttatatgcacctacggctcctaaaaaacatcagccacagcttcaagcctaagctcacccgagacccaagtcagacacctctggtgtggagcctggggatctgtttttaaagaactccacagtgcacagtcagcattcagaaccaccattctaaagttttatatgtttcacatggataggcagatagttgaaattgtaaaaaaaaaaaaaaatcaattttgattctctaatataatggaaaatatcagattaaaaagaactctatagtaatatttcactatttacttgagatgacctgaactaggtataacgaaatggaagactatagcacattggatagccacagaccagtactggtatgaattagaattgaattctgcttagattgtaaaggaacttaaatttagcactaagataagattattaaaggaaaataatgtgattaaatgaagtagaacaacagtacctaaaatgtgttatcttttaaagtttttgaaatctcttgttgaataaagcacaataattgtatagcattgaaataaagattttgaagtcttactataccactaactcaatatagtaaaaggtgatgctgaaaaaacattaatgtggctgtattggttattttgatattttaaaaagccctttagggctgggcatggtggctaacgcctgtaatctcagcaatttgggaggcctaggcgggtggatcacttgaggtcaggagtttgagaccagcctggccaacatggtgaaaccccgtctctactaaaaatacaaaaaattagccgggtgtggttgcaggcgcctgtaatcccagctgctcgggaggctgagactcgagaagtgctt

SEQ ID NO: 68762 - DNA, 1139 bp, Homo sapiens
ggtaatgtcaaggatgtttttgctgattgggacaatttgtattcaactgcaattcgactacattcattagcttcatcagaaataaaactgaggattatgtgtctagatctgggtgagctcaaagatgattactgctacatagtccttgctctcaagagattatatattacataatttgctttctatcttatggtttcagtagttatttttagcagcaaacagttatgttttttaaaggcagcaaaaatttatgttgttgggttattatttatttttactttttaagacttatttatataccaattaaagcccagaaaattagtcttgagcaagagttaacacatgctcctaaaattttaagttttttgtttggccagatgagggcactttttctttacatttctagaatttgagctgtgaagcagattgttttttcgcatccaagcgatttctttctttcttttattattgccagtgagacagttttggcatttttgatgttttgattgtgctgtattctcatagattaatcctttccatcaatcctttcctaaaggaaaagcttcagtttcttgcaaaggtgttgtatatgggaactttaaaatgaatgacaaaatttaatggaaccaaggtggttttaggaaaatgtccatgttatttgtaattttgcttatagttaataatggaagttgaaatgtacttttaatttgagtactctaacaatagcaagacgaagtagcattgactagaccctcctcttctcccttaccatatttctagtgcctgctttacattgaattaatgttgccttgcattattgccgtcagaattatacagaagtaatggagaagaaataaaataccagaaacattttgtctgctgcttagaaataaacaaaaataagtataagtactgaacccaacaagtataatattagaaatacagcatatttaactttcttatttgctgtcaaatgccagactgaataggataaggtttctaaggttatgtgtaatgtactaaaacaacacagactgcaactatttggtgtcagtgtgaacagtcttaagaagaaaatcaaagagaataatgtttaaacgtcccacaaaacaaagctgttgtcatttcgtcacagatga

SEQ ID NO: 68763 - DNA, 1068 bp, Homo sapiens
gtacttcttctctataccttttttttttttcttttaacattggttcttcactttggagaggagattaatggacctctttgaaactgtgatacagagatggcgtacatttcttttgtgccctgtccatcctctgtttcttctgagaatctaactcacatttaccttggagaaaaactccttattcagtacttgttattatactcaggtctggtcagtatttgttccatacctcctgatcctgtcattgaccagggtgtgcacattatgtaagctggaccagtaatactagatcctgggactttccttaagctctggagaacgagaatgtcttatgttggatttgaagctgtaaagatgtcagcctagagctgtcctcatggggcaataacagagagaaagacagagagaggaggggtagggatggcctgggaggaggagagagaagagtaggaggtaaagaacggagacagatagatacacactttatcatattagttgagtctctggatctagccattcctgaatctactcctgaacttttaaattaattgaaccaatacattccctccttttgtttaagctaatttgaattggattttctgttatttgaggctggaagagtcccattcccatgaagaatgcctgtgtacttaacatatcttaaagaatgcaaatgattcgggagtctccatatctgtaggggcccaatgaaacaaaaagtaatgaagatcaagttgttccaaggatagccattaactaattaataacacacacatacatataaaatcttgttatttattgtagttgaggggatgggatatttttattaatgccttttggattaatcaagaattaacacatttatcttcttcagtctctttcataagaatatcctttgtgaaatatttggattgcatttcatttgttatctgtctctctaggcttataaatatacttgccaaccacatacatgtcttaggactcagaccataaacccatagatacaacgtaatttgccagaggtcccataaaatactaataataaggctagttgtccctggctctagc

SEQ ID NO: 68764 - DNA, 1036 bp, Homo sapiens
ttcttgatctcattctagtggaatttggttacttgcttttctgtgcttttccaaagacattaatttgtttctttattaattgttaaaatctgcttacaacgtgcgcttcttcatttcctccttgtgtcgtatattttaaaagttattattcagctgagtcttactctttgaactcttactcttagtgtcagcttcacttcaccttttgaaagaaaaaacccaatcttgaaatcctcctttatcttgttaaaaagttttaggaaatattttgttatatttactggtaattatattttcagggatagaaatactggtttaaagctaggaaaacttccttatggataataatgcctttctcttgaagcattgcaaacaagtaaatgaattatcagttggataaatatttccttttttggtctttcaattccccaaataatttcttttaaaaaatactcatttattcaggttaatgcaaagcactgtgccaggtgctgcaagagagaaggctgagagataactgattgcattcaagatgtgtactacatgtgtggccctcatcatgaaatcagagagctttacatgctgcgcatgagtgataacaatctaaaagtcttagtaggaaatatagttattgcttggacattctagacttaaaaattaaccttgaaagcccagcatatctaatcatttctagcatgttggagaactgaagatgattcatttagccagaaatttcagttatctcagtgttattgcaagttccctatctgatcttcctctttttgcttgccttactcttgtgagacaactattaggtgtgttttaaatgggttgtcccaaaggagaagagactttcctattctcagccctctcaagataagcagaactgagattaggaaaaaagcaactgagccagagccaattttcacaggaatttaaaaatatcagtgtgaaaacaaaatgagcagtgaagcctagctatttaaagggcatgcaaaagagaagttggaaaaggaacatgagctggcagctaact

SEQ ID NO: 68765 - DNA, 1102 bp, Homo sapiens
aacaactttgctgccttgcagccattctcaatttttctctttccttcagttaacatcaccccacctcccctccagtctgtcatcagtgagccctgttgacacttcctcccctccaaaacgtatcccaaatctgctcacttctctccatctctgccacacctctcgtctttgccaccatcatctttcactcagacaactgtggcagcctctttgcttttcccctgcttctccgctcttgaccctttacaatccattctccacactagctagattcattttcttaaaatataaaaatgtaattcagatcttgtcaatgtcttccagtggctttccatagcacttagaataaaatccaaagttcattatctgacttgtaagtctaaccctagttgacttttctacttctacagctgttttcctctcaccctaccatactctagtcacagaggccttctttcatctcagatatgccaggcttagagcctttaaactaactgtccactctctctatccggatttcttttcccctttttgtgacattaagtcagtgcttaactgttggccctcggggcttttcctgacaatccattctctgagtcactgaacctgtcttagttctttgcataacccttttccactatctcatgtagtcttttgtttattgagtttcatcccccatgagaatatatgctccatgagagcatagacctttttactgctgttatgtgtaatacatagaacagtgtctggtacatagttaatgcttagtagatatttgtggaatgaatgattgtgtgaatgaacaaagggagcagatttttttaattacaaatttttaatacttaagatattaactatctgattaacaatatccttaggcagagtgggaaaaaaagtgactattctgattttggggaaaggagcgctaagaaatatttatttttctgtcttttagcagaatgcaggaatagttatccccatttttttatttacatagtgaaatattttttaaaaatttttctataagaccattactcagcagcaaaattatttcatgtatggttttgtttttttgtttttctagcaaaacatgacagatttt

SEQ ID NO: 68766 - DNA, 1031 bp, Homo sapiens
ccaaaataatgtataattaggtctattcattatcttgccatatgctaagtagatgctaaggatttatcactgcagtaaaagtcactggatcattacagttattttatggaaatatgttttaaaatttacaattcttttttgtaagacagtaacaaattattatgcagaatttatacctctgcctaagactcttgcaaatataagctcctgatttggtagagatcttcctaaagattgaatatttaaaaatcaaaatacttgttttctttttttgaaaaaatgccttctgtagatatatctgggtgagaaagcaataaaatataaataaaaatcttttatcaacaacatgtagtgtcattacttcatgactgattgtcagtgtgttgtactgaggagtgtcactggtttgtcccaaagaatgaagtggtggcagtgatggcagcatctgtttctaacttgtggtttatttctcattttcaagatcctgttgccactggtttttctccccagtggttggttaaaattcagacttgtttcatgaatacatggcagtgtgatcttaggagcttgcagttgctcagtagccaaccacacttagaaagtttgatgtaaatatttgtactgcaagatactctttgttgagataccaagtcccagcaaaaagtagcattaaacctgaagaccacagaagccatggaggaaaagcacattctacgacttgagctttttttctgaagctgtgtgtagctgattctatattttattctctaaggtgaaatctcaaactttttgaaaagggtcactaaaagagaatgaaatcatgtcttttgcagcaacatggatggaactggaggtcattaagtgaaataagccaggcacagaaagacaaacagcacatgttcacattcttaagtggaagctaaaaaaatgaatatcatggaggtcgacagtggaatgatgacagtatagggggaaggggagctggagaaaggttggttagtgggtacaaacatacagttagatggaaggaa

SEQ ID NO: 68767 - DNA, 1044 bp, Homo sapiens
tgtgaactggtgagcatctagagcagtggttcttaatcagagcaaactcaaaatttagggaggttttacagactggctccactgacaggtcaggttgaaaggtttctggaccctgagagtatgtgtgtgtgtgttctccagcttcacaaatggttctgctataacccaatggtaaacaaaacaacaacagattgcagtgttaagactcagcccgtagaatgtacaaacgccaattgtgaaccctaacaaactccaattgtgaaccctaacaaactgtggtctctgggtgataatgatgtgataatgataattgccgtataaggctcatgtattcatttccagtcttgctcctctcattccctccctttggttaggtatcagatggaaggcagatacgtttaagtcatgagcgagatccacccatcctcatgtatcagttacaaatgcactgtcctacctgcgttaggacaaatgcactaaaactgtataaagtcttcagaggatattcagttgtcatagaagtgagttatatctttggttgagtttttaaacattcattcttactggggtagtatttgggaaacattgtatcaggttttgctggtagagaaagggtaaatcagtaagttaaagaataagtgatatataaggatttaaaaaagaaggcctcaagtttaaaggatatatgtaattacaagatgatctcaattttaaatcagaacacttaagttggatgtataggagacaggaaatgcatgttagagagcaatttagtggtatggaggaattcataaagtgaatttgaaatgagtaagtactatgccggtgtgactggaattaccacctctttacctgtcctcatttacctgtttttctgtctgtctcttagagttgactccctcactcttccattatccagggtatagaacacttcttgccatctgcttccagattccatcccagaataattagtttttatctctttctttcttcccattgttgacagccgtcactttctagtattcgcattgtcaatacaagttc

SEQ ID NO: 68768 - DNA, 1152 bp, Homo sapiens
tggtgaaaccctgtctctactaaaaaatacaaaaattagctggcatggtggaaggcgcctataatcccagctactcaggaggctgaggaggagaatcgcttgaacccaggagtcggaggttgcagtgaaccgatatcatgccattgcaccccagcctgggcaacagagcaaaaactctgtctcaaaaaaaaaaaaaagttcattttttcactcgaatttaaaccttctgcctcttcattgaaacacatcatactcatggacgtagaatacctgttgtctgctccattggcccagccacctactttaggggactttttcttaaattgtattttgaaaaattgatagttggatttggtttccagctaagctctcattttttggcactcctgtgaaatttgaaacctaatttaaatagcagttttctttgctgtaacctaatgactaatacatgttctcaaatcattgtttattctaaaaagagaggatacaaatattaacagatctaggggcaagacttcctattcttagctacttaagagcctgagatgggctagttgcttgatcccagggtactctgcagatcgaatgttggcctcaaatatttgacatcaatatgattgtccctgagaatggagatagattgagtttccattaagattagtgtaaaattgatattttggtagtttagtagccatatttttctcaaaataaagtactagaaattgaatatgcaattcagagagaaatagtgaaaaatatgaggggacttcaaaaattcatggaaaatggatattgtgataaaactatgcatggatttaataaatttttttacaccaaaataagcctgtatgaatgtgttatagcaagtctgaacaggacctagtttgaggcactaagaaggataagacatcagcttgaaaagaactcctatcagagcaacatgaattctgctaaaattgaaggaagaataaacatcaaatttatggtaaagcttgggtggaaggatggtgaaatcattgatgattcacaaaaagtttatggggacaacactccaaagaaatcagcagtttacaaatggataactcattttaggaagggacaagacaatgttagagatgaagcttgcaccaacagactatccacatcagtttt

SEQ ID NO: 68769 - DNA, 1069 bp, Homo sapiens
tgtgtaaaggaatgctaattcagcagagcagacctagcagaagtgattagcataaaagaaccagaggactgagattaggaaaaccaggagaggggagtgttaactgtctcaggtgctacacatcagtcctttgagatgcggaccaagaagcaccttttgactttgtcagttaaagagacatcagtgacctttgctgaggcaatagggagaatagaattaagattacagttaatggaggagggaaagaggtgggagggaggaagtgagaagtacaaatagcctttttgactgagaaggaaaagagaaattcaacaacatcaaagaatgggagtgactaaagtgtgtttttcagctggtacataggagccagtagagagaaaaggttgaagatggagggaagagaagaaccagttgttaggacaaggtgccagggatgttgggaagaaaacagatccagcgacatatgatggagggtggacttaactaccctaagatttgagggcaacaaatatttgcttggggcatgggagtgattaggatggtggcttaaggagagtgacaaaaattttagaatagctgctaaagggagaatgaaagcaaatgaaagagttgtctgccagatggtgttaagagcccatctgaaagtgaaaaccatgaattgttcatcacatcattcaatctgcatgggtagatgctgcctttcatttgaaagcagcatatttctttccttaaaaaaaaaaaaaattggctgggtgcggtggctcatgcctgtaatcccagcactttgggaggccgaggtgggcggatcacctgaggtcaggagttcgaggccatcctggccaacatggtgaaaccccgtttctactaaaaataaaaaattagctgggtgtggtggcgcatgcctgtaatcccagctactccagaggctgaggcaggagaatcacttgaacctgagaggcagaggttgcagtgagctgagatggtgccactgcactccatcctggaagacagagtgagattccgtctcaaaaaaaaaaaattgctctaaaatgtatctgcttactaaaaa

SEQ ID NO: 68770 - DNA, 1053 bp, Homo sapiens
attgtgctgcaattttattacaaaaatgtctgccttcaaatggggtgatcttatagcatatgcaacagtgaatacacctaaaccaactctgccaggataatacaaaattccttctcagtaagttttagaggtgttttgttacagctgtctgatgagaacagtgaaggctttattatataatagaagatcaaattgatttgggggtaaggatagtaagcttactatattttaatcttcatacagtatttataggttatggtttatgttttttattatcttttagtttctctgatttatgttttttaaagggggctgtcgttggcttttagaactgtggaaaagttgtttcattgacttctttttcatgtttctgagaatggatttgttttcttttattgtatgaggagtttaaacttgaacatatttgaaactaacaaagccttcactgaaaaaaatgagaaggatcatgaatcactacttctctaaaacatatgcaaacccttctggttatagcaaactgtgttggcttgcttatctatatttcaaattacatgatgaaataattttgttttctcaacttgagatgctatttttaatttttgttacagcagtttcatatgaaaggaatttgttttagcaccagttatgttgcgtgctagatttagttgtaagacaactcagattgaggtatctaaaaatttttatatcagtagcattctaacaaggtatgtacaatatgttttgtaaaatggtttgcccatacactgttaaaaatccccattttgggtaaagggcatgaactgtagaagaaatacagtcagccactaaatgtcagtcagcatttaattaaacacttacaatgtggtaagcactgttctaattgcttgacatggtttttctcatacaataatcagaaaaatctcatgagtattacattattatgtttattttctgagtaaggaaatggagtcacggggaggctaagtaacctgcctgtggtcagaaaactgttgagaaaaggagctgggcttgaactggggtcatctgacttca

SEQ ID NO: 68771 - DNA, 1020 bp, Homo sapiens
aataaatgggaattttaaatacctgcatgttctgtttttcttttttccttttttcagccataatgaaaggaaagtgacctgcaaacatccagtcacaggacaaccatcacaggacaattgtatttttgtagtgaatgaacagtaagtaaagagtttcatggaatgcctgtattcaaaattgggttagcattgaaattgctgttatttatatttcaatttagcagttttcttatctggacatttgtagtcaagtataataacagaatgccagctgttcacaatgtgtcatatagaaacctgagttaaacatttttttcatgaagaatgtaatttcagaagctgtttttatagtacttcaaacgcagtaagctcaagaacccgggatgcaagcttagagaaactgtgtaaatggttagattattaaactaatttgagctcacttttctcatccttaaatcagatagtggtaattactatttcacaagagttttataagcatcaaagaatgtattatactataaagctattcacagagttagttactgaaattgttattgtttttaaaattagaataatctcataattcatttttaatttttcagttgggtgaccaagtagaatatctgcaataatgcctattataaataaacatgataggccgggcacagtggctcacgcctgtaatcctagcactttgggaggccaaggtgggcgaatcacttgaggtcaggcattcaagaccagcctggccaacatggtgaaaccctgactgtactaaaaaaatagaaaaattagccgggcatggtggaacgtgctggtagtcccagctactgaggagtctgaggcaggaaaatcacttgaacctgggaggcagattctacagtgaaccaagattacgccactgcactgtagcctgagcaacagagtgagactcttgtcttaaaaactaataataaataaacatgataataatgtatttttggcttaggaaaagcgttagctgtatttaaagttgttgta

SEQ ID NO: 68772 - DNA, 1090 bp, Homo sapiens
aataatcatgatgacagtaataataatagctttagatagactacagtaaatatgttttaaaaatcttttcagttattttatgtttaatgttaaaattcctaccctcccaaatagcaagggatacatatgcttttagtgtaaatgttctatgccttctttgttgttcttgttttgagatggagtctcgctctgtcgcccaggctggagtgcagtggcacgatctcagctcactccaaactctgcctctcaggttcaagcaattctcctgcctcagcctcccgagtaggtgggattacagatgtcctccaccaagccagctaattttttttttatttttcgtagagacggggtctcaccattttggcccggctggtctcaaacacctgatcttaggtgatccacccaccctggcctcccaaagtgctgggattacaggcatcagtggccacacctggccaacttttatttttcaagagaaagaagcacatagtctatcttagtaaattttcccaatgtctaatgttgcctccaatctagaagccatggtttatatttaacctaaatatatggatggttcataactttactccaagaaaaatagtcaccttttttttttaattttttttccttggtgaccatattccaaagcttctagatatcttcatctatagttgattacagatatatgtatatagatctacatcctttccacacgtcataaacattggcagcattaccacacctagtttctgatagaagcatttttatttattggaatatggagggttggctggctcctgagaggcctcctagagtggcatgatcttggcagtttcgtgcaggttcacacactcagcttgatcttttcagagtctggaagtgattaggctcagggaaagacctagatatggcaactagaatagtgagcaagtacaactgtcgagtgacctagacacatgctgttaacgagctcattctttcagtggccaggtggacatgggatgccagattctaacccaagattgcttgatgtgttggaattataatggtaaaataaggtctgtgccagccactcattaactcatctgat

SEQ ID NO: 68773 - DNA, 1047 bp, Homo sapiens
gaatacaaacaaaaggagttaattatatggttcagatctttgatagcatcagactatgatttcctgttgcagccatttccacaaccagactcatgtttgtctcatgagtcaacaagcagctaaccttggctgggagccatgtggctcctttcaagggactatctactgtggtcctttaagtgtagactttgtggtttaactgtcataaggcaatcttaatttgctttattttcagattcctaatggtgggagcacacatcactttttacgctctagttctttatgttttctttttccccctttctgtttatacattctggtgttgtgcttgaatgttaatatcacagcattgggtatttgtgtagacttgtccactgtgaccctttccagtcccctggcccccacccccgtaaagtataatttttcctagattgaatcccagaagtaatatgtacattatttcatctgatttactatgattttcttctctgatttcagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccagggggtaagtgtctgtcttgtcattatgaacccaggtttctttgatgctgtgttggtggagattggtttctgagctactgattaa

SEQ ID NO: 68774 - DNA, 1027 bp, Homo sapiens
tgatatagctcagtgcttaatctctagctttttgcatattaagcctcctgtagtatttcttcaatttatgaatgaccaaacaaaccaaggtgtgtcagagtaaattgctttagtactagggcagtctctttgatggagtcagctttccctagctgacatatttgcacatagtcatgggattgccagctctggatgttttccagtttctggctttcgtgtgataggagacggtgaagatggggaggaagaccaagcagaaacaaaataggaaatacccatggagggaaagcctcaaggaattgaactctttatactggttatataagagcaattgggtacctttctccctctctccaccccgaaggcatcgaatcggatggttggcctgaatgcagcggttcttgtctggagacatttcgttcaattttgaacaacctctttttgagtagagacattgaaatcctgaagaacaaccaccatgatgaaggaaatttagtttaggagaaacggttgaaagaattagaaatatttaaaatacaaaataaggcatagaattttagagctctagaataagtttatgatgaaatcatcttctagatgagaaaagaggatcccagtttcagttggccattggctagattttaatagcatattaaagagctctctggtgcgataagattatatccttcctaatttttaatacctttttatttttaactaagtcattgtgatagatgagtatggttttttaaaaataatattcatatcgtggcaaaatttaaaaatagagggatttttttaaaaaatcaaaaagtttagggatcactggcatagttaaaagagtgctgctttagaaagtaggagacctgcattttagttctatttagcccgcaagctctttctgtaaccccaagtatgatctcttggaccaggtgtggctcacacctgtaatcctggcactttgggaggccaaggtggttggatcacctgaggtccggagttcaagaccagcctggccaacatggtg

SEQ ID NO: 68775 - DNA, 1023 bp, Homo sapiens
agaatttggaaaataaccctccttcatgtttacattttaattatttttttattttagagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaaggtaaaatagctgctgattttgtgttaactcactaccttataaatgctgtgttttctttctagtatactattttaaatgtgagagacaaaagaatggggataaagtaagcaaggcagctcttttttgttttaaaaaataaataaaaatattttacaacattaagatctcatgtataaaaaatacctaattgcaacacttcatctctcaggaacacaggagcagttcttttgagcagatgcattctgttttctctgcttgataccatatctcatcagttctccgtgtagcttaacaccacatgcatttttctgttgtttttgttgttgttgttgttttgttttgagatggagtctctctctgttgcccaggctggaatgcagaggcataatctcagctcactgcaacctctgcctcccgggctcaagcgattctccttcctcagcctcccgagtagctgggattacagacatgcgccaccacacctggctaatttttgtatt

SEQ ID NO: 68776 - DNA, 1067 bp, Homo sapiens
tactattacttgtgatgaaatggtaaatgcataaagcatttctatggcataccaaagtgctaaccgttgtctcacagtaaaacacatgatggagttgcaagctgaattagttccttttattgtgaaacatatttttacttgaacaaaagacaactgtcaatattcagacgtggtatttgatagacacactttctcaaagtgaatgctatcctgtcacttcaaggaaaacaactgacagtatttgttactgataacaacgtttgagttttcaagcaaaaaatagaattttgaaaatcatgtatctgccaccctgaacttgacagctttccggtgcttaaagattggcggtgatattaacagttgtgatgtttttatattgtatactgacatatgtcaatatttagaacattgcataactcactgaaccaatattttccagatgaccagtgtttgatgtcacaagattcatttaaagtacaaatagaccaagtggatattaatgtaacagagtatcaaaagttcattgataaggtttcagatatcactttgtaactaacctttaaaaaatatcagttttttgagctatagcgcagtgtcaaagatgaacatctataattatcaagaaaaactattaaaattctctccttttttccaactatatatattgagggtagattttcttcacatacttccactaaaagagattatcacaacagattaaatacagaaacagatacaagaatccagccagacattaaagatttgcaaaactgtaaaacaatgccactcttgccactaaattttctttttaagaatataaagggatcctgaggtcaaagagtttttgagaacctctaaaccagattttagaattactctgttcaggccgggcaagtggctcaagcctgtaatcctagcactttgggaggccgaggtaggtggattgcttgaggccaggagttcgagaccagcctggccaacatggtgaaaccccgtctctactaaaaatacaaaaattagtcagacgtggtggcatgcgcctgtaatcccagctacttgagaggctg

SEQ ID NO: 68777 - DNA, 1159 bp, Homo sapiens
cgtaatttcttacaaaacaaaatataattttgtaatttaatatgtcagcggtaccatttacaggggagcatgtgcgtgaaagttgtcgtgtactgtgatataataggttgtagtaaattacctgtttttcttattccaaaattgaccttttcttgaattccacatcctctttctctgtcccttttttcttaattggtgcctactagaatgaaattctttcacatcatctccaaaggaacaccatatatttggatcatcaggtgggattcatagagattttcttacttttaatacttaatagaacttcttaaatataatacagtttttcaggcttctcagctatttcagtcacgttgaattaataacatgacttttacaagtgatagaatatgaaatctctgaccaggtggattcaggaattccataataaacagggagaaaggacaggtgtggaggtaaagagggatacaaatgctgggtcacctgaaattgagggcctaaattctctagacttcgttcttcttatcccattaaaacacctactccttgaggcttatctcagcttggagctgacctaattaaaggaacagacaccaagctgtgaattgtcttgttggaaggcaagaaggagggtgaatgtagtgtgctctgtattcctaaaggggagtttaaaggtgggtgaagttggctggatgcaatggctcatgcctgtaatcccagcactttgggaggctgaggcaggcggctcactggaggccaggagttcgagacgaggctggccaacatggagaaaccctgcctctactaaaaatacaaaaatgagccgggcgtcacagtgaacgtctgtaatcccagcagcttgggaggctgaggcatgagaattgcttgaacccgggaggtggaggttgcagtgagccgagatcatgcaccactgcactccagcctgggctacagcgcaagactctgtcttaaaaataaagaaacagagaaagagagagagggagggagtaagggaggaaggaagatgggtgaagtgtgtagtggaggtgatttgcagttgcctgtccttattccctgtttgctgtgtacttccaatgtttggtctttgccaacgtgtgtagagccagttttataggaggctcacattcctagcattacc

SEQ ID NO: 68778 - DNA, 2091 bp, Homo sapiens
atagagtctctataaatgtcaagattacctttaataaaatatgtgattaagtgacacattcagtatattatattttaatacttgtagagaactaattttttataaccttacacagaactgaatatcattttcagctttattactgaattcataatcaaattgtaccatttttctcctgattgtgtaggttctcaccctttagtttaccctttgaattatgatttatcatctattttattatatgtagaaatattcattaattgactatatcatgattatatgtatgaagtaaaactagttgtgacagtgttgcaattagtagttttttcttggaagtatttcacagcgtttaatacttgtttgaaatggtttatatgaattaaatctgtacaaccatggggtaaaatgtaaacaactgcactattaggaagatattaaagtagaggctatatttacagtgtcgtctttcaaatctagctatgctgtaaactgatgtttgctgtatgctcctcctgatttgaaatagatgaaagaaaatgaacctattatcaccatggttcacacaatgattgagaactcggcgctaagaccccaactgtaccagcaagtaaggtcttggacagtgaatgatactgctttatcatctgcaaaatccctcagtgacagttttgatttattctcagatttactcatgacatcagtgtttttcttattttattttttgtttatgtttatttggaaaaccacaattcatccatgcttttcaagatgctgcagtattcttagcatggcttcgctgaacattttgctgttgaatattaaatgtgccattttcctaaagtttttgtgcagagtatttgattgatatgtacttggaggtctgcagtacatttgcaaaattactagattttcatatggttttattaactttaaaagcattatacctattttttagggaaaaggctttgtaaaaatatttactttcaggggttgccctccacaacttcccccaacctagtgttttaagaatacattatatttgtatgggcgttatttaaatctagtttctgtactatggtatggtaaaacttaaagatagccactttttaacatactgggggtattttgtcgctgtattcttaccattctcaagcagtcgtcaagactatcataagttaccctattgtttttccttattcaaaatgtgtgtcatggagttggctggctttaacttaggaaccttagtaatctgcagatctgcaaaagaagtcatatgtttctatcaaatttttgtgtatctcatggtctaaatgtttctagctatgtgtttctcaacatcagcttctttcacttcaacaccctcaaattactctggcgtatgacctttacaatctttaaaaatcatgcagaagaagaaaattaactaacatgaaaaatgaatatatattttgatttaaatatataaggcacctagtaaaaagaacgactttgagctcatgctggcttttaaggcctctatttggttcagttgccatgggatctgcatcacagggccatgtaactgaggaatggatacaattgatcagagggtgacttatatttcagcacagttttcaaaatatttaaagtatattattagatgactgaaaatagtctcaaatttgcaataaagagattaacaaactattaaatatttaaagttaaacagctttacttatcaaaagaaaatggaatctttcaattcttaaagtcaccagattatagaccttggtactctattccaaagtaccacaccgagagtatttggaataagtattattccgaataagtattattccaaaactgataccttctgcagtgtctgaagctgtcagtaaaatatatcatctataagatgctaaattgacatgagatcaaagggattttgttgtaataggttatgtttttatcacattttgcatattttagatgagaatggtagcctggatttcaaatctgtttggtttggttgggtttttttttataatgctcaacattcatggttcaggatgcggaagtctgatagtttaaattatttggttgcattaaaag

SEQ ID NO: 68779 - DNA, 1759 bp, Homo sapiens
ttactttttttatcatagatctacctatttaaaacttacttcatattactttttttccagataggaatataaattattttcttggatctaggtgctttaatttacaatgacagttgacacttctcaggacacacctgaggatacttattttgaatagtataagagtattctaacttttgtcattaaattcatttttcatgtaatattcattcctatgaaagttttgtggtttaacaatcactgcatacccttaaatagtcacagattcatttgcatgaggtatgtgaaagtaatgtcttgaaatgaaatataaatccaggatttattgtatgtttggaatgcttatatttttaaccttctcctgattcccacatttctagatcaattcaaagttatctcctgtttaaatgatgcttccttttaaagctgtaactgtcaagcagtttctttcatagagaaaacatatagaattgtcatttatacattcttatgtattatgcgtatatgaaatttaattttttaaactggaatgtaattgggacacattacttctaaccccaccttgaaaacattgtgccatttagtaaacatgcaatgagccccatttaaattttttctactgtgtttttgttattttctcacagtcaatataaaaatcaaaagacaagaaaaatagtgaagtattgcctgcagaggctgtgatgttatctgtggtataactgactgggatggctattgaaatcttgctaagcacaatcagaagtaaccaaaatatcttttaaccaaaatgtactgggcagaagctgaagaaaggatatttaagtacactgaataattccttacaatatagtaacataaatggagtcaactaacacacataaactttttatgaaatttgactatccatagtttataacataggctttcagttttataagatttcgaatgattttcctcttttcaattaaacccatccttttccttcattatcttttagttcttaagacagaagagcaagataagtctatattgtgtatgtgtgtttatatattatatatatgtatacaatatgttataggttttgttaagatgtgttgacatttgagtgtacacatacacagtgtgtgtttatgtatataccgtgaaggatggttttggctgttgaactatgcttaatttaagtatttgatttgacacagttgctacgattgtatttgtcagtttttttattaaaataatgtgtgtctttaaaagaaatgatgtaagatactgtattagttttgtttgaccagcatattattatgtttaacaagcttgttacatacatcgttcgtatgtatcttgcatattatatcactgttaagtattttctactttgttgatcagtgtttgaattaaacttctaaaagtgtaagaatcattaaaatctatttttgttatgttatatatatttaatataaatccaaagtattaattaatagggtaaatatatttttaaataagattttttaagttgctatatgatttttttcttatagctgtcacaagatgaaggtagaggcacattatacaaatacagacctgaagaagtagatattgatgtaagtattagtatgatatatgtggtcagtactctgtcgtattctccgccaaaaacactggaaataagcatgaccaaaaaacttctttctcccaagtcctccaaagtgacatcaggtaaattcatattttatgtgtgtgctctaaattattattccct

SEQ ID NO: 68780 - DNA, 1084 bp, Homo sapiens
ccagctactcaggaggctgaggcaggacaatcacttgaacccgggaggtggaggttgcagtgagccgagatggcaccattgcactccagcctgggcaacaagagcgaaactccatctcaaaacaaaacaaaacaaaacaaaacaaaacaaaacaaaaattacctgggcatggtgttgcgcacctgtagtctcagctactcgggaggctgaggcaggagactctcttgaacctgggaggtggagcttgcaatgagctgagatctcgccattgcactccagcctgggtgacaagactgaaattctgtatcaaaaaaaaaaaattttaaatgaaccaggcataatggcacatccatgtagtcccagctacctgggaggctaaggtaggaggatcactggagcccaggagttctaggctgcagtgagctatgatggtgacactgcactccagcctaggagacagagcaagatgttgtctctaaaaaaaaacaaaacgaaaacctttctttatcaaattcttatttcgcctccggggactccgccccatctaagatagtctgcctttgatagctgtttcagctgcctgctgaatcttgcctacaaagattacaaacaaatgacacatcatgaagccatcttgctggcaggttggatgagaaagttttccatctgagaacttgctctggagctgtgctgaaggataacaggttgtaacttggctctaaactctgggactgttcagcaggtcccagtggtgacctccagttataattaggcaatgacccataaatgtgcagacagattagaaaattagaggaggccagcagcgagtctcatgcctataattgcagcagttggggaggccaaggcgggtggatctcttcaactcaagagttcaagacaagccttggcaacatggtgagacccctgtttccgtttctactaaaaatacaaaaatatgtgtgtgtgtgtgtgtgtgtgtgtgtgtatatatatatatatgtatatatatatagctaggtgtggtggtgtgcacctgtagtaccagctactcgggaggctgatgtaggaggcgggaggatcactt

SEQ ID NO: 68781 - DNA, 1011 bp, Homo sapiens
aggagagagaattgtttgagcccaggagttcaagaccaacatagggagttcaagggaaacacagggagaccccatctctaaaaatatttcaaaaattagctgggtgtggtggctcacacctgtagttgcagctacccaggaggctgaagagaaaagatcacttgagctcaggaggtcaaggctacagtgagcagggcatggggccactgcatagcagcctaggtgacagagcaatactctgtcacaaaaacaaacaaaaaacaaagcagcaacataaagaaaacaaccaaacattcagctgtgaaataattgcctttaagtagagtatgtaccaattcactcagcttgttggactctgatgtcaatgaggccaggagcttaccccccccggggggccaggagattcaaatacaggcaacatttcttccatcatcaacatccctacttccaatttgtcatcgcaaaagtgctgttattcccaagggattttaaggaggtgatgtagacaggacattttcaacactcctggggaaagtgtgtctttatatatttgtaatgtcagatcagtagtatcatcttgatattcaagggactgccctatcctaaaacataaacttgagaaacttatgttaagtgaatagcatggaagttaatggtcaaatgcagtatgtctcttaccaaaggagacttggacacagaagagcctcacatttgtaaatgctttaaatcctgatttccttttaggtcacaagtctgtcttcccttgccaacttcatacgtaatgcaatggcatcagcttttggtgaaagcttgattgattccttcttcttcttctttttttttttttgagacggagttttgctcttgttgcccaggctggagtgcaatggcgcaatcttggctcatcgcaacctctgcctcccaggttcaagtgattctcctgcctcagcctcctgagtagctgggattacaggcatgtgccaccacacccagctaatttttttgtatttt

SEQ ID NO: 68782 - DNA, 1003 bp, Homo sapiens
agtctccgtgtgagtgcgcgtagtcgcgcgcctgtccccgcgcgggctccgtagcgcgtgtgcaggctgacgcagctcgcgggccctcctcctgctctgcagcggcgtcggcggagttttgggcgtttgggaggggggcgagggagagagagtcgagagagggaggcggcggtggggaggaggaggaggaggaggagcaggcgccgccatggccgccgctatcaccgacatggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacaggtcagtgctctgaagcgtttccccttcccttcctcctcttgaactcccgggcccctcagagggggaccaaggcgacgttttgccgcgatccccctgctccccgaatcctcggcccctcccccag

SEQ ID NO: 68783 - DNA, 1006 bp, Homo sapiens
gatcatattcatgttagtgaatttctaggaataacacagccttttttcttcttttgtagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggttggttttgtcatttctttttttcgctccctgttttcgttagttttattaatttataattgctagttaggcttttttgctgaaagtaatttgggattatttttacacaggcttagttttttcaagtgaatttttaataattatttcccatatacttgatagaatcaaataaaaatagggtatgtgctggattttagtttgtttttagatacgttattttgaagaaattagacttttaaaagtatagtaggtgacagtattattaatgaatacagtgtattccagggttctgatgttttgagttgagaacatttagaattagcactttcttgattttcctttgttagaggatcctaaattattcctgacgcttaaattaactggggagactattggtaccaggattagtgtatgcaattctattaaataacaacctgaactcattatttgtgagtgagaattgatcatctttcccaggtcttgtcagagctgatttagatggaaagttctgattagttagtattgacctatatgtcctttcaggaatacatttaattgtgtcagttcatgtaacttctattaggtactgaataaagagctaagcaaattgggtaagccaaaagtaatgtgccaaaatattaatttatacattgtttcaactttacctagaattttgttgaatagttatcacacttagtgcatttttcagaaattaatgtcacagtgtaagggcaggtaa

SEQ ID NO: 68784 - DNA, 1230 bp, Homo sapiens
attcaggaatccagtcattgccaggatatctaattatttgttgcaaaaacagcttagtgcttctgctataacaatgattaattcaaaaccagatttttctgggaagaagatcccattatttttgtattgcatatagtggaaatagcagtaaactgggaggtcgtgaaacttgttgcattttcaagctttgtctaatgtatgtcatcttacttggcaacttacttcgtaaagtgaaaagactactagtcccttatgcttcctttctggaattagttctattgtactacttatttacttccgaaaatactagatattcactcattgatattcttctcgtgccctacacagcatgcctgacgttatttctgttttattttcttttagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattacgtaagtgttacactgagaaaatctggtgtatttcatggttttaaaagatatcttagacttttatgcaaatccactttgaacttcaactcctcttctattaaaagtaacaaacaggtaggatgcctgtctgtcagtgagagtgagaattcagtggcacatgtttgtagtagctaagggagtatatgtggccttcaaatataaactgtataaaattagatttgggggctactctgattctcttccaaaataacatttaaaatatagtaacattggtatttctagaaatattttagaaaatttgaacatgttaaaagtaaatatcaagtgaaagttaagtaatctatctactccaaagtagtgtgtgtacctgagctgggaggtagaggctgcagtgagccgtgatcgcgccaccacacttgaacctgggagacagagtgagaccctgtctcaaaaaaccaacaacaaaaaaaaccaccacaaagcaatgtgtgtggataacaaagcagtgttgctttttttttttttttttttttgagatggagtctcgctctgtcagccaggccggagtgcaatggcgtgagacagggtttcactgtgttggacgggctggtctcaaactcccgacctcaggtgattgcctgtctcggcctcccaaaatg

SEQ ID NO: 68785 - DNA, 1954 bp, Homo sapiens
tttttttatctttcttattaaaattttctttttataaaaggaaatgagggtatattatagacatattggacaaaattaataagcatcaagaatagaataaatttcattgaaggagatttcattatgtgtacctaattcacgtatgtggccaatggctgggcgcagtggtttatgctggtaatcccagtgctttgtgaggctgaggcagaaagattgcttttagggcaggagtttgagatcagcctgggcagtatagtgaatcctcgtctctacaggaaaacaaaaaaagaaattagctggttgtgatggtgtcgcctgtagtcccagatactcaggagactgaggcgggaagattgattgagcccaggaggttgaagctgcagtgagccgtgattgtaccactgcaactcaagcttgggtgacagagtgagaccctgttcaaaaaagtcaaattcaaatgtgtatattcctaatgttttggaaattgattaatccaaatatcaaaatacattcatttgaattttcttgtagagttgaatttctttgaattcagtgttatggccgcatgcatttttttttttttttttaatggagtttagtcttacagggtttttatttatttcttttttttttttttaaatggactttaatcttacaggttttgtttctgttttttgtttttttggttttttttggagagagagtctcactttgacgcccatgctgcagtgcagtggtgcactcttggctcactgcaacctctgtctcctgggttcaagcgattcttgtgcctcgttctccggagttgatgggaatacaggtgtgcgccaccatgcccagctaatttttgtatttttagtacagatggggtttcaccatgttggccagtgtggtcttaaactcctgggctcaagttatcttccccccttggcctcccaaagtgctggaattagaggaaggagccaccgcactgggcccttttatttctctcttagtaaagaaacttgctgtcagatttccagcaagtcaaaatcaagtatgaatttcactcattgagttaaaagctagccagtgtgttctgacaaatttctaatttgataagatattgccactgaaaatgtttaatttattcctcaattcatgtttaaaatttaacactgccatttcttatctgggactccaagtcctgctattaaggttgatagctgagcttccctggcttctgggaaacttgttcacttaacgtggactgatcaaagtagcagaaaatgccagaatgtgaaggcacatggaagtgtaaatctaaaattaatgttactttattattgacttgttttttaattcatagtctgcctgatgtgtgggtgaatgaaagtgaacgacatcagttaaaaactaaagtagttcatttatcaaagctacccaaagatactgccttgcttttggacccaaacatatacaggtaatttaattcttgcctttatgttttactttttgatttgtaattttctctccccaaattttggataaattaggacttagttttaagtgctgaattttaataccaagcatatctcattacttcctggcttttttttttttggatgtggactcacaaagagttaaaaattgtagaatccagaaaaacagtattttgctaataaagtttatatgcttgtttaatcccagatttatcttaagtatgttagattgtaatatacatagtaatttgaaaataagtgccctttaacaaggtaattctttttataataacagacttttgtggacctaagaatatgttgcatgagtctgaataccaaaactgtttgattttttttagcttaccctttctccaaactttccaaaagagcaattcaaatattatttgttttttaagacatagcttagagtgttcacatttctagtaattttatgttttgagctttttttagtg

SEQ ID NO: 68786 - DNA, 1068 bp, Homo sapiens
attttagctatcataaagatagcaaattttatattaattaagtgctttgaagggtatattcattccacgatgcacctttttggagtgctattcacctggagatttcctgtaatttgagacattattctgtgagtgaaattccaacataatgggcattgctatgtagaagcatagttttccctattacaataaaaggtttttttggctgggcccagtggctcatgcctatcatcacagcattttgggaggctgaggtgggcaggtcgctgaagtctaggagttcgagaccagcctcggcaacatagtgagaccctgtctctacaaaaaatacatggtggcacatgcctgtggtcccagctactcaggaggctgaggtaggaggattgcttcagcctggaagttcgaggctgcagtgagccaggattacaccactgcactccagcctggctgacagagcgagaacctgtctcaaaaaaatttttttcttctcaaacatcttttggtgaaagtgctaattaatacaataaaacttattctttgtggaatgaactagatcatcaaggagaagaagattgagagtaatctaccaaaaatttgggaaggttacgagttacttctctataaagaaaaataattgagtgttgttgatttatttgtacctaatttagagttatttctgtttactctttggagagatgaattaaaattagcatcctaaaagagtgatattttgggagagccactcttgccttttagaactagtcgtaaacctctcttagagagttgtcaaagggccatgaatcttaaattaagattaatctgtgtttctgcctgcatcctgcttccttctttccaagagtcttgctttctcaccaaaccagcttattttttttctgttcttatgccatataggaagcaatttagacattttagtgaaagtgacttaaaacaaaatttaagcttgaactgatgttctgaagtgcataggaacaatgttgcatatactcaaatttatgtgtgtgattccacaagtcttgttgattttattcttggaaatgaggttgttct

SEQ ID NO: 68787 - DNA, 5225 bp, Homo sapiens
ccaatgtgctgggaagattacaggcatgagcctctgggacccagccaagcatcagttttaaagtattagttggctaaaatatatgtattacacatggaattctttcttagaaatgcactagcaggctacatttaaaacttttattaaacaactatattatgtaactaagtatagatccatatgtataaatgttttggaaatacatttttattataatctatgatcatcacattgcctgtatcttattaatatttttaatgtctcttgaagcactcaaatgtgtttgattcagttgaataaaaggatttctttttctctttttctagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctgtgaatgaagtagactcttcggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacattgcataatttatttattgaatcaagtttacgtggtctaacacatggttctgttaatctgaaaattgaaaaggatttgtaagcaggttagagcaggaattgcaacccagatttttttttttctaggtcagaattcttttcactataccaaactgctgctcacagtgtgagaacatgaatgtacattgtgataccactataaagttgtgtccagtgtttctgccacagccagtctagcatgatcattcatggcacaaaatagtctgtaaaatttgttaaatgagtattataggtgagtaatttttacagtaaaatactttggagaattaacagtgataaaacagtagtagggttgaagtgacctggcttaagccacattctgtgatagtgtcaggtaccttttcataagaaccttatatacggatatagtggttcatgcttgtaatcccaactacttgggagggtaagaagggaggattgcttgaggccaagagttccaggctacagtgagctatgattggaccactgcattccagtctgggtgacacagcgagaccccacctctttatttttcgctacggagtcttgctctct

SEQ ID NO: 68788 - DNA, 1121 bp, Homo sapiens
ctcttcctgtttttcccctcttctcttcaaatgcaaggaaagggtaatcttaagattcagaagagtgatttgtttttccccgcgtagtgagcagttttctcgcccccaactaataaaccatctattcttttcccattaagcaatatatatcacataaaaatttcatttagaaatgagcctgtctctggcagattcaccattttaataagaggccctaaacttttccatgctttccatgaaagctaaaggtcattagcacagaaggaaaagaaagagctgtgaaacatatccatactctgtcaatgacctgaggtggggtaggcaactgcaactgcaagactcatcaattgaacatatgtaggtttttagtatctagtagattacacaaaacacatacaggactttgtaaatttgaagggagaaggttggagaatatggcaaaggaggatcatatccgtactagtcagctaggaaaaacaagctgggaaaaaatgagaacagagtagatgaattgcataggaatttctgaaatattctaagaatgccatggattaaataggattttatgaacttgcctgggaagctaatgatcgtttctatgagaaaatgtatttcacttttcaactcaggatatctggaacatatctctctttgtcacagttccagaagaattcccaggaatttagctttccctttactctaatctcagaaggagctataccctctttgaagctccatagagagaaataggaacaaacttacccaaaacacacggtgggtatgagtgctgatttttatccccatggagaaagggaattttacagcaatgagcatagggtctctggtgaaaggtcatatccatacatatctttatagaaaaaaaaaaagaaggcttggaaatagtgagaacaaagcccagagcccagggcttggtgggaaagcaggccctggctccccttcctgcatgtgagttttgacttcttcctgtgctggtcagggctgcaaatggctgataatatcactgaagcctggactatcttcaaagcccgactggcacaaaatgacatattaatgtagtatctcatttcctttgcattctggggacaagtgggattggctcg

SEQ ID NO: 68789 - DNA, 1042 bp, Homo sapiens
attacaaccccaagtgcctaagctcttatttttgctatatgtatttttaatgactgaagattaaggtcctactgaacatggagacacgtaaaaagtgttgggtaaatggaatgaatgagagaacaaacctgccatcctcatacagtttgattattgcctctcttgtggaggtagtcatgtctaataacccatgggacatttagacaaacattagcagactccatgaccaatataggaaaaaactcatactaaagctgctcctgcaatgcacagattgcctcaggaagtgctagtgagttttccatcatttaaggccattcaagcagaatatggatggcctattgttccttcagcggggatttctgcacagggaaggaagtttagattgtctggaagagtctatgatgcaaaaggcagatggggaatctatatcatcagagaggagagaggacaatttcggtgggaatgcttaagtaaggcctgagagcatttagctatgattttcggcacatcgactttggaagagagtatgacctttgctgggcttatagacaaaaatgaatgagtgctgtgatatatcttcaaaaaagtaacactggttaatcttacatggaaaggataccataggaaggccgtgtgtgtgagtgagatacagtatgagtggtctctttcccaccctatacccaggacagttcacatagtcaaattccactgggactctaattgagagagcagagctgtttttcttaatgaaattcaagttttccccctagagatgagctcagaacaaaaatgggactatgttttcttatagaacagctcaatacaggtcacagtgggataaatttcacatacttaattgaatctttttgtgaatggcattctttaatgaatttttaatagaagatacagtgttttcatttagtagcaataaaaagaattgcttcctaaacattttaatagagaatttatatattgaaagctgtaatgcttactcaagaggttataccatgtttattccccaaaagcagatagtgtatca

SEQ ID NO: 68790 - DNA, 1042 bp, Homo sapiens
aattatcaacaatgctagactggtgaattatctatagtacttcattgttgtttaaatttttctttgactactaatttattggccatatatatttttatttttaccatttacaggtgagtcatcctgttctctttcacattgtttcaatctggaacaatatgaagagtgacatgttttatatgaactaatttcctccaagttatctattgtcattgacttgtaaactcactggtttcctgcattcttgtggatgtgattttggagccctattattaggacttttgcagtattggtggagtcacacaaaatgacctaaagatactctcagagatcagaaggagcatgtgagtttcaggcaactgcattcacacttcctgggacacataaatggaaaaggtacaaagatacagcaccaatactaactgaaacggcccttttatcatgaaacagctttaattcaatatacaggccatgagtgatatatagggtggcttactcattagtcattcacattcatacacagaggaaataacagaattgataccaactttgaacgaaagaatagtaaagcatatgttattttccatatagatcttgtcttcgcctatgcctaaattcacagtatactagttacttgctttaatattattattattttttgagacagagtttcactcttttgcccagggtggagtgcagtggtgcgatctcggctcactgtatcctctgcctcccgggtttaagcaattctctgcctcagcctcccgagtagctgggattataggtgcccaccaccacaactggctaatttttgtttgtatttttagtagagacaggtttcaccatcttggccaggctgatcttgaactcccgacctcatgatccacccacctcggcctcccaaagtgttgggattacaggcgtgagccactacactttaatattttaataactgtcttttccatacaacttcacagcatatcattgtgagaaaataaaacatccttaaaaccaagaataaatgaattgttaggagactatt

SEQ ID NO: 68791 - DNA, 1137 bp, Homo sapiens
caccgtattttcctgattagtatgtacatgctttttagaactggagcttcttgtgcccagcctatcactacaaacacagaaatgttgtaggctttggacatttcaatttgtgcaaagactatcaccctatttaagattagatgttaagcacggtcctaaatcttacagggcagatgactttttactcttggtgctgaatcctaccgatgaaagatattactgagtcagtacagacttcagcttctgtgtaaccctctaacgatccccagggcaatatactgttgtaacctttgatcacacttaaaaagtacatgggcaaggttcttatccttgagcagatgagtgcttttcatatgactagttaaaaacttactttatcagtagagacaatctaggctgtcgagagaagttaaccttgtaaaattatcaggttgagttccactttgatgtttttcttgggttattctagatgcttactatagtttgtcttttgtacagttaatatatgtgtgtataaattaggctatattcaatgatgctagctagcatcatcgtgtgtgtgtatgtatacatatatataacatatatattctcatatatatatatatatatatacacacacacatacatgcattatacatatatatatatatacaattccggaccgttgactctggatcaagggtccggaagtgcaatccactgttgattctttgctcacatagttaagtttcccacattgtacaatcttcaatgctttcactactcttctagacttgtgtttatatatcatagtaaatttttggaggacttttttttttccgtttatgtatgtgttacttttcctgaaaaacatcagtgctgttgtatcacaggattggagggaaattaaaggtagagctcaatttatgaaatgcctaacaagtgatcattgttaagcttttgcctaatcactaccataatagggaactaagtccccttccatgccattttgttctccccttttcccctcctctctgtttagatatggtcttttgaaattgaggagtccagaatctggtacaacagatatggtatgactggaacaaagcgaagggtggctgtcacctcttttgtagaacaataatttgtgaacct

SEQ ID NO: 68792 - DNA, 1219 bp, Homo sapiens
gcaagaaaacatcaaaaatattttgtatttgatgaattattcaactaatgaaaaaaaggagttcatgaccagcctggccaacatggtgaaaccccttctctactaaaaatacaaaaattaggtgggcgtggtggggcacgcctataatcccagctacttgggaggttgaggcaggagaatcgcttgaacctgaaaggccaagattgcagtgagctgagatcgcgctgctgcactccagcctgaatgacagagtgacaccctgtctcacaaaaaaagaaaaaaaaaagaaagaaaaagaaaaatagacttttgagggtaaaaaataattaaagcctaaccttataataaatggtaatattaattatagatttaaaagacaaatttttaaaaagacaaaactgtaaatataaaatagaataaaatccaggtaaatactcaacctatcttgggaaataaaaaaaaaattaaataaatctaaatctttttttattttttttatttttttttttttatctgtgaaaaacatttattctgagaatctaaaatctggacaaagtactggactttagaaaaagcctacacaaaattgtctcattcttccctaatacattaataatctaagaataaggaggtgaaaaaaaaccctttaaaaataacattgctccagtttgtctgcaggtatgtgatttaaaatatccctgttttattgaggtataggctgcaaactttggtaaaattagaaaaattaacaaaccctttcaaaaaaaaaatacaaaaacaaaaacaaccaaaccctaacgttatatctttcttggtacatatacagtaactacaaaaaaattcatttagaaaatgtgttcattaagagaaaaaaaaattaaaaaaaaaaccctcttgtaagttctcacttgctgagttaaaaaaattgaatgtaaatgatctataaggctcaaacggttcccaagcacccatccggtgtcaggaagaactggatgaccgcagtttctagaatctggttgacattttcaataattcagtgctaacaacaaagactgtcgtctttagaaagaaggaacgaatcaaaggcacttgcacgtgacttcatgtgctggcgtccgtccgtggccgccttcgtcggacagcgtcagccacacgcctggccccacgtggagcggagtccccttgaggccatttctgcgtggccccaactccctgctct

SEQ ID NO: 68793 - DNA, 1033 bp, Homo sapiens
agcagggagttggggccacgcagaaatggcctcaaggggactccgctccacgtggggccaggcgtgtggctgacgctgtccgacgaaggcggccacggacggacgccagcacatgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggttttttttttaatttttttttctcttaatgaacacattttctaaatgaatttttttgtagttactgtatatgtaccaagaaagatataacgttagggtttggttgtttttgtttttgtattttttttttgaaagggtttgttaatttttctaattttaccaaagtttgcagcctatacctcaataaaacagggatattttaaatcacatacctgcagacaaactggagcaatgttatttttaaagggttttttttcacctccttattcttagattattaatgtattagggaagaatgagacaattttgtgtaggctttttctaaagtccagtactttgtccagattttagattctcagaataaatgtttttcacagataaaaaaaaaaaaataaaaaaaataaaaaaagatttagatttatttaattttttttttatttcccaagataggttgagtatttacctggattttattctattttatatttacagttttgtctttttaaaaatttgtcttttaaatctataattaatattaccatttattataaggttaggctttaattattttttaccctcaaaagtctatttttctttttctttcttttttttttctttttttgtgagacagggtgtcactctgtcattcaggctggagtgcagcagcgcgatctcagctcactgcaatcttggcctttcaggttca

SEQ ID NO: 68794 - DNA, 1049 bp, Homo sapiens
cacaggtgtgcaccaccacgcccagctaatttttgtgtttttaatagagacagggtttcaccattttggccagcatgatttcgatctcctgacctcgtgatccgcctgcctcggcctcccaaagtactgggattacaggtgtgagccaccgtgcccagctgctttttttttttgttttttaaatgcttaaaaacagtaggaggacattccaaggggccaataatttacttatcacttagtggaggctccttgtggaaaagattagttcaatttgtgaatttgtaaacatcctaacactttaatattcttggaaccctcaggcctttatttaccaatagtgaaaaactagcaagtttttagttatttagtatattattggtatttgactaccagccagactgtattagctggacttaaaagtacttacaagaaacaaatttttgtgttgtccatctggttttcaaatgattgaagtctttctttagataataaaattctggtttgtatgattctaaataattcaagtattgtgtgtaaaatactggaagatagctgagtattccgatggaaaaaaagtgattaaatgcacactagactatcatcagtatgcttacaaatgacccatggcctattttggagcaggtctttagtggtttaacaagtcctggaggcaacaaattgtaaaaattctagactaaaagcaactacctagatcagtgagcctttatagcataatgttaagtctcaaggatgaattttgatgaggagtcattgtgctttacttttttgtctgtaatttcaagggaatggatctgattgtaatacctactgaagttgattaacctaatcatttgcctactaatggcctgatgcagtgacaggtcacttcttttctaggttaaatcatttgtttttgataagagaatgtggagagaaatttaaatgccttttcatatttatctggagtaatgccatatatatttattgaagttaattccttttaatacattttggaaagatgaccagccgtatttcccaggaatttgttc

SEQ ID NO: 68795 - DNA, 1043 bp, Homo sapiens
gacttgtatcatataataataatgaggacatagccagaaggaagtttcaagttgcagatctgagagtgaaacttttttgaggaatgtgccatgagaaatccactataagatggtattgctttagaattcctcccaaaacatgcctgtgggatgaattaacaggaccttggttatatcacgacctagtcaatggcatgatcccagctgggactgcctgtgctgttacagcaaatctctacctgtgacccagcatgaaagggaatttggaggccagggaaagtggctttaaattatgaggcttctttttcaacatttacagaaacaaccatcatttatatgtacatcaagcttaacttcatataaattgtgtatctagtcaaaagtatccaaggcaaaaatattcaatcttcaggcttttcatagacctagaactctttatgtgggcatataactgtactataaccttatacttttatttatttttagggcttgtagaaacaggagctattattggtcctttgattggacttttgttggcatcattctgtgcaaatgtttatgttgacactggatttgtgaacacaggtaattcaataaaatctatttgtacagtgtctagactatacaaagcatctcaggtatgttatcatatataatcatggccttacttgaccttcaatttgataaatgatctctactttaaaagtgagaaactctagtggaggaatttaaataacttttaaaatattccaaaccagaaagcagtagtgcaaaataaaatgctaatctgacacagaatcacatgctatttctagtgcacttcaactatatttcttggttttacaaaatttaagcatgtaggtttgaatttatttcaattaagcaatcatttgttgatgatgaaatagaactttaagcaatcatttgttgatgatgaaatagaacttgtagctgtttagttaatacctgcttttaaatcccttacatgatagacagataaccagcctaatttattactagacaatattacaacaccacatatt

SEQ ID NO: 68796 - DNA, 1038 bp, Homo sapiens
gagaagtgtcctttacattttttagtgaattagagatagtatgttttactttcacgtctcttgccaaaaatttagcagtagctaatggaaagagtttttgtgtttgtttgtgctatttgtttttacagcagctaaatgcaaattatttttaaagttttgtcagtgcctataattaacttttgttcttgtcagttgaaattctaaccagattatttaaaagaagacttgtataaaatttctacatggattatgctatgctggattactggttttatgtatttgttatggaactgaagaattaatttgagttataaatgtctcattggatgttaagtgctatgatacagtttaacaaggtttgtaagtcaaacacttggcacaaacattaacccctaaatcattcgaacaaagttgagcatctctcatagtagcatgcatttatgtttaaatgttttctaaaggctactatttatatgtggtttttcattcagtattaaagaacaaaagcaatatatctctgatatgtagttttagacccatttatgttattaattaatataaatttaaagccaatacatgctaggattaaagattatcatattttttacttatactaaaatataccccaaaagcatttggtttgctcgtaaagtcattatttgtacttaagaatataagtactattttttttaagcacttctagtctttttagattaagaagacataccataacctcttgttccactcactgcttttctgtactcataatagatatgaaggtaggatatggttagaattactaggtcttcttacagtaacttcccttgagatcagaaatcttcatcaaggcctgtcacaggtataatgagaatgcttaaatttaaaaatttcttgaagttttgtttttaacgtggggtcaacataccttttcaaccaacatgggattccctgaagtttaatacaaaactttgtgtgaatgtacctttttatgccaggggagaaagactagttttcaggagatctcaaaatggttcatga

SEQ ID NO: 68797 - DNA, 1089 bp, Homo sapiens
ttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaatacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtg

SEQ ID NO: 68798 - DNA, 1024 bp, Homo sapiens
tttttagaacaatgtatttttagcagtttgacacttacttgcatatggagaaatttttacttatgttctgttatctgaattgtttctttttatgtgtgttaagataatttgatgttcatctttgcctcctgaatttttaattagtgatttcaaatctataacttaactggattatagacacattttttaacttagtagagctgattattgatgtctctttagagttttttttaatttgagggtacccattacaaattaacttccacatctctaaaatttctagatgtagtataaaacattgcctgctaattttaccatatgtcatttttgcatattttgaatttgtaaatgtaattctgcaatctcaaggtttctcacaccacaggtcgagatgacatgaaagcagactgtattttgtactacggctttggagatatattcagaataagttcaatggtggtgatggaaaatgtgggacagcagaagctttatgagatggtatcatactgtcaaaacataagcaagtaagccacatacctttttataacttttatcaattaaagcaaatatgaaagtatatgacatcgtttttaagttcttactaaatacattggtggaacaccaaagtgcagatccataaaagcagatgttggagggtaggaaccagcacatcaacctgtatgatctgccttagttcaagaaaagatgccctatctttgagataatcctccaaaactacttttttaattgaaggtttttgagacacattgatagcaacttgaaggctttttttctctggcactgctgtacagttacatgatttaataattttgaaaaggtctatggttaagataggcattttgagagtcaagctcagtaacgtgccaccttgccagctcatgtgtcaatgaaataccaagtttctccttaagaagtaagtttaaatctacttagggtggctttagactagatagcttcctgaaagctttctgtcatagttatctttgtgcttttattgcctatc

SEQ ID NO: 68799 - DNA, 1119 bp, Homo sapiens
atattttaaaggtaaattaggcttctatggaagatatagacctaacctgaatttcattggctgaccattttctatgaactgtggtcttatcttctggctccaaattggcatggtaagcacctgcatgaattcccagattctgcaaactaaccgtaacttgttcagagtctttctgagaaaaacaatatatgattcctgcagtaaaatatgtgcatttgttagatagatatggcatattcctggaagatggttttcaacacacacattcaggacattgattaatacaatgcacagaaggaaaaaaagaattatgaaaaatttcaaggccttgtgcatatattgacattttggtataattccagatttgagcaccagcttcctttaaagcagaaatgagcctgagccatcagtttttgttcctgttatctcttttctctctttaactttatctcccactaaacagtatttctcaaactgatgtctgtaagatgctaacaaatgtgctatgaatgcagtgttctccagattaattttgggttaatttagattaatttgcatgcaaattaatttggagaacattgcattcaacaaagttaaatgggtgtctctctttattttcagggatggtcagagcttctagtttgctgatacaccctgtgaacatccaggcagaataaatacctgcaacctttctcaaattcatttgaccctagaactccttttacccaggactacctcctgaaaatctatagaacagtttaaaatgctactttcacacaaattctttgcttcagtaacatttgcttagtcattaaacccagaaaaccatgtatatatactcacaactcgatctgtgcttaatctattcagtatgtactactggatttatttattgctttaacgtgtcctttactgtaagggagtatattttctatccctttagaatatcagttgcttaatccactattttgtacacagtggatacatactaaatatgtgctgttgataattaacattaagtcatcaggtctattctaaagcaagtgtaaataagcaaaaataaatcaggcaatttgacgactcataatctatggcataagcaaatgtcacacccaattt

SEQ ID NO: 68800 - DNA, 1107 bp, Homo sapiens
accaaatagcaatggtttgaagcaggtaggaattgaggaagtggaactggtgagtatgggattctctttggaaaagaatgactatgaagggaagaagagagtgggccataaatgagatgttatcttagtctattccagctgctgtaacagaatactttatatcagttaattaacaaacaacagaagtttactgcttgcagttctggaggctgggaagtccaagatcaagatgctaatagatttcggtgtctagagagggggtgtttctcatagatggcaccttcttgctacaccctcacatggcggcaaagaaagggcactcccttcaactttttgtaaaatggcattaatcccacttatgaaagcagagccctcattacttaatcacttctgtggggataccaactttcagaccatagtgggtgttttccaagatgagagggacttgaccatgtttaaatgtaatgagtaggtgctagtaaggaaaagtgaaaataataggagagagaataattgactgggaaaaatccctaataaggtcttaatttgattatgttttttaaacatgtctgctctttgccaaaggttgttttaagaaacaaactacagaaacgtaaagccatatataattttaactgtagaatagcttttgtactttaaacagtttcaattataaggaagggggcatattactataacttcattcagacagtaaactgttcactgatttctactcagcataaatgaatctcgtacaaaaagtaaaagaatgcttatgcaactatcatgtttaattatacacactactgtataattaaaaatctggtttttttggaaagctttatagtgatttttccctgatgaaactgtttagtgtttgaactgatatatgttgtcttactgaaattaccaatagtgattatttaaaacgatagcaaattaaacatttgaaatgataaaaatctgtctttatttttataaggatagagttctgtttagttgtatgtttatttggcttctacttaccttgtttggtcatttattcatatctaattaatgagagtaagaagtaagctttactaaagctgcattaaaaattaatctgaa

SEQ ID NO: 68801 - DNA, 1002 bp, Homo sapiens
cagatattgtgcatttaaataataattatagaatgtgaaaggagataagtaattaaggaaacctatacatttatgtctgatgcgagagagcttttcaggaggaaaaaaacaaattacatattaaaaccaaaggtttagaatcccgatttatcttttttattatagctatgtctgagaaatgctatctcccatataaggcttagaaattttcattcatgttttaaattttgaaataatttgctgataattaatttgttataagagctaaataaatgtcattatgaagttaacctgcaatgttgggtacctgttttcttatacctatgaaaggaaaactggaaaattttcttagtttacagggatgttaatgtgactttaatttttctctacccttaaccatataccttatattgcagaaattggaatgggattaacaggatttggagtgtttttcctgttctttggaatgattctcttttttgacaaagcactactggctattggaaatgtgagtttttaaatatatattttaactaaatttataaggaaattttaactacgaatgaattattatctgctattaaatttggggaaaataattcactattactcataagtaattcctgttacattctctatttccatcaggaatgaaacctgtcagctttctgtttaaataaaaggtaaacacttaatgaggttttctaattccataactactctgttaagtgtttgtcatgagatttacaatagattaaatgaaggctgcctctaaataggagttcaaaatagatgacttgatagtttcatgtcttgataaatcactaaagtatttttactttaaacatccaagacttcacatttgattcagctgcataagatagatttttttaacctttttaaaaatatatatttctatgttaatggttgacttgcttagaaagggatctatgttgtttatttggaatgtgtactatgctattcatgtgtggaggttatgat

SEQ ID NO: 68802 - DNA, 1003 bp, Homo sapiens
aacttagccatgtcaatatttctcccatccatagaaactcctgtagcctatgatgaatatttcagaaccaagaggaatacccttgggtgacatatttatgggcagctttcctctttatgccttgccaactcatctgcttgactaagccttcctcatccagctaaaactaggaaaactactgcagacacagatgccccttggtaacgtctaatctttctttgtttctctttttctccatttaatcaagatagaagaggaatgagacaagtggaacaaagctacaactttaaaatgcataacccactccttggttctgctgcttggttgtacattacagttctgtctggccagttgcccacattaaaagccaaacaaatgtgcttctttttttatatttagctttgactttacgtttaaaatttatgcattgtgtttaattaccttttccgtgttgtattttctttctcttttaggttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggtaaggcatattattgtctctttcagtaaatcagtgtgtcagatagttagtacaaaaactcagatatttgcatcagttggagtaagatgatgatcatttccttaaatggaattttatttaggttgaatcttatagatttagatgaagcaactataaaaatgttttatcacatgtgaatgattgcctaatggtataaattatcttgttttgtcagcacaataaagtttattttattggcattttaaggcaccatctttatgttggatatttgtatcaactaaatagtggtaggtaggtcggtcgatcgatcaatcggtaggtaggtaggtagatagatagatagatagatag

SEQ ID NO: 68803 - DNA, 1780 bp, Homo sapiens
gtcaagaccagcctggccagcatgatgaaaccccgtctctactaaaaattcaaaaattagctggccatgctggcaggcgcctgtaatcctagctactcgggaggctgaggcaggcgaattgtttgaacctgggaggcggaagttgcagtgagccgatcacaccattgcactccagcctaggcaatagagcgagactctgtctcaaaaaaaaaaaaaaaaaaaaaaaaaaaacagaaaagaaaataactttaagtagggttgagcttaattatttattccagaaatgcatatcctttgtcttctgtctgccaggcactgtattacccacaggagacataaaaataaattaagtaccaaatctgctttagaaaatctctcatttctattatggaaagtagactctaaaaataccaataggatatagtcataatgccattataaatgtgtatgcagaatattgtggaagcatgattaaaaaattagtaaattcaaggagaggtgagaaatgttaactgataaactgggctttgaagaatgggtaagaatttatcctataaacgagaaagggaacgacagttaacagaaggaacagacagggccataaaaacacacagcttgttctgaaaagaatgaatactcttatagaacaggagcatgtgatcagttgaaggaaatggttggtaatgaaactgaaaatgaagcctggagccaggttacaaactttctttgatgacttgttgagaaaagtataccttatcctgtaaccaaatttgggctgggggagcagtgtttggagaaggtcgggggagtggggcacagaggtttttaagccagaggtggtacaacagggtagatgttttaggaaggttgttctgatatcaggataaagtaggtattaaagagaaaaactgaagtcaggggagccagtcaagaggcggttaatacagtacagaatatacagtgataagactggaatcttggagtacttttgacattttagggtaggtggagaaaaagaagaaaacactagaagagactaggaaaagaggtgggagaagaactaggagtaaagatcatagtggctaagagagaaaagagtgaagaagagtttgttttggcagatgtatcttgcagcagaaaacttaagcaccttaagaagtaagaaaatcattggctttcccagttatgtgggggttttagtaatgaaggttaaaagccaaagctgatctttgagatgaataaaaaatgggaagtcttagtatcatcgacaagcttggagtaatacacaggtttcgtggtttagagagctttgtggtataaatactagtttttgttgttgggttttgttgtgttctgagatattctgagctggagatttagtgccaagggtctttgatgttgtttttctagatatttataaccctaaataatggcatttgaaatcacacatttttatgttttaaaacaatacttaaaacaaaataaatgatcttttgaattcattactactagaaaatgattgtgattttctttgaaacacgcacatacaccatcaacataaatacttgtctaatttaaaaattctgctttctgtttaattctttattttgacttctgcagatccataacagaatcttattgcttaacttctgaattgtattcattgtagtattttcatccctatctaactctgtgaagaaaacagctttttttctgtactcgtcttaccacaatcaacacagaagactgctgtgaccaaatgggtggggggttttcccga

SEQ ID NO: 68804 - DNA, 1298 bp, Homo sapiens
catagggcaaggaaaggggggagggtcgcagatccccccccaccctccccaacccaccatcctccaagaacatccttgtgttcagctatccggaagctccctgaacactgtccttttgggtttttatggaggcttcattactaggcatgattgattaaattattggccatgagtgaccagcttcacagcccccctccccttcgtggaggttaggaggtagggctcagatttccagccctctaatcttgccttggtctttctggtgaccagcccccatcctgaagctgcctaggggctgccaaccattgatgataactcattagtatacaaaaagacatcaccttgtagagactcttaagtattttaggagttgtaagccagaaaatgaggtcaaagaccaaatatatatttcacagtatcactacatattttaagacccaggaaaagtttagtttctttgcatttttaaaataaactatttcattctcttcctatactgaggtagcttaactgatctactgtcaattttaaactggttagaagctgtttaacttctgtagacttgtatttctaccaagaaagaatgagacatactgtgaggatcagtatctggcaggtagtctcttagtgttaactaaatgttttgacccttagtacttacttagtaaatgatagctattattattttcatggttctacacatatggtctcaacagcccctttctttttatcagtttcaccccacacaactcatagttggagaaatcttcagcagttgagctaactcataatctgagttatatatagctaggcctcatgtacttgtcacatttttaccaacaatcacaaaatttttaattaagtttgtagttatttctaagtttgaagaccctcaattattcagaattttaacaggatactttctttttccttggttagcaattattttgaaaatagaaaatgtgtaaatattaagaaccttttttttccctctcccaggggcttctttcctgtcgttgttggctttattagaagagtgccagtccttggatccctcctaaatttacctggaattagatcagtaagtaatcatgtatattttaggccaacaaaatacgtattttgatgctttttacttctagaaatttgagtaattgatacttggttaattgctgagttttgtattatgatatagttacttcacatagatcatgagtaccatgaagaccaaaaaataattattgctaaacctataaaatgtgaaattttgttttaccgtatccatttctggatccata

SEQ ID NO: 68805 - DNA, 3036 bp, Homo sapiens
agcgatgctcacaccgccacactatagcctgggcaatagggcaaaaccttgtctcaaacaaaaaagaaaaaagagaaaggaaaggagaaagggaggcacttccatgtaaaactacagtccttgagggcagagacaggttgtattttagtcattgttctatccccagtgacccagcataatatctgccgtataatggaaactcaaaatattttctgctaagcaagtgagtgaaggatggcattttgttgacctcagggaacttgctcaatttcaagacaagaccagatgactgtctcttagcctacctcctcagtttcaaaactaaacaaaatccttaatttctaaaagaatctaggtgatctagaattcagctgagttggctacaatccttttggctctaggtcagacccatatcagaagtattcatatccttctttggattggtttcatagatccaactctgtcctaaataactaggataaactagctttataggaaaacttaaaagactacaagttccagttaggttcagggaagttaatcaactttctaaagttgttcacagatttttatagatgtttctagagagaaagttcatagcattttattgaatgctcaaagagctaaagaatggcttacctatggaagaataagtaccactataagcctaatcccatttccatccccagggtaattttagggtcagaaccttacagccaagacaatctaaatatttcaagttacctttggagagagaatattgtgctttctctccacttaaatttaccttaaaattctaataaatccatgaattctttgagagcaacttttagtttcagtggccagccacctgtttgtgataatataacaaaatgttggaatgtaggcttataggggtatactctgatttcatttgcattaatctgcaaattcatacagtggtcagtgttatttatacctagaatggcttttgaatgtactgaaacttctagttacagagttgtaatcattatttgtgcccttaatttaaggattctcaagaatttgcataaatggacacccaatacaatagaatatgtttcttatcgttattcatcatgataagtgcttatgtaaacatgtgaatcgtgaaacaaaataaatgatcagatgattactagaatttgatagtataaccacctgggttatataacttttaatgtctctaccaattatatacaatatcagtctttacatcaccatctggaatgttaaaaaaaaaaaaaaagcccaactgctttatgtttggggtggagtaaccaaagtaaataaccacttacagtaatgtgtgttaaaatttatattcaataattataaatttatgcttacatcattaaatctatctttaatgtcattaccactttcaatccaaagtccagaatacacatttaaagtatttttagtcaataactgttgttaactattgaacttaatggagttaaatctgtttgtccaaagactacataggcccagaagagatccacagtaatggtcagttgaaatatcttattgggttcattaatgcatgaatggctgacatttcagttttttttatgtttttattttttattttttgttaagctagcagtgttatcttcatcttatacaatttctttattcattgtgttgcatttttcatgttgcacccttaaattcatatgtataacatgtcatgcaaaaaacaacttttagaaaaaaaaattttatacacgtttatgtatcagaagatgatggtgagtagtactggattagtcattgtcagtcataccttaaatttccacaactcttcttgtaaggctgggtttttaaaatcaacattttaaatattgatataatgttttataatgttccgggctttctttaattctctgtttttcttctccttacagtttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaaatgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctatttttaaagggctattcatttaatctgagttttcccttattttcagctttttcctagcat

SEQ ID NO: 68806 - DNA, 1700 bp, Homo sapiens
taaactgactgtggtttcttaagaacatgacactaaaaaaaaagtgttttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaactctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctattttttaaaaatcagactcccagtttgtatattatgttattcaatagacattttctgagtaccccttgaatactaaaagtcctgtgttgaatgtgggagacccaggagaacaagatatgtgccatctgctcattaagtgcttagaatgttaacattgcttttaaattcttagccgta

SEQ ID NO: 68807 - DNA, 1170 bp, Homo sapiens
tcatatatcaaaatttattaaagtgtatttaaatagagcagtgttcaataaaatacgtatataataaaattaaataagtacttgttacttacaaatatctaattttctcatagtgtatgtttgcatattctatgtataaaacctaattcaaaacataagtattggggaaatgtggacctgtaagtgatgaaaattagattagggaatgagttcaggcctatcaagttttctacaattctttctgttggaacatcggacctttgattattctcttttttcccccctttagagattagttcttgctctgtcacccaggctggagagtagtaccgctgtcatagctcactgaagcttcaaactcctgggctcaaacagtcctcccacctcagcctcctgtctttgatcatttttacttacagtttcatgtcttaatctcgatgctttgttgttctggcaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtgcttctgtttctgggattccttccttaatgattcctgaaagatttcagtcagtctgccaagtcattcttaccacacgtcataaatgtccctaaattccaacatcatctacactcctccctctggatgagacaaaaattcttttttgcaacaggtgccacggtttgttgttgttgtcctgagaatatgattatctttttaaggttataactgaagaagttgtaacggatgtcaatgtatatgacatttacaaaggaagcccgttttaaaaggaagaacccctaaaatggaaactttgttagaattctatttaataatgaaggaaaatgaaagtttggtctggattat

SEQ ID NO: 68808 - DNA, 2581 bp, Homo sapiens
tctgatactcttctcctttaaattaagtagacccttatttataatttttaccccactttcataattatgctttatttgggtcttattctaggattttttttctttactgtagaataaaggagcatatattagaaaaatatggaggagaaaagttaaacattcctcaaaccaaaagtttagcatagtccccaactagaatccctgtgatttcacacacctagagagaagcaaagaattttattttctctgtaactatgacacagcaattctgctttgcactaaaattcttgaaagttaaaaggtcagacatgttgctatttgaaggcaaacgtcagcctttttggggaactatactggaatctactggagagtcacttattggagcagttccagttggtattcagtaatttgcatcataggtgaaattgcactaaaagaagaaaatattttttaaaataatgtaagaaataactgcaatgtctttttttttttttttaaacagtggctgtgtggagtggtgtgaatgtggcaggtgtttctctccaggaattgaatccagaaatgggaactgacaatgatagtgaaaattggaaggaagtgcataagatggtggttgaaaggtaagtgaaagggaacttgattttagatgattaatttcaactctacttaaataaaattataaacattttccatggctgtctgctcagataaactcttaatgtagtaattatgcagctgttatcttttgaaactgataagacttttacactggtcaaacttgctatgccagtctccctagggaaagtaaatattttctctagagaaactctattgtagaggtaacaggagcaaaatgtggaattaacaagtgagaagagtcttcaaattgccacctctcaacaaataaggttgatttatttagaaaagtaaacttagaaactattggtttcataattgccccaaataaataaacttgcttgctgattgctaacagtgtttaagttttaataacaggactaactgatgtctcaaatatagaatcattttgttcaattttagtaatttttttttcaggaatttgaactatatgtggagaaaaggaaccttaaaaaagttgaaagagtctttataatttcaattaacatatacctttattttacaagtgagaaaactatggctcacccagatagtgtaactggtccaaggtcttctaatgattgggtgtcaattgcattaaatcctaattttccaatactcagctagagttattcctgctgcttctcaagtgccagggcctttatgggttttaagagctacaatttgtgctgaaaaaactgtcaggcaagatactcttatcccttttattagttagttgattatgttaggtgacagtggcaagtgggacctcacaattgagatatattttgttctttcacttttattgtttcctgattttatgtgtttggaaatatgtttacagatttgttacaatgattggaaaatgtatatttttgccacagtgactttataaatcttaacttatacaataaactaaagttatcaagcatttatatagtgtttactgtgtagtgcttacagttttaagcattttacatatatattaattcatttaacactcaaaaagggaacactaaggcaataaagggtaaataatttgcccaagattatagttagagacagagcagtagtcaaagtcaggtctggtttcaataatgattgagtcttatttcagtgatgtcttttataatttttttaagtgcctatgaagtcatcaagctaaaaggatataccaactgggctattggattaagtgtggctgatcttattgaatccatgttgaaaaatctatccaggattcatcccgtgtcaacaatggtaaaggtaagacaaactaccacaaaatgtaatatgatttctcgcattgtattctacaaaaagattcatttaaagaggctcagaccagataaaatcatagttcaaggttatttctgtctctcaaagttttatgtaaactattctcattttccaacagaagtcttggacagcaagggcagaaaacttagagaatctaagacattcaatagattgttgtcattctttatataattttgcaaattaaatattaactctgaatcttagcacattcttaaagtattgatcatttgaataagtgtaatagagtttcatttaaagttgatgtactaaactctagattgcctttcatatagcacttgataccttagcaaatacagtttaattcaaaagctatggagcaaatgcacaaaacaggtagaaattaatgattttttaaacaaaactaaaattatattaaaatattttgtaagacaactgactcattttccacaagtcagtgtaaatcaagtgtgtcaataattgggtaattactgagtctttgggtacatacataggaatttgtttattctatctacttttgtgtatgtacaaaatttttgaaattaaaagtttaaaaactgacattaaggtatgtttaatataattagttatatagttaaattgaccctgtgaataaattacccac

SEQ ID NO: 68809 - DNA, 1156 bp, Homo sapiens
tttaatactacgtattatcacagttgtttactgaagaatacctcatgcccagaaaaatttgtggtagcaagatttggtagtttagtaatcaaaggcttcttggtttatgatgacaatcattataattatggaatgttacaactgggggaaacttaactgacaacctggttcaacctgttttgtttttttcaactttaagttaattaatctgcaaggttcttaaatattcttgtttcacataataatgcaaatgtaaaagcacagtattgcatttttcatgtcttgcaatcttcatataaggcttaaaagtttgtttttgtcactgtcattcctggtatctctaacaatgaaaagttaaagtatttactttaatctttctggccacatctcatttggggagtggggaagtgggaaaagggaagccagggcaccccaagctgcctaacagttgaagttggttttggtttacttacatatattatttccaaaatttttagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtggtaaagaaaaaaaaaagaaataattacttgtgatgttggttttgccattttgaatttttcattttatttcaaattttatttttatagactttgatgtacttaagaacagttgcaaaaatagtagttacttttctattctattccattttgctttatcatttactctctcatctctctatctacctatcatctatctttaccttgatcaattaagcataaatcaattccctcacctttttctccttaagttctttactgtgtatttcctcaaaacaaagattttctttttcataaccacagtacacttcccaaaatcaggaaatgtaaccctgaaacaatattatctaatccagagtccattattcacaagttatcaactgtctcaatagtgtcctctaaagcttttttcctaattcagaatccattctaggctcacacattacatctactatatatccttagcctccttcattctggaacagttt

SEQ ID NO: 68810 - DNA, 1301 bp, Homo sapiens
atgtagggactataattactgccattttatgggagaggaaccttacaaagtattaccaatcatcaaaagccgcactgtaacccagtttaattatgtgaatcatccatagctgttgagtcaaatgatcacatcaaatcgcaatatccatatatttcgaaaaaggacacacttccttaagaaaaaaatcaaatctccagggaaacttgcagcgctaaaaagcaaataagcttcctaaaaatattgagtattagaaatccaagttttagtttccagacaaaaccaaacacttcactgccttccttcccttcctaaattttaactttttaagataaaagtaacttaaaattggtttttgtttttgtttttttttttttttttttttgatgtctacctattggagtcactgtttacacttcattttattcctgacaattcattgaattcatagccaaaaacatactttcgggtcatctttattttctgaggcagtttgatgtttggattattgcagtgtagctcaagggagaaaaaagaagccacaggaacattaaacttcaagcccttacaatacagaaaacttaattcacatatatgttctagaagcttatgtatggttaggcttttagagcatgtcatataggttatgttataatgaagagttgcatttaaagtacctgtttttgcttttctttttaaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccaggtattattgtatactttaagtctctgttctgttaagttcagtgttttggtgtttctgttgttattgttttggactaaaatcagtcccagtattcatttacagaagcagtttacatgtcttctttcattggccctaaatagtggtgtttgcaaaacaaatgcctctgtcccaggccagatgttcaaaaaatgtgacaagagttttagctaaagcaatttcatgtttttgcttcatctggcttggttatagattctgaaggcttttaaaacttttttataaagattatcctgggatggagaatgaagcattcgaacatagtttcaatttgtaagaaacattttgacatatttgaccttttattttctggaaaatcccattatacagaattgaaacagatcaactttgaaaagaagcatataagaaagccat

SEQ ID NO: 68811 - DNA, 1173 bp, Homo sapiens
caattggaatagaaaacaaaagaaatctgagactgggcaagtctcaggcacagatttggagtgatcacatgaaaaaacctcccaatcctagattcctctgtccataaaactcatcttcctttccccaccaagacatttgagtggatcagagccaccctgaagattccaagcttcaacctgggtttcaaatcctactctaaagtaaactcacactcctggtgatttaagccaaatctaccatctcagaaagcctccaaattggggtgacctcaaggatggacacattgcccaaggttgtttctgggcctgagtgtatttttgttttcaccattccctctccattaatatagacttgtattcactaggcctactcttgaactaagctggtttcctaatgaatctttaagtctacatgttcttaaagtatagtttgtatcatgtgaactgaatcctcattgagtatctaactccatggtaaaattctcaagatgtttagatctttggtgcttagccatgttaaagatctttctttgggttagattgtgagctgacgcatcctagagtggcttagggttctaatgcctgtttttgcgtttacagtctctggctgatgaacttgctcttgtggatgttttggaagataagcttaaaggagaaatgatggatctgcagcatgggagcttatttcttcagacacctaaaattgtggcagataaaggtaatttcacttaatgcccaaagtgatctaatatttttttcatggccccaaaacacatttggaatgcatcttacagcataatagatttatttgtaagtaggaaaggttgaagttttggaacagttatttcaataactgttaataagatatttataatgtagtttagcaaattcagattattgcaaaattgttatataattataaaatgtttccctctttttcctcattttataaaaagctcttacttctctactgtattctactttttatttctcaaatattttatattcacttattaatggacagctacctaaaatgagtttgctagccgtaagtgatcactgatatgtcactaacaggaaataacaaattggatttatcgcattgtttggcttattttaccacgtttcttctataggccaattttctttcatccgtttctagaaactcattgc

SEQ ID NO: 68812 - DNA, 1046 bp, Homo sapiens
aatttttgtatttttagtagagacagggtttcactatgttggccaggctgttctcaaactcctgacctcaggtgatctgcctgcctcagccccccaaaatgctgggattacacgcatgagccaccacccctggccaacacttggatataaaaatgaaaccatcaaatattaaggcactggtggtagtaatttattacttaggaggaggaagaggcagaatatatggctgtgtctggtccacacaggactttagattaaaagcctttttttaagtctgtcacaggagtagagtaaaaataaataggtttttttaaagccattttagtgatacattaagcaagctttcaacagtggtattcttggtatctaagtgaccttgatccataataagaatactgcttttgcagttaatctaaaccttgctgtttcaaacattttaaacatgcttacagcttaagtgaaatatatatatggaaaattcattgtataaaatatgtgaatacagagggagatttatttaagccaaacaatagcaccagtacttagtcacacatcacgcctctccatttgggggatattcagtgctgcggatgcagctaaattcagtgttacaattattattatttaagtgttggatctcttccttccttttcagccgaatatgcacttctcaggcaattctctacacccactgaaacagagacaggatctgacatcctgtgacatccttttctacttaagcactaaattgttttgccctgtggatttcagcagcacacatgtgatgttactaaaataagagtgatattcccagtgctcagtaccttaatagaaccattatagctattattaagttatgttgcattaatttaggacttaaaaaatacaaatgagaattttgtgtgttcttgtcagagattgcaaagaacaaaagcagccttaaaggtgtcaaaacgtgtttaaggaaaaatggataaaaattaacgccagtatttgatacacatggaaatgaggaaatgttttgtacgtgatccccaactcacaga

SEQ ID NO: 68813 - DNA, 2586 bp, Homo sapiens
ttctttttttccttttgagacggaatcgctctgttgccaggctggggtgcagtggtgagatctaagctcactgcaacctccacttcctgggttcaagtgattctccttccttagcctcctgagtagttaggactacaggcttgcaccaccatgcccagctaattttcttttttttagtagagacggggtttcaccatgttggccaggatggtctcaatctcttgacctcgtgatccaccagcctctgcctcccaaagtgttgggattacaggcatgagccaccatgcccagccgggtctcatggttctttaaaatatattctgctttctagaatatcattaggctcattttaagttgtacttcagttcgaaattgcaacagtaacattttaaggatgatttctatttggatttcatatgcagatatacgtgtaatgttttgattctttccttgcagtgcaaaatggcaactcttaaggaaaaactcattgcaccagttgcggaagaagaggcaacagttccaaacaataagatcactgtagtgggtgttggacaagttggtatggcgtgtgctatcagcattctgggaaaggtacatttcaagaacaccatagatgatagagaagttcagcatgtatacacagtttctttgggcaccttggaattttattatatctttaaaagatttctttttttcctgagcaatttgaagttgtagatgtaatcccacttcactttcaaatatttaagcatgtatctcctaaaagaattatattctccctatgtgaccataaatagttactacacttagagaatttaacactgatgcaatactatcatccagtatacactattaacatttaaaattctccatgttgtcaaaatcatgccgtttatagctattttcacctcagtccaagatcatgtgtctcatatacttacgtctcttcattctttaagctggaactgttactcaacctttctttgtttcttgtgtcattgacatttttctagcatccaggtgagttctgcagaatgtccctcaatttgtctgtctgatgttttcttgtaattcagctcgggttgaattttttgggtgggattggaactaggtgatgtcatgtccttctttgtgcagaccatcaggagacacatgatgttcaacttgtctcattactgctgaacttaatcccctggttcaagtggtcacagcaagccttctccactgcaaagatccctttccctcttttaattaataagtaatctgtgccatgcatggctttgtgaggttgtgggaatattctgttatgcccctgaaacttttacctaatggttttattttgaaatgatttcagatttacagaaaatttttaagaatggcaagaaaataaaactttcataaataattcacctacatttaccaattcttaacatgttgttatttatactctctcaccatatatacatacatatatgtgtatatatatatatgtgtatgttcataggtagatttatagatacagagatctatagaaatacatagatgtccatgacgtatttgtctatatctatctatagatggctggaaccatttgagaataaattgcagatattatgccctttacttacatgtcctttagagcagcagtccccaacctttctggcactagggaaccagttttgtgggagacaatttttccacagatgtgtgaggggatagttttgggatgaaattgttccagttcagatcatcaggcattggctagattctctagattcagtactggctcgtgacctgggtgttggggacccctgttttagagtacgtttcctaagaataggacatattctgagatcatcagtgcaattatcaacatcaggagatttaacactaataccattctattatcaccttccacttcaatttttcttacatacctccataggctttttgccttacctcatatgtatcctttgtagttcaaaccacagttaagctttctttagttctcgaagacttgaggaaagaagcccttttcttatttatttcactgaatggattccttatttcttctgatggctgccttaaatgtagaaacaacaacaaaaatgctgccttgccttcaggagaacacactgtccctttgtatcatatgtaaaggctgcctgaataacccctaaccaagccatgtcttttttcaaaatttaaattctaaagcagcaaactgagtctttactaagaaacagttatcaaaaaaataaactaaaaaacgtagtgcacacccatgaacattttatccttttgcatttgcttctagctagtttcaattgactaggtaactgtcatttaggatagcagctccctatccttttgcatttccttctagctagtttcaattgactaggtcactgtcatttaggatagcagctccctatccttttgcatttctttctagctagtttcaattgactaggtaactatcatttaggatagcagctccctatccttttgcatttccttctagctagtttcaatagactaggtaactaccatttaagatggcagctccctagattacagggaatt

SEQ ID NO: 68814 - DNA, 1037 bp, Homo sapiens
gcatttattatcttctaagcttgaaactgtttcacctttagggtttggctaagccaagtccatttttttttttttagcaagcatattaaaatattttatacaatattttggatttggatggagaataagcaagatctttaattttctttagatttgacttctagtgcctttttaaaaacgtttattttaggttcaggggtacatcaggcttgttacagaggtaagttgcatgttgcaggggttcggtgtacagattatttcgtcattcaggtagtaagcatagtacctgataggtagttttttgatcctcaccctcctcccaccctctaccctcaagtaggccccagtgtctgttgttcctttctttatataaagcatatctaggactgcatttttattcattaatatatttatatacaaaatactttataatttcttacattttatactcctttggatctgtaacattattatcattgtgcaaaaaatattctcacattatataagctgtattttatggttacagagctccattttattgttaatgatttcttttgatttggctgttaatttcttttgatatctgaacagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatggtatgaatttgattaatagtttattcaaacctttatgtacttttctacttcctttattatcttataagacttgttttaacatttgaattccaaaccttaatattacttgcttgcaaggaactttttttttaaatatccttttcatttctcttgtctttttaagaggttgacattgtaggaaatattcaagctacttctccatgtttacatcctactgatcttcaaaaagttgcagaaatgattcgagaagaaggatatgattctgttttctctgttgtgagacgccatcagtttcgatggagt

SEQ ID NO: 68815 - DNA, 1046 bp, Homo sapiens
gttagtttgataataggtatcaaatgtagaatgattattagcacaagctgtgaagtcagactgtaccactgattagccagttgtgataagatgaatgttgtttcctcatctgtaaactggagatatcgagagtacctattaccgtagggctctggaagggattaataaaataatatgagtaaagcacttagcagaatttctagtacatatgaattacactctgaatagtttttgctgctaattgaatgtacatactttttcctccaaattccaattccaggaaagaaatgagacaaatgggccaatagtgaagttaaaagaacccacttaaatgtcctgtgaaaaatagaatatccctaaaaaggattactatgcaaccattacaaacagtgctgtgacctgtatttatttgcatgatcaaatataacaatgtttttcacttggatattaagcaatacacttacttaccaggtacctatgatgatacgcagcatggaactggttgtgggaactgtaggctttctgcttgcagagcttacagtctgatgatgtcaacattttaaaattgataagttattaagatgcataataactataaatcatgtatgaaagcagtatttacaagggtaatatgagcctcaaaataagaagcacaggaaaaactttgggagcatgtgatctagagacttcaggaataacccttaaaccacacatgaagatttaatggacataaatgctgcagaatgtttgttaaagacagatccaatttttattagaagaaaattttagtggaatgtataacaaattccaactatacttattatctttctttgggatgttaagcaagcttctgtataccttagttttctacttagaatataaacacaaaccaaattttataaagccattagaaagaaaaacaaagataatataaaatgcttaacatagtgcctacagatagtaataagtgtatcatttatataggtaaaactctagaattatatgtgtcaaaatgtagtgattatctacaaatagtgataattagg

SEQ ID NO: 68816 - DNA, 2565 bp, Homo sapiens
ttttttaaaaaaatatttctaccacgaatacgtattacttatatgacattaaaaaaaaaacacacacacacacactttaaaaggagaggtaagaaaatggagaagagcatttacatttttatttaaaactcacagcaggccaggcatgatggctcatgcctacaatcccaccactttgggaagcggaggcaggcagatccctggagctcaggagttttagaccagcctgtgaaacatagtgaggccccatgtctacaaaaaaaaaaaataataactcactcaccaatgttttatatgggtgacataagtgtataaaaatatatttcttaaaaaaatcaatacttttataagtaaaatttagtaaatagagcttaaaggctggattatgcaaatactaactttttttattttagtgaaaacgattcaaatttcaacacatttaataataaatgagaaaatttcagtagataagcatagaacaaatgtaaaagaaactctcttcaaccaagattgtactattgtatgtggtctaaagtatagtaatagttttactcagaatggtgaattaaagatactgggagcttctgaaatgcatcctattccaaaaaaggggttaacagagagggaggaaaaggatatcgttatgtcagtatgatttagtatctatttttattctttaaaaatggtaatttttcagcaactattaataaatggcataccaatcagaaccattacagattaaaagagatttaagagattatatatatataaacaaaagaccatatgttaaccttatttcattcctgattcaaataagtcagctataaaaggacaattttgagacagctgggggtatctcaacatatactaggttattagaggatattaaggaactattactgattttgtgggtttaatgatattctgtcagataaaaaattatatttatcagagataaatattgaagagtttttggataaaatattatgtctgggaattccttcttctccctttccccaaataaactagggggcagtgcatagaaaacaatattactaagtgattttaaattctgataatttttcaatataaaattggggttctcgcatatgtttgaaattttgcttaatgaaaaatttaaataacttacttagaattcatatataaaatttctaacatttgtaatatgcatggcaggtagcaattatgctccattcttcttctctagctcataagagtttatttttgattgcttagggaaaaccctggacctcaattatactgtaaaatatttttgttccatctaatctttagtattcttatatgcagtgcccctaggtcttactgaagttgccagagttacctgttggttgctgtctgcattatttagctagaatattctttgtctctttaaatgtttgctcagtatttattttacttgataggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttgatgaaaactgccttgttgctctagaagaaatttaccatgcattttctttctttcctttaaacattaaccaatcttagtgagaaacaagccactcgatgccggggtagagcatctgattgtacttcacatatgtatacgtaacagcatatggtctatgtgggggttggttccaggaccacccacatataccaaaatctgtgcatactcaagtaccacagtcaacactgttgaacccacatatacaaaaagtgggccctccatatactgcatgattcacatgtatttttgatctgcacatggttaaaaaaattcacataaaagtggaccacacaattcaaacccatgttgttcaaggatcagcagtatacacaaatacaaatatccaaataaatttatatattatgaagattatgtatttatttggaggaagcaaattatttgcagttacccctgagagataatggtaattttgcatacaggaatatcttagagatattacgggtttggttccagaccgttgcaataaagcgagtcataggaattttttggatgccaggtacataaaatgttatg

SEQ ID NO: 68817 - DNA, 1055 bp, Homo sapiens
acacatgacacttttgacacatttataaagtgtctgttttgcactgaaaaaaaatctgctttctataatggtgaaaaatatttatgttttcccaaagcactgcattgcataaaataaaaattggtttcatttcccatttgtactgagtgatcttcaaagtgtcttaccagttcactgtgtttcatcttctctgtgaatagttcattaaatactcttctgctctgaagtagtttatccaatcatccaccgctcctggatagattggaaatgtattagacaagaaccaatttaaatgtattgtattcacaaaagaaatctgccagttttaaaataaaatgtgaacatcttgtatctcttggtgccaagatgataggggattattctttatttacttatctgttgtttctaatttcttctgtaatggttgtatattatgcagtttaaaaagttatttctggaaaaaaaggcagattaaaaatacatgaatgtcataggttttactctaacaggcaaagtttctcacctaaacttaataaaatcataaagcgggcaatatggacataatgatgtttcgtttatttcccaacttgcacatctccacagcagaagctgtgctgatgactggagggtggcggtaattagtctaattttaaagacatttattttacaacatgatattgaaaacataagtgccaagttatataaacacaaacaaaatttacttgtgtgatatcctcactttcaatataaagtgttgggtgattgagataagatatacacttcacatagtccatcagcctctcttgatcatacaaatcatctctctcagccttggccacagggtcaaccacacaggactgccttttttgcccccactatgcacacaatgccaaaccccaaccctggatcttgcctacaatggtcttttgccacttctagcctcaaacttcatctctggggtctacctgtactggagccagtgatacgttttatccatccattacagaacatcttctgttgttctctatcatcttttctttccaaatagcttatat

SEQ ID NO: 68818 - DNA, 1170 bp, Homo sapiens
ttgctatagttttgttataacttgaatgcgagtgaggtcgtgcttattttaatatgcatattggccctttgaatttcctcatctcggatttggcagttctacatcgttgttcatttacccattgtgatatttgcatgtttgttattaatttttattgtttgtgttctggatactactgttttgttatgttgtgctatttgctgtatttgttattgatttttatcatttgtatccttgatactaatcccttgtcatgtatgttgtaaatattttcatcccaatctgctgcttgtctctttaaaaatatgtttgtagaagactttcattttaaagcagtcatgtttaacaattttttatggattttgctaaggaattgcctcatgtttacattgtcttttgtgtcctaaaggtcttaaagatattttctcctattttcttttaattttatggtatatgattattccatctggagcttaatttttgggacaatgtgaggtaggaatttatcttattttctattactggctagccagtagacccagtacaatgtatggaatagtagatttttatgaattggtttgaaatattacttttggcataaaggaaatctccaaaaatgcttaggtacatttttagactcattctcctgtttcatcatacatggtttattcttgtgtgagttccatagtgtttttattactatagttttataatcagttttgacattggtaagttaagttttctctgttattcttttgtccaaaattactgtcagtatacatactaatttatacctctcatatgatgtttagaattaccttatcaaattttactttaaaataatgttgggatttttgttgagattgcatttgaacctacaaatttatctggggaggcatctttcaatattccttattgtccacataaaaatgttgtatttatttttaggcttatttcaaagtgtttgggggctttgttgctattaacaatgaaatttttgttttattgtattattttaatatatgattcctgctgtatagggaagctaagactctattggttccaataaatatttttttcagttgattattttgtatattctagataggtaattataacatcttcaaatattgacagatttccacttatatacataattgaaatatgttt

SEQ ID NO: 68819 - DNA, 1019 bp, Homo sapiens
agtaaaaatcatggtggagttaaacttttaaaatttgtaaatgcataacttttaattcaataaggggacttgatatgagacctcaatatttattttgaggtataacctgagaaatatcttcccatacaagtagaagagattttatccaatggttagtgcctctaagtttaataaagggaattgagaatgtagagataatcgcagggggaacaattgtttatgttattagtgtgctttttaaataataacttgagctttgaggaaaataacttgggtccaagattacagcaatttatctttaaaattgtgtacaactcaatgtacacaaactatacatgcatgtttcaaactgtgttcctaaaacttccatatctcttttgctgtctgacttctttttttttttcctccaaactcagagcagcttatcattgtttgtatcaaggcttcaaagtcattgatagctatttattctaacatctgttctgaaataagggaattagaaggcagataataaaactgaaactagagatagcaagtaggagatagaaaagaaaagcccctaaaaatatggatacatggagttggtatctgagaggcaatattatatagcagtgaagaacacaagttttgattagaacggatttgttttcaaattatagtgctagtgctagtaagtgtttctgcctactagctatgtaaccttagttacttaatgtaccatatgtcaattgagtataaatattatttaccttggggactgttgagagatataaatgagataatgtaactgcatctagtagaagctattctgactgatatccaaattagctactcaagaggactctccagttgcaatacattttgttcttggataaaacatattatttaatacattattgtactcatcagatttagagaaatttccaagaatatctgcatgcccaccttccccacaaaaaaaacaaaaacagaaaatgagggaacaaaaaccagaccaaatggtgtgaattataaaagtc

SEQ ID NO: 68820 - DNA, 1044 bp, Homo sapiens
tggttgccttcagtatggtttcttaaatttcttgctgtcatagaaaagggataattgagtttgccttactcatcagattgactttttgttttctttcttctctctttaaatgtttttctttatatctgtcatctgtgtgtgtgaataaatcacagtgttttgatgcaagggtggaagcaggatgttacagagttacagttttcctagcctttctgatttgagtcctatgagactgaaggaagcaagaaatgaatgatcagggacttgtggaattctagtgttctgaggttggctgtggaatgaccatgaggatttgtgtgatactggaatgttttcttaggactgatgttgctcagggagtggggaccatatggtgagaagtttgcttcttagagctcttgaatgttaaccctgtggttagattaccactgtgaaatggaggagtggtggatatggagaggaataattcaacttgaccacttttgaagtggtctaaatcaagctttgcttacttaatatttattcttggttttctgggcattgaaataaaatgtttttctaatatacatgtaggcagcaagaggggggaaaagggaaattttattttagggaaccctagttttggggaggggagatcttaggcaaaattgcaattagggaaaaattcagaaatgaatcatggcctccccaagacatcttttagccacccttggtttgctcagatgattgtacagaaagagaatttttaagccttagaaagtgggactgaatctttcatgtgtctctgttaatagcccatgagactttaaaggaggaatcccacaaagctgaggcacaggttctaccagatccaaagtcacactctctataaaacagccatgctgactagctcatccttagatattttagtctagtttaatggtcttaaaatgcagtgataaggtttttcttttaatttttgaaataagaagtagaagctttagtttattgccagcatctacatgttttctctcttcatctgcccttgggaggcttccaggtgtc

SEQ ID NO: 68821 - DNA, 1034 bp, Homo sapiens
aagacattatatgtaagttgggaccaaggagtgaatgagttgttctctgaaaaaaaaaaaaaaaatgaaaagtctgcaggagcaacatgtgccagtgagcctgaggtaggaagagtgcttgtgcatttgagaaactgaaaaaaaggcaagtttgattggaacatggttcaggttcagaatgagagatatagataacaggtaagttttatcgtttaggcttatcatcaatttgtttaaatgatgatgagcatgatatgatggagatgttgaaggtggaggcacaatttgaattcttgccttgccatttacttactagctaatttgatcatagctagtcatgggcaaattacaaattctccgggcttcagttttatcatctgtaaagtaaaggtagtaaatccttgcctggacatgtgttcagtcaatgtttgttcattcatgcagtaaatccccattgtgagggaagtttaagttatttggtatattaagataatttaggatgttttaatatatattctttgacattttgtgtgcattcctatatccatacacatgtatatatagtatgattttcctgtgcactattatttaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggtaagatgcagttaaaaattcctgattggcgggaacctgagaatttcttccatggcttcctacccctaaccccctccaaaagagaattgctctttagagccctttgagtctagatgcgtaagatattttaatgagtttattcataaccatggtcatacatagtcacaagtcaatacatgctatttcgacatctcaggtaactagggtattattcttaatcacatctggaatttgtgctcctgagttactgtttccaccctcttgttggtaggtgtttagaatacagtgatagcta

SEQ ID NO: 68822 - DNA, 1037 bp, Homo sapiens
gtttttgtgcaaataaatgaatagcttctgacagattatttaattaattagatggatgttttctttaaggtaaattaggccaggcacagtggctcacgcctatattctcaccactttgggaggctgaggcgggtagattgcttgaggccagcagtttgagaccagcctgaccaacatgacgaaaccccttctctactataaatacaaaaattagccgggcatggtggcacatgcctgtaatcctagctactcaggaggctgaggcacgagaattgcttgaacctgagaggtggaggttgcagtgagccgagattgcgccattgcactccagcctgggtgacagagtgagactctatccttccccccaaaaaagataaattagtttttatatcactcttaattacgttaagatgaaaaataaactatgaagatattctcaaaagcctttggatagagaattaaaatagatgatacttctacatccatttaaatttgacaaagatttggtgcgaaaagctggcatatattatgaattaaccttttctacttgctcttggtagcacatggatattacactattttgaatccataaaattgtatttcctaagccttcttgactacttaagctcccatacctcaaaatgttgcttcttagtaggttttccttcaacagaaacttataataataattgtgtagcaccatatcccaaatgtgttaattgcctgagtcgttttcttacagttaattaatatttttaaaattaatcctctgtagctactgtgtcatcagaattttttgatttaataaacaggaaattgataaaactcaaaaaatatactgaactatgattgagttggaggcaggctgaagcaactcccttaattccctaactacaaaaagagatatctttatacaactatatgtaggatcctcaggcttttcagaaggatgtgacccaataaaatggttttctaatactgcagtcatttttccccttcacttccagtttaaagttggaaatttcctcctagactgt

SEQ ID NO: 68823 - DNA, 1012 bp, Homo sapiens
tcaggctctccctaggagaccacacaactatgacatcaccagaaatgctcagcctgctaactgagaacttggttttggacaaatcagtgtctaaagcttgactctttactatctctcttatctgacttgaaaaggaccattctttttctgagttacagttaaattacatcatcgaaaggagtgttaagacgagtaagagacatcatccatatttttttctttgtttttttcttttgttttctgtctgtgttttcagcaacgtcagttgattacagttcctttgcagacagatgcagcagctggatagagctcattaaactgaaagctcagaccataaggcgtggatcaattaagacaagtaggcggatgtttctaccacattatgataatctgagaaacatatccctgatttcccagtggtgaaagctagaccttactacccagtaataacattgccaatccatcatgtattagagtgtgaaagctgcagactgtaacggtcatttaggaaaagcttttgaaaggcctttagatttattagttttacctatagaattgtgtttttaaaattttcctttttgtgcaggtattcttaaaagtatataaatagatattatatcattctaattggaagtaaattgccaactctcttattgaaaagacattcttccaggacccaaggtactatttagtatgtggcatctgtcggtttattaagtgtgatatgcagagggctaaactaataaagaatttatggtgagaaagtagttattaccttactgctagaatcagaatcattacttatatgttatcttatgccatgtgttttggtaaattttgaggtaaatatatttgagtgaaagagcttaccgtacattaaaagggggaaaaaactacatttcacaggaaataatataggatgtgaaaccagccagatctggttctgaatcctagaagtgccattttaatagctatgagaccttgggcaagttacttaacttctctaaccttc

SEQ ID NO: 68824 - DNA, 1029 bp, Homo sapiens
aaatacctgtaataaaaaatatcagggaaaattctggatgctactgtcaggttactggaaagggagtgatactggcttgggattcctggttacctctgtgatcactcattttttagtttcacaaagtcttgataccaccagagggagctgttgatatcgaagtcttcgaatgaagaagttggtggtgagagttaagactagggagcagcttatgctgatctgtgaagcataatcattatcttgtctgtaatttgtaatcttatagactcttccccacagcaaacattttccttccatgtttcatttcagatattcttcccaacacattgacccttttctctgcctagtctcacatcctgctttcatcatactcacattcgttactatgtttatattttcttgtgactataaagtttctgaaactctttttgtgttacagtaagcaagtagtctcctttggcatggtatttatgaactgagctagttttcatttatcaatagaaactgcattttaaacctagatgcttttatttggtttgcttttgcaatgaagccataaagatttcctcctattcttctggcttatagaggtattaacaaataacaaagaagaggtactggcttgtacttagcatctgagctaatgttgttcatattgtcttattagaacacctggagagtgcaagttctaactcaggtataccagctgcacagagaggtgagtttgtctaattaagcaaatagtcaccaaaggtgtaaaattctagtttggtggtgcataaaattatagacattgaagaaaatgcactggacaatatggaatagacaccaaaatctggcttttttttttttgtaggtagaatatgttcttttaaaagcatcaattaaactaatatttaaattttttagtatgttaatggtttcccagtttctaagcataaaattttagctccttaaaattttttttccagcttagcagtagtaaaagttattgtttttaaaagggggaacttgtgaggctcacacctg

SEQ ID NO: 68825 - DNA, 1015 bp, Homo sapiens
agttttggaggggacctacattcaaataatcgctgcagctaacgaatacctttgccattggttacgacaagttatttagaagaatggaaaagtctcagactttagacgtactggagaatgtctgtttgagggaggaagaatcctttttgtcgttaatatgctcatttccactgagctgattttaacctgggttagtttccctcccacaccactacacacagggcttgttaaatattgctagagtgcactaggggaattataaaaccatagccctgtattgctttgctaagtttctagggtcatttatttggggcttgcagggttatcacttaatggtgacttttaaaaaaatgcaaaataatcttcttcttgcattaagtgggaaaccaaattataatagaagcagactgttgtgtggcttaattgagactgtttgcagctagaagggggatcttgacatgaaaagcatttgtttcagactcttccatatagatctacaaatggcacacaagtgagcacaactcagcaaagcctgaaagacttttaaggagatttctacccttgaataatgaactatgttgtttttaatttagtattagtctagagactgcatgttgttttatttcttttaaactggaactcccagttggtcagtgagccagactgcatgtatctgcagtaccttctcttttgaaaagcttatcacctgggaagccaaactctgatcaggaggagcagagggcctgggagtctgaggtcatcagacatttgaggtattcaaaccagtccaggtgctgatgtctatctgctgctgggaccagctggccttgggcctcttgggccttttttttctaggagaaaaattaagatagcaagcatgttaaaagatgaacctgctctccctaagtgaaatcaaaaatctcccttaaaaacttgggtttttcagatttttttcagatgcattcgtatttgagggcagggaataaacattttccctcccttttttccctcttca

SEQ ID NO: 68826 - DNA, 1056 bp, Homo sapiens
cagtaagctgtgatcatgccactgcactccagcctgggcgacagagtgacgctgtctcaaaaaaaacagaataaaaaatgatttcaaataacttttaatcaattaaaccaataattttaattttaaattctgctcctctgaaccatagaggtttgtcagaggtacctcttggcctgccaggaggcaaagtgaaagggagcagagaaggatgggattgagggtaggtctctggatcccctacttttctgaaacagcagctttgattccatgtttttatatatccatcttctgtatgtgatttcacttgaagaaagggtctcaaagagtttgaaaaccattgattgattatgccaccctttattgtcatcatcatcatcagaccatcacatctaatacgaatatatgtaaaactttctatactaagtgcttaactgtgaaacctatgtgcttttccttgaatactgcatttaaaataatcagtaaacacttaaaagtgtatctgtacctttctgccaatatttctgtagttttgtaaattgtggtttgtgttgcgtgcttatttattgtcttgtgcttcaagtcttttcaggaggacatgggctaaatacaatttttaaagctatctcaaaatgttttggaaaatttgagggtaagataggttttgaaaaggtctgaaaaatataatagagtcttaaaaatggagtaattgcgtgttgtaacatgaaagaaggcaatgtctggaaaaattcaaaaatagcaatttagcggaaataggaagagaggaaggtaagagtgttagggataaatgctcaaaagatttctctgtttttttaaaatatgcaaccataagaggcttaaaagtcagttactaatactgataaataaaagtatagttttttaatcattttgttaagttaaataaggtgatagcttttttttttttactttcagtaactttgaattccagtgtatatttcatgtttttaatcacaaataggatgattgttaaaattttttatttccttttatattgactaggggattagtttcaagagc

SEQ ID NO: 68827 - DNA, 2740 bp, Homo sapiens
taggatattaattattgtctagcatttattatttgcaaagcactgtgctaagtgagttacagatattaatctcttaaagcttcacaagagtcataccagggaagatagcaccagtctcagcatcatgcagatgaatggtttccatgggagaaatcaaggagaaaatgaccagaataaattggggtggggagatggagctgagaatatgtatatgtatgttgtcacagattcttaattttaaaaaattaataatagatcattactaaataactgatattttcttgcctttctagcctcaacagataatgaagaacttttacaatttccactggaactgtgttcagattcacttccttctcatccttttccaccagctaaaggttggttaagtgagggaaaaagcaaacacaaatcctggtttctagttcctttcactgcttcttcattataggaaatcttactaaccttgaggtgaaaatttatccttcattccctcattatatgtttcttcatattcataaaggggagaaattaatgttccttttattttaatttctgaagtaatttcattctaagttattaaggtaatttttcctatgatattctattctcataccttaatgtattaaagctttattttcaaaggtttggatttcccactgtaactattcacacatagaatacttgatattttatattatatttggtaagttttttccagcaacaattaaaccttcacaaaaagttttggattttcatgcacaacagaatgcttttttttttccagaagatacatgaagaggttttgagtgggagtagtacaagtgagaaagcgatgagcttcctgtctttgctgtggcaataattgaagaacattgttatgtacttatataagacactgccatgttttttttccagtgcaaattgatagctccttaatttaatagcaataaatctattttgatctgcataatctttggggaaaagtgggaggtattgttttccatttctcatctgattttagtatgatttttattacaaaaaaatttaaaattactatgccttattttgtagcattatgtattagataaatgtagtatgtgtttttcactaaatttattttgagaaatgatagttatttgaaatgagctattcaacttttatgtcttataatacaatggatattattttatgattcctacttgttatttgataccaaattatgtataatacagaatagttttatattcactttacatatatgtcaatagaatctttattaaatcagtacaaagtctgtttatatagataaatagatcttgtctcatatttcaaagacgaaaaataagctgcttccagattctgaactttgtaacgtagtaactgtggtcctttttcctttttgtgatcacccaaaattctgatttagaactccatagagaattgtagcatatctcaatgtccttgaaagaatagagaggaaaaatcaaattcaaaggtaatgtgagttcagatttatgaattaaatacagcttccaggcagaaagcagaactgtcaagagtcttctttgggccgggcctgttggctcatacctgtaatcccagcactttgagaggctgaggcgagaagatcgcttgaatccaggagcttaagaccagcctgggcaacacagtgagaccccagctctacaaaaaataaataatgagctgcatgtggtggtgtgcacctgtgatcctagctccgtgggaggctgaggtgggaggattgcttgatcccaggaggttaaggctacagtgagctgtgattgtgccactgcactccagcccaggcgatagggggagaccctctctcaaaaagaagaaaagtctttcttgaattcactatacagcaagtttttttttctttaacatctactttatacagaaatttgtatttattcagggttagttccaaatcacttctaggtataatttcatttatccttatcctgcaataggggccaaaaaaaaaaaaaaaagccctaaaacctaatcgacaaaggtttgattgattgttattctgtaggaaaaggtatttgtggacttggggtccctgttagctctgttttactatgttgttaatacctactgaattctgcagaagattagatttcagctctctaagtttgccttgtctataaggacaactttccacttctgcaatagctttcaaaatgttttcaaaggaattataactggtgcttatgtgatcgttactatacggtatccaaatgatattttgtggactaaaaaacaagaaaataagaatttgagtagagtaagtcctatttgaacagtacctaaaatatttgcagctcattttagggagaattgagagggaccgtgaggtaggttggaaaagcaactgacctgttttctcagttctgctatggattaggcatgagaacttggaccaattgcttaacctctttgagcctcagttcgtcctttgtaaaatgtgaaaagattctctctaacctttaaaattcgttgggtttctatagtttatggttcttcaattattaacatattcccattttgaaaagtaaatcaaaagctaaattagaccccaaggtcacactgagcgtctgtatttaatttaagtgtgttcagctgggcgcggtgactcatatctgtaatcgtagcactttgggaggccgaagcaggcggattgcttgagcctaggagtctcttctctaca

SEQ ID NO: 68828 - DNA, 1039 bp, Homo sapiens
cctccttgatgacttctcatttcttgatccttgagagccatgggtttggaccctctgcccaaagctctctccttagttgaactcatcaacttatatagatctatgtgtctgtgactcccagatttgtaactctagtccggaactttcttttgagctttagacttatacctgtctacttcataccccattttgataagccataggcatctcatacgcgttccacattgaactgctgattttcttcacttttcttattagccttttctgttttaatgaatggtacctttctctatccagttcttcatgccaaatttggtattctttggcactgtcctctttctcaacctccccacatcaaatttattacaaagtccgttgatttttcttctaaaatgtatttctaatccatttatttttttccctcttgaatcttagaccttccatttgggattgttttccttttgccttaaatgtacgctttagtatttcttttgatggtctgctggtggtgagctattttttttgtctgtctgaaaaatgtgtttattttacttttatcttaaaaaatattttgggctggcagctatttctttacagcacattgaagtactctttcaccactgtcttctggctttcattgctactgttgagaaataatctattagtctaattactgtccctttgaatgtagcctatgtggcacgaagtagatgctcaagtgacttttgtattttttttaatgactaacattttcttctgctttccatttatattgaacacatgcagttataaaacctaagattttaaatgatattctctagtgattttggtcattatttcatttttagagattttaagattttttatttttctttattgaaatatgattctttaaaatatttaatttttgtgggtaaacaggtgtatgtatttatagggtacatgagctactttgatacaggcatgtaatacataataatcacatcatggaagatggggtatccatcccctcacgcatttatcctttgtgttagaaaca

SEQ ID NO: 68829 - DNA, 1107 bp, Homo sapiens
aaaatgtcaatgaagtaactgatgcttgagttggattttgggggatgaatatgaattatataaataaaaagaagaggcataaggagaggtttcaaagcttacaagatgcattcaacacttaaaagagtagcaaaaaaaagaaggccacaggatgtagactcaggatggctgatgataggtcacagatggaggagtctgcaaatgagttcagttaatttacctagaagtttgagttcatctgacagatgtcatctgacagaggtcctttctagacctcaaaaacatctgtgtatttaaattttaactaatcttttctgttccagcccatgctactttctgttactggattaaactctctgaaatgcacttctgctcttataacttcttgattcgaagacatcagtggtttcatgttattccttctgacatccttaattcctacctacactttaagcctggtcttcctttattttatttacagttcaagtgactgttcctcccttgttctcttaggcttctgttttattttatttctgggttttatttatacctggttttcagcagttcatccctaggttgctacttttctcatttgtttaggtgatctcattcaataattatgttgattgtttaattttttagctttcaaattgggtgacatataataatttaaaaattattttgaatatcagttttctgttatatgatgatgtagtttaagcttcatttagtatattttgtatattgtttcagaaacctttataatgatttaaatttagattaagctatataaatcacctatatagagatatttacatagttgtgcttttagaataattttaataaaacttcatatacatttaaagagtattttaatatagtttcattgattaatgctagattcagcaatacaatttattactgcttatattttgaaacatttcattctttcagccttgccatattttaaatgaagttattgtctttaatattaatacttttatcttttttcagtttttaatttatgaagaattctttccctccattcaaataaagttacttctgttttctaggctaggtttaggaggtaaacctcgtaaatattat

SEQ ID NO: 68830 - DNA, 1534 bp, Homo sapiens
acatgttggcgttttaaaaataaatatatgtagaacttaagtagcttcctccattttttattaatttctaaaacactgtttatggattactttctgtaaaattcatttttaaaacagtaaagccaccatgtattacttgtggtacagatgaagaaggcaaacccaatgtgagaaaaatcttataaaaacatagtacataattatttgctttagaaaataatattttaaacttctagaatggtttaaaaagtaaacagtaggttttattagtgagtttaagaaaagttagaattttatttcatgcaattttttgggaaaataggtattttctaaactgaaatacatttctatggttgtgacaattattttctcagaatcatagtcatttaatagattagagcaaccacttgaataatagttcatcttatgatagaaaaattctcttttaggaaaggatgatgttaaatggatgttcagattggtccgtaagtgtgtatgtcttagaaaaaagagagtatggatttgaaagtgtatttttgctgttactatatacatttcatttgggaatatgaagaaattctttaacacaagtagtatttgtgtaaaataggttcacttaattgttcacacatttcttaatttataacattgattgctaataccatattgtagtcttttctatttctcttccttattttatcttctactttgatgtctttctcagtttcctgaattctgcatttctttcttctgaaagaaagttttaaggtagctttgtcttggaaccaaaactttaattcaagaactggctggcatcatttgtagttctggcttttatctccttatttctcccttttgctgatcctcctccctgtggaggagacaaaaatttcatcataggaatgtgagctataacacgcctcttaacctttctttactttgctgtcttcactattttactagtgagtataattctacttattctactaattttgaaaaacatattttgaaaattggatatatactgcaattcaaaaatagaaactttggattttttggtttttagatttaatagtggcttttatatggaaaaattacaatgagagcttagcattctatctagagttgatttttttttctatctcaagttattcccaaatgagaattggccacaaaaagaaataaattatgatatgctaattatagactttctgtttttaacacattgtacataaaatgttactataatttgcagctgctgtcaccagtagtttgcagctaaatgcaagtgattaggaaatatgtatgacagatgcttcatttatagtgctccattacaagcaatattggacttctctggtaataaaatagaattctgtgactctaaatcattttttaaaattacagaccaatacatggagtgttatatctgaaatttttccttatatacattaccaaattatttgtgttaatattttaagtgtgcttgctttctttctttttttttttaaattagtctctaatttcttgtatt

SEQ ID NO: 68831 - DNA, 1683 bp, Homo sapiens
tcattttccctgagagatacttatgagcagatgtgcaaactatacctaaagtacttatacagcttttggttttcagtattttaataaggttttcaggaagtagataaataagagttcaagatgcaagatggcataaatacagcatgcgtgatatgtgagcttttctatattaccagtaattttagagtaatgaaaatccagttacattgtgtgtgtgtgtgtgtgtgtgtgtgtgtgtgtgtatgtgtgtgcatgcgtgtatgtagtgaaatttcacaattatggagtagattgcacatttgactttctaaatttacagatagtaaagactccagtttggtcaaacatggattatatcttagtttcatcctaacatcacaaatgactaggtcttgacgtttgctctgtatttgcacatgacttcctctataatgagaatcttcttcctagtctactgatccccacccagtttgagattatatactcctttgaacctgaactctctaatttctttttcattaggggaaatttatcttcttcaagaggttagcagttggaatgttactttcaggtatttgggaatatagctttttatactgtccgttaacatgatagattatcattgtattaacctttatttgatccaacctaacattttatctccttttgttgatttataaattagattgaataactgtccattttaaaaataatttttatttttaaacaatatttgtttgtatttatggggtacatgttttattttgttacatgcatagaataatgatcaaatcagggtatttggagtatccatcaccttgagtatttatgatttctaagtgttgggaacatttcaagttctctcgggtagctgttttgacatatacagtacagtgttggtaactatagtcactctgctttaaaacattagaataatttcttttttcttctaaccgtattaaaagaatctgcaaggcagagttattctctcccagagctatataaaaatgaactgaacttaacatttcaggtagttggtatttcttaattgccaagtgtatgatagcctaaaatctcaaagaggttgagtttaataagagcatattatgttgagttgttcacattgttattttctgatatataaactgccgttttagaattttaccagtttcacctgcacttcagaaacaaaatgttaaaaagatggcaagatatcgagctgtggccatgctctaggaatgtaacgtagtaaaaattaatgaattctgatgtcaacctaagtgtgctgacattacccctaaaagagacatcagtgaggattgatttagtgctcagttcatgcctgcaattaaaaggatatattaaaagatttgcgatattatctacaaagagttttgacccacagaagaaaaacataaaatagtataaaatataacttgtatattaaacttatatataaaatatataatttgtatataaaaatatattaatttgtatataattaaattttaaattttcctaaaataataacttttataattgtaaataattctgtagattatcagaagaaatgtgtttaaggtgaagaggtttgtttcttaacatctttgaaatgtttatttaatgtttattaaatgacctcacatctcagctgtatatccttcagataactaaattgtatca

SEQ ID NO: 68832 - DNA, 2485 bp, Homo sapiens
tatacgtttctcatttaaaactcacatttacaaagttcaaatgtacttgctcagtgattaccgaactgttttcccaacttctttcttaatacttatattgtgtaattaccccgtgtgtgctgtgcctaacaataaatccattcgaatatttttatgactcaaaacttcatttacattcaaatttcctaataataaatatgaattcattatgaggtaatcctctagtttgtacaatttttattagatttccaggaacaaaacttagaggacagaaaaagaagtttaaatggaaataaggatgcattttgactaaacatattataatacatttattataagtgacgtactctccttccatcctcttccttattttccctctacctttctgctgggctatacctaaccacttccatagaccagttttttactcttttcttacatagcatagatttttctttctcttgtttaaagattacttctaaatttgaactgaatttatttctaaataaattttagaaacttttttatactcaaccttcatgggttactgaggtgcacaggactgatagcttttgtgcaaaatgattccaagttgccgtgctttgtgatcatgcttttgtgagtttgtattctccatgcttgaagcagccagtgaataattcttgctgcttttaataagcctgcttctggtggtattctgtatctctttaccagcttttatttgttgcatttaatctgaggtggtcttgaaaatgagatcatgataaattttagagttgtttctttttaagataaaaatttataactactataatatagtatgaatatgatctgtgggagtctcctatgaataaagtatatgagctttagagcttgagaccgtaacagttcttttgaccgttgagagccctgttttgcttatttttctcaattatgctcaattatgttctaaatagctgaggctactggtaagtgattccagttaagtgagctacattaatcttgcagccagacaggtcaaacatcaagttttccttacttgcatccaatttgtgtaatgtgaggggcctccatgttttcacaggagctccgttttcttattgggtcctatttcaatgaatttcctttcttggctttttcatttgtcttttttgtgtttctctttgtctctaagttgatgaattttattctttaagagagaaggatagaataaagcttgcaagaacttgtggaattttattgccttcctagctgttatctatgtacctttcaactttccttaatgtacctttatgcacttgtatttgttcctgccacattggtgttgatagagtaacctcacacaatgattctctacccatctcaacttgatatttgccactatcctctttctcttaacccacactgcttatcctctcacttatcctcctttggtcccactttcatttagatcccttggccccaggtttttagagtctttaccagtgtcttatactgggtgttcatgtgaagggggtgtctaaaccactgatagataaaggggaagagggatagggcagttccctcatctcattgagaagttccatcagagttggagattcagaggaaggaagagtgtgtttcaaatatcttaaattgaaggaacactttttttttcttcattgagaactgatgaaatgggtctttggattctgtataacattgtatatatggggaaatggatttgaaactctaaacatttaattaaacttttaattacaaagcatgtgtgatgtgtaatgggtggccttttatttcaagggatgtaatacagttgctatggcaagctttttaataagcaaattttttacactctacacacgataagttgtatttttcccttattctttccactaggaatttccattttttaccttgacggcatttcctcctggattccttgtacacgttgggggtgtagttagtgcacgttctgtgaagcttttggatcgtatccacaatcctggtatgttcttaaaaagtttcaatgtttcctttatttaaattgtggttattaaaattgatttttatgatttttttaaagccaaatctaactgaaaagagaaatgaaaagaaagtataaactagcacgttactttaatatatttgtagtcatcttaattataaataaactaagtgtattttagttacttttctgtaaaaaaccaattgatttatttttggtcacaatatcactttaaggaaatccttaaataacttttctttgacccaggggagataaacatttttataaattgaccattatggccattagtttaagatgttagttcttttcattagcagtagctttttatagattacttattttccttgttcttaaaacaggtatttttaaaaatgtaattgtaaagctgggcacagtagcatgtgcctgttgtcccagctactcaggaggccggggcaaggaggatcgcttgagcccagg

SEQ ID NO: 68833 - DNA, 4258 bp, Homo sapiens
aaataatttttttcctaaaattatttattacttcaatagtttatttatataatattagcagttttcagccccttggccttatattatgagtccctaaatatctctaaattgtcctgaggagcactcctatttctcatggagacttcaaatggcaaaattgtgattgttataaaaattctaaaactataatttcagcctgtatttcatgattttctgccttctgatttacctatatcagaatcagtgtcttgagaaataatggacagagataagctgattataatttatttgggaatccaaaagtagaataaagttaataacatttagactgagaaagttgtttttttttttttctgtttgtagttaaagctacattatctgtatttctggtaggtctcttttaaaaaattttatatttctgtagatactaatttttgacatttacaaggttttatttttatattttttcccaagtatttaactaatagtggaattttagatttactagtgttagaatattgatttgacacctgattttagctaattttttttagccagtcttttaactatgtatagtttttatagagggtatttgacccttagggtactcacgtctctgtaaatgcaaataatactatgatcagagtaaagtattaaacattttagaggaaaaagaaaagtattaatatatatctcaaaactggacagaagttaatattaaaattaatactgacaactgtttacctaatccagtactgagtattttttatggatattcaattaaagtgcccattgatgctatcttttagttagtaacatttgaagtactgcacctttataactttaaataagtgtttatattttaggcagcaagtctggctctaaaaatttgaaaatggggtacatttgaatcttacaaattcttaagccaaaaagggcaggcaagttaagtattttgaagacattaattaaaagttattagaatcacataaaatcctaagttagtgatttaaaaaattttaatgaatgtgaagtttgtaaaggttttgttaagttttagactatgcctgttattttcattacgtgggatagatggtcttgctagtgacttctcatttgcttagtgtaatttgtctgtacattttaaagttcatttttattgttatattttgcctcatcattgctttccttagcctgcattttctgatcatcttctgaatctgcatcttttctctgctactttcctccacagcaccttacccacagggacctaggatttacctgtgtcccagctccccctctctctcttgtggttcccttcatcttaaaaagtcctgtctcctcctctcggaatctagccttacccctcatcattctagccttgtcagcccagttctgaggaaaagtgtttctttcagtgaagagctgttcctggctgcttctggtaggatcacattatgtcagctttttaatccctttatttttcatgctgtaaaaaattattgggtattttatacaagatgcctttctattatttttcttactggtagtcagagttaaataattggaattataaggatataattgaggattacttgatggctaatcatgaatattctgccaaattattttatatattaaaaaattatataaggacatagatctgggtatttctaatattattagattcttattactacagtttctgttttagatgctttactttctttcccttcataccaactccattcacattggacctgtgtcatcatgttgctaaaccatatgattacattagtaaattattctgtttgaatcagtttaagtctcattttggtgatattcttttattatctttttttctgtctgttgcattaattattaaatttttctgctctattttctgatatttcaattatcactacaaatttacattttattttctggcttttaatatgcttcgtataaagatcttagtttcatttctatgtttagtattgtatagtctctaaaaataatgttcagattactataagaaaaaccatttttttgtttttaggaacagaatgggactatacatatgctaacctttgtttccttatccaagaacagctaaaaatgtaaaagttaattagttcctttttaagtcgttgtggtaaatttggctgtatgcatcttacgttttgaaagggatgggattaactctagtctgtagagcactggcttcttacctgtcccctgctttctatgattgtttgaccatagttgatctactggcatggtcagaacaataaaataaggtagggaaagaaatttaaaattaagccgtaaaaaatacatgtaagagcttgggaaagataattctttcattcataactatgtacatttgtgatgtgtctattacatgtctgtggttttttgtttacttaaaaaaagtttatgttgatttttgtgaatgagcgttgacatgtatgaaattaatactgttttgtcatgatatgtttagaaatgggaagttataagaaaatagatttgactatatttcagactcacctgaattttatgttttctagagaattttggaatattttcagtgagcacaagtagtgcttttgtctctatatttacatttaatcagacattttatatttctcatttgttagtattcttaaattgttagcatagtaattgttattatcttgattattttaattaaaagactcagcttttaaaatggaatattatgcaaagattcatcacctttacatactttttcttataattttctgaaaaaattaagtccaaaactagctggggtcagtagggctctgacatgttgcatctaaagaaaactgtgaataaaagtagagtaaaatatgtgctttatttgtcatccccagtgctttaaatgtttcgatcattttatcacatttcaactcatgatgtttatgaagatgaatgcaattaaactttgtttctatagttgcttttttggttgttatttatgtactgatgttctgtaggaatgggaagtggtagtgctggaaaagaaggggggccctttaaagctcttttaagacaacagactcaatcagcgttggaacagagggtaagattcacttgatattctttgttcttacactgttaatatgactttgttatcttatgcttccatgtacttgcatgttttcatgaactgttttggttacatatctataatattgcagttttgaagtccaaaatggatttaaggtgtcaaagtaatttgtttatggataattactgttgatttggaataattacgtaataataatttttgtcttgtttaatcttttatcagaaatactatttttgataatacctattgaatgctgaagtaattttccattacgtttatcattggaaaggagatggtaaacattttgcagaaaaaaaattccagtagcattttattatattaaaaataattccttagaatataaatatatttatttgctgagattacttttatcattgaccaatctcttaggaataagaaatgtacagattctatatttctaaagattaatataaataatgtggttattcagtataatgcatctatttcagttattgtaagtttgagatttagctatatttgttcattgggaaaataagcagttacagtttttggatgatttctctctctctcttttttttttttaaataaacttcattgctaagggaggatcgcctcataggttctgtagaaggcgggtatgtttctgaaaaatgtgtgagagcctatttcttgtattgatagctttctagttttaatcttggtcatttaaattttatttaatcttagcaaatgttgacagcgtttttcttttcgtaatgcaaagttttttttttatttaatagcactgtgagactcatgttcttttttctactaactaatatggtgcatgttatatatgtcatgtcagtaattttaagacatagttctatagctttcattatgtctgatttggaagctataagcatttacagaattttcttttacatgttctatattacactagcatttgggggaaaaaaggtgaaagagtaaatacctgtaaaaaggatacatttcataaaactaaagtatttctcctctagaggttggtacgatttattttctagacttttccctccttatgctgacagtatctgtgtatgcactgtttacctagagaaggctgaagagagcagagctgaactaagcaatgatgag

SEQ ID NO: 68834 - DNA, 1378 bp, Homo sapiens
gtgtgtgtgcaaatataaaaacaattatgaatatttacacacaccatttgtagttaccatttttcttttgtaacttacagcattgtttatttgaaaatattttgtcatatattctttttatttctccttttgatattttttatccccttagtctgtcatttcatgcttttttgctttttcacttggcttattaactgtttcaatgcagataatatttatctggagagtgatgaatggttaaacagcaattggttgtctttggcctcattcccagctccacacgtaagaaatgactgctggccctgccccaattctttcctggtgtttggatcatgctgccacctgtcaagtcctttggcacatgattacttaatatttctccaccttcttctggcaggattcccttcaatgaagatcccaatcccaatactcactcatcaggaccctcaacccctctgaaaaaccaaacttattccttttcaccttccaagtcctacagtcgacagtcctcttcttctgacacagatttgagtttgacacccaaaactggtaaggcgcttccacccaccttttattttttcttttttaaaaatttgtttctatttcttattagctttccatccaaatctttcctcttgtttttggcacttaagttaaaaagaaaatgtgaatactgaccattttcagttactgcaattaaaatatgaaaattttgtataattcagaaattatcttgtttacatttcattgatttaatcatagtgtagatatcaaagtccacgatttattttggcatgtagacatttttcattttatgctcgaattaaaaggaataacatcttaaaacattttgactaaaaagtaacactagtggcttgcaatcaattgcatacaagcatttttgaatttattatttctgcctattagtgaatataattctaagattttattatgaaaaaactttaaaccactgaaatggttatattagagtacatctatctatttattaactgggtatttaaaatgtttggttttactagtctttctaggttagaaaatagcatttttacttattcttaaatttttctgttcattaaatttgtattttctattgtattttgatgaatgatttctgggtttttatgaatatgttttatgataaaaagttgatgaaaaatcagattagttctttataccttagaatagaattaacttatttaaatcattaaattattattgtttagaaaaatttaaaataaatttaaaaacttaatagtgatgaaatttttataaatagtatttttgtctgacagttttcccatcagatgattaaaacatagttcttatttgttatttttagttaatatttttagtagcc

SEQ ID NO: 68835 - DNA, 1654 bp, Homo sapiens
gatcaggtaaagttgggctctttgcctgcctttaatttgcgttctaaaaaatggggatgatagtttttcagagtgtactcacatatgattcatatgattctgtttccctcattgtgtgtaagcaaaggcattgcacagtgaaataattgctgatattaaattcaggattcttatttatgtagtatacctttttacaacattcaatgtaatccttttagccaaattttttcttaaaaatttcaaatcttatatatcaatatatacttgtataactgctctaagtatacacacacatagatatggtttattataggatatatgttgatatcttataaaattttgatttggaatatagtttatatgatatattctgtatgagagccaaagttattgacattgttttatgaagatgtctttaaaagcaaggtccccttgttttgtttccagtgtaacctgattttaagctatatatttggtgtattgaaatactggaatatgtttatctgcgtatatccaatcagttcactcatttctctttgtgccatcatctctcatattcttaaatacccctatcttagtagcctagacagttatttaactttctttatagaaaatataattaattatatcagcaattcatatctcagtttcaaaggtaatataagaactttatatttgactttttacttttatgggcgtccctccccataaatagtgcatagtaagttctattgtgatgaaaataatgacaaatatgttaaggaaacttaaaatacagatcttagtcttgttctcatttaatttcattgactattctgcttgctattttcttattcacaattaataaattaatcacaattaatttattaatcggatactttaaaactatgtatcctaacaaattaatatttagctatttttcaatttcaacttgttttttgcatgctagggattaaaaaaataagttctcttccctgactaaagctcctttgaaattattttaacataactctgcaatctgttgtatgtattgttttcttttcttccactttgaccacaaattccctcaggtctccgctggttcatcctccaagccatggatgccgctcgactcacaacagcccaattcacactgctactggctcacgacttactcagaacttctctgtgtctgttcccactctcatctatactggtacgagactgctcagactccagagctggggagatgcaggccacgggcagagtggctgcagaggcaggcaggcaggtagtgtaggcaggtaccataaatctttgcttcatccttttcttactcgaagtccagctgcagtgaggaacttctgtatttagctgccacagagtctctaactatatggaagtgaaggtattcttccagcttccaaagtctcttccacagatcctcaaataatgctattttgtatgtgtgtactgtgaattttgtggcgaatcctcccatatatatttttataattatttctgcatttgtttaaaaataaaattgatgattagattctaaatgaaatagctgccaaagcttccaatttgcttattttctttatatacaaaacctattacagtaggtcctatttcattctgtggaagagagctattggagaacaggtaagcaact

SEQ ID NO: 68836 - DNA, 1123 bp, Homo sapiens
agcaaatttaagtaagttacctagtggaaggagaatgacaaagctatattacctgttggttccttagaatgaaatacagagagcaaggggatatgttttgcatgcattcaggaagagttctattagtgtaaatcttctgggattgtatacgttttctccttttctaatcttgttgtagcctcatgatggacgtaagttccttccttaggattttctaaaaggcatcttactaattaagtcaagttattttttaaaaaccctcaatactcaggctgttttatttcaactggcttcattgtattttttgagaatgaagcaatttgggttctatttcaaagcctattttatgattcagctgattataactattctggtatttaattatgtaatattgttgattctagacaggaatttgataaaaggtggtttagattatgttattgactgactggaaaggaatattaatattataaataccacaggttattatgaggcatcctttcatgcagagagactgatcgaatcagaaaactccaagagtacattatggtgatgttccagtgtatttgaattttaatttgatgccatagtttgaacattttacactgttcattttagttttttcattttattttacctacattaatggtgtgttctacttcctaagtttttttctttttgatgtttagtgtcatgcacactataaatccctttggtgttttccagcttaactctcttgacaatagaaagtgcttttaagtatgagttattgcttctttacttaaaaaaagtactacgagacaaattctcctgtgtatactactgattataataaatatagcattgtttatttttaagtcttggattttttaattctttttgagaattcttatactttttctcacttcagtggagaaataaaaacaaaaacaaaaccttactcattttttggtgtaaaagtagatcaccaatgaattgtttgatttttatccattatagtaaataccttttaatttctattagcaacaaacgtagaaacagttctcctattgcaaaatcagtaatattttcataaagtagtctgtagaccttaggaaggactattatgatcagttagtgatag

SEQ ID NO: 68837 - DNA, 1046 bp, Homo sapiens
cccagcccctcagcctattcccccctcgactgccctcccttcggccgtggttgtccagctctcccacgagggatgaccgccgagacctcagtgtgtgcgatgggtgcacggcttgcaggcgtccgcggcacagtccgctgcgcggggaggcttgtactgttgtgcatgcgggggtgaccctgatgtcaggactcattaacaggccacctgccactcaggagatcccaaggcgtggccgcgcagccaccgacacactcacacacatacacacacacacacacaaatgccggaatgactctgatgtcaggactcattaacaggccacctgccactcaggagatcccaaggtgtggccccgcagccactgaaacacacacacacacaggcacacacacacccttggaaggggtggccagagtgctggacatcatgtttaagaaggtgcatgaagccctttatgggcacttggagtcccacagtgcgaggaaatccactctcatgcctaacattttgtgaatctgccatgcacgttctaaaacacaactgcaacacttcctgctcttgtataggctggtaggtctgatgaggtgtttcagggtaatttagcgccttgaggtaggaagtcatttaattgccatggacttaaattgcaaaattgctttttaagtctaatgattagtttaaaagtcatgcaaattagtaaaggcctacggccggaaggtaataacccagagtctgaaagaagccaagtaaagattgtaataaaaattggcgtgatgagccagagcattagagcagcaatcatttgggctattagtgcttagaattgatggatagatatatcataatatatagctcgatttcatctcaatattcctgatgtttcctaaatgttctctaaccgaataattacagttcactgcctcccctgcccattgtcatggtgattcttaatcacttcatttgagaaagttcttgagtgctcttgtgccagatgttaggtgataggaatccacaaataactaaaacatagtgtttgctttccg

SEQ ID NO: 68838 - DNA, 1462 bp, Homo sapiens
ttcagaatttctttagtaaatctcaaaggaaatattttcttttgagattttactgtatttcccttgaaatagataagaatcatacctcacatttcagaggaagtatgtattatatagtcgacagagtataatgtaattttagagcagtcgagtatcagtaatgtagcctgtttttttctcagtttttttctaacatttttgtatgtttaagatatactttaaatgtactttagaaacttactgtagtaatacttatctggtgattgattattcctgcaagctgaactatccagagcatatcagaaaataaaaagaaaaaaacaagctaaaaaagacttactagagtcaaaatgatagaaggcccagtctttgctcagaatttgtgggtacatggagtaaatatatctcattttagacagaattcctgttcttactagattaaaagaataaattataaaggagatggtgaggttttcggagtatagtagcagaataggcagagtaaatctaaaacaacaatacagccacagtgctttgtatttaataatcctttactgtttataaagcactttcacatgcattctcccaactatcctgtgaggtagatgtagacggtactgttaatatgtatcatatagttaatgaaactgaatttgccgtttacaaatggcagatctgagatgataaaccatcttatgaattattgttctatgaccaagagttttgtttgtatattatgatttaggcagggaaggtgcttctgtataaaattaatttcttaaaagctttggctcataaaaagattctgctttaaagttcccttgaacataaatttgcattacttttttcatatgtgacaccattttaggaaaaagggattacttaagctttccttcacgagttacttttgttgtgtaacaactgtttaacttatttgaagattttgatttttaatttttatacttttctttggagagtcatcgtataaaggaataaagaatcaagtcagatctcaggtccataataattctcaacggactcttaaaattgtttttcattttctgaagagctgatgaattagtgtttggaatattccagttatgttgtctcagggtctttctgtttgcagtattaagcaacgttgtttttctcactaacttgtcactatgaatttttccattacttgggacttatagtagataatggcaaaggcttcataggtaggaattaataccgtaattattatttaacattacaaaactaatatatttattcctttgttgggtctaaatgagattgcttgctatatggtaccttatagcaacttagcttttcaataacagtgtgttacagtgctcaagagcatggggtttgaacacagtgctagttttgagtccagattctatactttactagctttgttactctggtcaaatcattaaacttcctgtctcagtatcct

SEQ ID NO: 68839 - DNA, 1246 bp, Homo sapiens
tgtaaattatggtagattatatttgtatatttattaacaaatctatgaatgttgttaaggacttctataagtaatgaaccatactaggaatagggcagtgttcccattctcagagactttccaatctgttggacataggagagattccctgtatgtgtacattccctgtatgtgtacacacacacatacacacaaatgtgcaaagattgtgatacaaggcagactgtgagaaatggcaggtatcaagaaagttatatagaaatattgaagacagaatgtataattaacactttggatcaaggaaggcatgttatatgaattaagggcaacatgttaacattagtggttctctttgtttaaatatagaattaaaattatagatgttagataaaattgtattcaaagatggttcttttatgtgaagaagttggtgttttctttaattagtatttaactcatgattttcaatttatctcctgttctctaaagatagataattgctttttttcccatttttaaaaaaaatttttggcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggtacattttcttttctgaatttttccttttgaaaaatagggcatttaagtgcattaaggaaatattttttaaaattgtctttgtttgagcaactatttggttaacttagaaactttctttagctagggtttttgtttttgttcttgttttccctaaaaagatagaagtaaatttctttatatttgcagtttatcatcgttgactctttgcaaaggaaaaactacaagatgttttggattaaccggctgcagagggtcaaggcttctgcttagttttttctagttagtgtttgagttgaagtgttatacatttcttactgccgattgcttattacttaattgttcatgttttcagagttcttgcctattaaaattttattaatttggttaacaattctttgttctttacgttgttcattatttaatttaatatattatgttttctataaaga

SEQ ID NO: 68840 - DNA, 1075 bp, Homo sapiens
tctgggtaaaacaacctaatgattcttgctgaagatggccagagtaatcagagtaattaatttggggaatggtgaaggataaggaacctgatcagatatcaagggtggggatactcttgctaaactgactcagtagggttcttgctaaaactggtttttacaagagagagcacaggtaggtctacaagaagattcgggagactgactaaagtttcatcaagaatctttgtcaggagacatgacctttatgatacttaagtttttctttttatgcggttttgttttaaacaggctaatagctcgtcagcttgctaaaatccatgctattcatgcacacaatggctggatccccaaatctaatctttggctaaagatgggaaagtatttctctctcattcccacaggatttgcagatgaagacattaataaaaggtaaaattatttttacatttgaaattatgttttacattgctttgctctatgatagggtttcaaaggtaattgtaaagtttcattgtataaaatctggttttctttctttgcattgaagtaaagtaagcattgattctttggctgtcagatagcactacagaaataactgcctctccatccccctcagtgtcccctcccaaaaaatatgccctacaacagcaaggggcagaggtggaagtaggggaacaccacttaaaaataaagagttaggtggtaatggtgaagcaagatttttcttgactttttaagatactgcagggttgagaggcaagtctagtattatatagaataagagcacaagagcctggagccaaactgagattaaatcttagtcctgctagttaacatttctgttgtgtaactcattcaactagggaacttaacctaactgtttccttatctataaaatggaaattacagtagtagtatattaaccatatagagtttttgtgaggattgagatagtatatgtaaagttctttaaaacagtgcctggtcatcacttaagtgttgaggtagctgctgttttaaaaattactattgttattcaaagaaggttatttgagttatattttttccctag

SEQ ID NO: 68841 - DNA, 1660 bp, Homo sapiens
atttattaaatgctttgtgtcttagttttgtcatctataaaattgacataaatgtaaattacttagaatagtacttagtaattgttaactattacctatatatattacttagaaacccaagtttttagtgagttttttaacttttgtcctacattttaattgctgctcagtttcttctattcatgtctaaacttactatataggttttctttattctaacttttgaaatagaataattggtctgttgtttgaattcagcagtatgtgcgattaaattgaagggatttattcaaaatagattttaatccttaatcaaacttgaaaaaaatgtcacacaagatataactcttcttttaaaactaaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtaggtatttgaccttagcagtaagtaaaattgatttcttttatgttcttaatggtcattttatctctatatcaacaaaataaattcaaatgcaaggagtaagagcgtgcatgaaacctttaaagattttcttttagtttatcaagttatggtaactgtgaaatttaggatatatattctttttatatttgtataaaatatgttttttagaattggttagaaacagtttgtgatttccatgggatttttaggtataaaatgatgaaatgatttgtttataaatttaattgcaaaacttatttggttattcatgagttgaacatgtacctgcttgtaatgggggatgtggaaaatcaacatattgacattaaactgctttataaatagaaaaattttctcacagtgttgggaaggacaacagtattaaaaacaaatgtgtctccaggtttctcattatctagttattgttgatttgttagatattttgatactaaggagagagctacagatggaggagatattatttgtagttgctcaaatttatatctactaaagtaatcaagaaaccttggtagataatttcaacattttttgaggtagactgatactttttggtgaaatgtttttgtgtttatatttgtacactgtattcaatttctgttttcatatttaagaaccactcggttgtattatattactgggtgaagtggtttgaggtttggttgctaaatgatagatgcccttcaatgctaaattgaaatttaaaaataaaattttggttgaaggagtcttactaacttaaaaaatgtttttgaaactgttttcattttataggaaactagttccccgcaccccccccccctttttttttccttttttgagatggagtttcactcttgtcacccaggctggagtgcaatggcataatctcagctcactgtaacttccgcctcccaagttcaagtgattctcctgcctcagcctcctgaatagttgggattacaggtgcacatcaccatgcccggctaatttttgtatttttttttttttttttttttttttagaagagatagagtttcaccatgttggccaggctggtctcgaactcctgaccccaggtgatccgcccacctcggcctcccaaagcgctg

SEQ ID NO: 68842 - DNA, 2617 bp, Homo sapiens
gaattcacattagcatggtcataattatattaaattactgtttatgacccttcttagagtgtaaagcgggactattcaaatacaaaggttgatagatatagctgactttcactttaagaaaaccaaaggtacactgtcaagagtggtaggcttaagcacatattgccaaaaatatatttgagaattttttgtttgatatttcaatgttgattagagattctatttttcaaaaacatactgagctaacatttttgttttgaatcatcttgaaatgcttgtgtggaatcatttttaaaatttcgagcataccctaaaacattaagtacttgacagtgtcctttaatgtcttattgtctgttatatataattatcatagtacgtatgcactacattatatactggtaaccaaatctcaatgccatttgtgagactagagcattagttacgcattaaagcagtgtatgagcttgtaaattcagtgcaggacctaataacacattttatataatggaatttcaagtgagggacttcatcttacatttgaagtggacactcagctttatttttaactgcaagttgatcaaagagaatctgttatttcctttagaatataattttaaactttcatatttttatttttgtaagtttcttttgcatattcatttcacagaacaaaacttgtttataaaaccaaaaaataagggaccaaaaaaatcagattactttgtcttgggtgttaaaaaatacattttcacttttttatttaagtggtcacttatctctaaactattgatcagttatgtgaaaagttcccatgttttcacataaaatctttattcagtttggctttaagaatgcaaggttgtcatttgtttttgtgccaagttacttgaattatacttttgtgtctaattttcctttcacagaaaaattttacagctgtacagatgaactattttgatacattttttagaatttgccttttttattgaagtctagtttgtatcatttgttttttctttgtctttgtggttatgtatgtgtcttagttacagaaatgttctgttttttttttctctctccttacgtggttttataatgttcattaggaaggctggttttgatcccatagtatccgtttaaaagagtaatttctatgtgattacttcaaacataagcattaagaaatatggttagaatgttcaaataaaaatctaaaactaaagtatgacaagaagcttacttaacctagtctttagtgttacgtttcaaattgggagctaatggttttaaggtaatttaactatatgacatgtttgagtgtttactataagtagaagatgccatgccttatacttaaaaagtatgaattatattatttaataaatttaatagtcaaaaatagtcaatattgagtaaatgtaatatgcaaactagttatatgtttgcatttaatatgcaaataatataatatgcatataatataactagtaggtatgtttgcatattaaatgcaagcatctaactagtagatataggacttaattaacagatatgacatgacgattcagttcactaaaagtggaacttttagtttctatcttaactataacttgagagattaatttagattaatttagaattaaaatgtgtatgtatatgggtatatgtataagtaacatatttatacacaaggcacacatactatgagcaccctgcaatttgtaggcatttttacatgtgaatgttattggaactggtagacatcacaggaagaaattttatatatttgagattgtagcatagcattaacacttatggcagcaattttgaaaaggttaattaaagatacagactgcagttatttaccttctttagttgccttattatagcatataaatgccatgttgagtcttttgagattaagataatttccatatagaataaatgattaagctgcatattcacaaacatgtttgattttttattacttcttaagtcattcatatgacttgagctccaggtttcattattgtgtacccaactttgagataccaatagataaaacgtaataagatgaaagccaggggactggccttggaatcatcaagctcagtatttgtctgcagtatgtttcagacccttaatttctcagaagtacaaattttaggcaaacttcttaaatttatactggattatcttgatgtctctacatatatgtttaaaccatagtaacttagattttgtactagaaaatctctaactcttaaaagcagatatatttatagcttagttactatcaagagaagtcagaaagagtatagattttggaactaaacacattcgagtttagatccctacccagttacttacagaaataagtagtattagacatatcgttttatctctttatgtctttatgtaaacacagactgttcttgacagtttacatcagaatcacctatggtacttgggaaaaaatttggatttcttggccccacccatgaccaattacaaaataatttttatagataggcttagaaattttatgtttaacagattctgaggcagtttttgtactattgatagtctagaactttagtttgctttatttgta

SEQ ID NO: 68843 - DNA, 2993 bp, Homo sapiens
taaaaaatttaaataaatacaaattgatttttgtgtttggtaaactatgttttctagggtggtgtttttaaatgtagtttaatttttaactctgttttaatttgtattctcaaccactagttagcagaaaataaaatatctgtaagtcagataataaaaaacttaaatgaactgtaaaaacctgaagttatgaagaaagagtgacctaatataggtactagtttgtttgttttttcattcattcattctggcccactgtgttcagtcttgtacttgaataaaaatgtcagaaacaccacacttttttctttagtttttcatgcttttttgtcttttcccctcccccagcaaacgtgttattgtgtgtcagcattttctgcaaacttcattttttctactagcatttaaatatttcctgtgtcctagggattgctctgtggattgcaggataaaagagggaagggaccctagtgcccctccaggaggctgtgtatcttgtagtggaggagtccaatcactgaacagatacttacatttagaatgatgagtgctctggtgaaggggtacagagtactacaggacaccagcgtgaagattaaagggaaagtgtttcagactagaatactccctgtctttttctgtataaaatagaaaacattttgctaacattagtaggattatagttacttttcgtatcgttctcttcgaacctgcctaacattgcagagcaagtagggtgagttggaaagatttttcaggttctcatattgactattttgcttttcatttttattcctttctcctaacaacaaaataaaggaattcagacaaacatgtcatgtgataattatatagccttgggtaatacattattattttttagttttaaagtactttaaaaattggcagagtatttttagtatactaagatttgaacagtttaaccagtagtgtcgggatttgattacgctgataaagatatgcaagaaataaagtaataaaagacaaaatgtaggtttggaaaattcaaattgtagttttatccattaatcatatactttactttgtgcttgtcattgtgataattacataaagataaataaaataacacacctagcccttaaagtagtagttctttactttttaaaggtcaggggtcccttgagaatctgaaaaattgagaatctcttcctaagaaagtgcacatacacataaaattttagggaatattctagttgtcttttcatccttgaaaccccaattaaaaattcatgtcttaaagaactgagatgatgatcatgctatatgagctagttaattattaatgctgatgtggatattcgtttaaataaagcgaaattttagaaatcagaagttaaatttatagaaggaaaaagtatattttctgttgttaggaaagcattttccagtaatttgatttttctggcaccctaactaagggaagttggctttttaaattttactttgttgcagaagattaaatttaaggttgagttccactttgtttgcaatagtttgaaaaagaatagttaatgcagattttttttttaaatttttttccttttaagctttgtgtcttgtacaatgtgagtttgccaaattttcttcatctgctacagattaggtatgccattgttgctgccatgtggcggcgcaccccgtgcttcttaaacgcactgactggaggtttatcgcatcacttgttcacatgcacggagcctggtaacagcctcatctgtatcttgttagcttcattttcttatttttaaaatttcattatttataaactcaacatagcatttaaaaataaaggctagttttaattaattaatgttactacaaaaagtcattgctaaaattttcatagtgaaacagattttaacttttgttaaaatgtgctatgctttaattaaattgtatttactctacaagcagggatgttttacctgccattttaactgtatttgccaaattctaaatataattttgaaaattgaaattgaagcttatgtttatgtggcaaaagtaagcttcaggactgggctgtgtatttttattggcatgtaacagttaatatgagctctacaagaatttgtttttaaggagctaaagctatcaacagctgcagatttaaaaaattatatattaaaactgttaggttagctcagttgtacaacttagtgaatcttgtatcctgagtttctgaaggctggtggataggtatctctgaaatcattgtgttttagtctttttactgatagttttgtatagggaattcatcttctcttttaaaataacttttttcctttaatttatttctattacttattgtacataaattttaaaataaaaaaataaaagaaaaaagtcacttgtctatcacctgttaatagtttaaacattttggtttatttccattcatccttcccccccatgcattatttacatatttttttttctctgtaggcatattttaatttggatcacagtttactacttagtatctccttttcatgacatttgtaatttccctggtcattatttttgaaaatgagatttcttcatggttttatttcattttattttcatgcctgtgagtattttatcatgatggttgtcttcactctcctactcccaatgattcctagaaaagaaactttaaaacatgtttctacttcccattctgcagtttagtaaaatgatttggttaactcttaaaactttttgtggaataatgttctgtgaattcaagtatacaaggcaggaggatcacttcaggccaggagttccataccagcttgggcaacatagcaagaccccgtctctacaaaaaacaaaaagagaaaaaaaatatataatacttgaggtagttgaattgccgtgatttattgtcaccaatatttttaaatcttatatttattataataatacacattacatttttataactgggttataacattgattattct

SEQ ID NO: 68844 - DNA, 1081 bp, Homo sapiens
atagcattattgcaagatttacagaattcaggtctttaaaagtttatattttatttccatatgtagataagcttgtcagtttactgttggagtatcataaagtttttgttaaaattacacagattattagtaatttccaaagataaaaattatgtttctaattaaacttgaatttttaagtaactgatgcccccatgtggcaaaggatttattttgcttttgcttaaacttggagaatgactgtcttttcatttttctttaaaaaagtggacattagtgtttataaagaagctgttgaccaagagacataatttgaattttgtaaagctcattgccataaaattcacagccccttaccctgtattgtctcacaagtgcatgtaatcaagcacgtacaatgagacaaaatattggaagctatttaattacaaatagcatagggattttctgatcttatatgtgatttcttaatgtctttgtttttgtgtctcacataggtgatgtacagttcattgattatgaatattctggatacaactacctggcatatgatattggaaatcatttcaatgaatttgcaggtataactaatggagtaacttatttagctttgaaacgatattttcagaatatttcattctttttttaaagtagataaaccgtgagcagggggaacattttcccacgtgttgttgaccgtttttctttgcttttgtttatcactggaagaaagcagagatgaccaaaatttcttccttaattgctatcagaaagtaataggtggccgggcgcggtggctcacgcctgtaatcccagcactttgggaggccgaggtgggcggatcacgaggtcaggagattgagaccatcctggctaacacggtgaaaccccgtttctactaaaaatacaaaaaatttagccgggcgtggtggtgggcgcctgtagtcccagctacttgggaggctgaggcaggagaatggcgtgaacccgggaggcagagtttgcagtgagccgagatcgcgctactgcactccagcctgggcgatagagcaagactccatctcattaaaaaaaaaaaaaa

SEQ ID NO: 68845 - DNA, 1076 bp, Homo sapiens
tctctacagatagaccctagtggtatatgggtatgccatttttatagtcttaaaagtaccatatgcccagagttactcagaatacatcccaagtaagaaggtgtcctgaaatgttcctttacctgctgttcttctatctattttcagtacagttactggttcaattaatgacatgctctacagctggtcctaggatgcctgcttttctatttattgtatttaagcatgatcttagagaatgtagggttttctttctcattaggtgatttaatgaatttcagattcagcctaatattccatttatgcattgaattagttaatttccaggtaaagtacacatagctcatcaattcttaaccatcaatcccactgtttgctattagaaagctgatttggatttccttgcaaacttttgatgacatttaagatttttgggggatactgtgactgtatctgtacatggcattgaaaaatacctttgcttctgatttgatcaattgtttataaatattcatcaatcagatactaagtacttactgttattctaggtcagtagattggaagaataaaaaaaatgcactctttcaaaatgcttataatttagaaggccaaataagatgtacagaataactcttttggtggtaaaagttaacactcatttcttttgaaattgattttattttaatatttacttttatttttattttgagacagtctttgctttgtcatccaggcctggagtatagtgatgtgatcacagctcattgcagcctcaacctcccgggcttaagcagtcctcccacttgagccttctgagtagcaagcgccaccatgcctggctaatttttttaatttttctgtggagatgaggtctctctatattgcccaggctggtcttgaactcctgggcctaagtgattcttcccggctcagcctcccaaagtgctgggaatttataggtatgagccatcatgccagacctatttttttattagatacaaggtcttgctctgtcacgcaggctggaatgcagtggtacgatcatagctcactgcagcctcaaactcctgagcaca

SEQ ID NO: 68846 - DNA, 5549 bp, Homo sapiens
tatgtagtctggcagtataaatataaatatttaccatataatcttggaataagtattagttaatgttaccaaaatctgtattaaataatgttttcaaatgctaaatatggtcgttactattttcagttttaaaaattttatagtatcaaattgtttctaaccaaaaatttccttttacttctagagatgctttatgtttttgattattaaatagtcactagtattgctaatttttgaaacaaatacacaaaatttatcatatgtagaaataagaaaatattgtttaggttaattattttttacctatccagagtcattccttacatttcagtttcatgtttcattcctcacattttagtttcatgttttagtttgattctatgtttttagactgatagcaaatgattacttgatacatgtaagttcagcgttatatgttgaggcagttatataattaaataaggaacacttagggcattgatcttgtacacttaaaatctgacaaatgacaaaatgtgaattaagcataaatagtcatggcaggagggcttttgtttatttctcttgtttttgtttaactgtatttttaattttgtctggtggtaagagggaggtaattattgtatggaaagaagttagatctttcagatagataaataggcttcaggttttgaagtctgctctgtgtagttgagcagtcatggttaactttacttagaaaattagtctgacaagctttgcacttcggtcacataagtgcccatgtacaaagttggcttactggatctgcatattcaaaatatgcaactacaaatttatcctctgagaaatcttctgaggagtctaatgtattccaaatgacttaatattctcagacaaatgctttaaaatacttggattatctcaagatttttgaagctaataaagtaaatagaaacacaggccattttaaatggtaaattctagttacataaatataatcttaaagtatgtttgtatctgtaacagtgttagaccagatttggtttctacctccccaatgttataaatgttcacttttgtttttataaaccatattactgtaagatcaatagaactttgcctagttaagtgaatggaaccaattaaacaactagtagctttttataatgttagtgtgaacttgaaaaattgtttttggtggaatttttgtctgtggttagaacattttcataaaacagataaagaatgtgtaatactcttaattttttttttttttttttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctgtggttgtggtgtgctgctacttaattataggtagtgacacactgaaattcttatttgtccaataatctgaagtagtttcctatatttatctgtactaaattgactataaattgagtctgcaaagaggaaactttttgactgtactgtatttaggagcctttgtacagcttggtcaaatttccatgatatgaagtatttgagttttaaaatatactgttattaaaaggaaaaagacatggccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgtaagtgctacaaatagtctcagcactgaaaatgtattgatacctcttaaatgaatgcaacttttgatgtaggtgttttgctatgcctcagaaaatatctgtctgagaatttgttaatctgtttgataatgaagatacttcctgttttcttgtttcatattttcatgttcaaaatttaagttttacatttttactactgttaatttaaataaaatttgttctgtggataaaatgaggttggcagtgaagaaaattaaaaacagcctcattcatgtaactggttaagtaaaaatacattttcactatgtgttcataaacttttaatgaagctgtttgtctttcagttcaaatataagtgatgtttaggctttatttctgttaataaggctttttaccattgattaaatgaaggaatgtatctttttgaagagatttatattctgtaaataaaaattcgttgtaacaataaagttgagttctaactacagtgtattcataaattttattgttacttcaacttatttttgaggttttccttgtgaatatctgcaaacacaagactttccaaagttagtgtataaatgtatatgtggagtgattctttgaattctagttttttgttttctgtttttttagttttatatacattaaaaagttttgaaaaaatgtttacttttggaaaaatttggttgagatgagactatggaatattacataacttataaacatttctgtttacctagtttaaaaattcattattcttctaactattatgctttgtgtcttcactattctttggaaccagagttgggaaacatagaggaataaagacactgtctgagacttagcatcttatggtctaggcagggattatccatttaaacaacaaactcttaaaattatcagatagtgtgatagatgatctctgccttcaggaaatgtttatttgccatgaagatcagttgtccataacaaaaa

SEQ ID NO: 68847 - DNA, 1075 bp, Homo sapiens
gcttccaacatattgtcagttggctcacaaaattcctgaagatttaggttggctctcaaaagctggtgaaagctggctccagagcaatactggatccaacaaaccagcgggcgaggcccacccattaagtaaaggatagagccattctctatatcttgctcccagctctaccctggacactcagggcatgaagaaatgcctgttacggttcatgaattgcctaaggtaacacaagctctcagagatagaaatgaaactttaaaaatgaaagcatggatgtgatactgtctttttccttctcatcctttttgattggccatcagtgtgtcttgtacagtttgagtcataccaaagaagatttctcaactagcaggatcaaagttctttttaaagagttgattttttttttttttccggagctaaaatggtctccccagctgctaagaaaagaggaaactgtggtgttttctctggaactttccccaagcactctagttttcagtggggtcagtgtgataccattccctaagaatgttttggaaattcactgggaagatgtttaatcatcccagtgattttaggtttcacaatggcttggctattaacaatagcatgcgagaaggcaggaatgctaaggatcttgtggagcataggacagtctcacacaaagaaatgtcctgtgttctgtacaacttcaaatgttccccccagccattcttgcaggtgaaaaaagccacttacaattttctaagcttgcaatataacttcattttacctatggacatgataggcccttgtaccgcctaaacatacatgaaattttttaagaatgcagctgccgtgtaaactgaagggaaactacctgacactttgttgagaacattattgagcatgacatcatgtttaagggttatcccccagtttggaaaagcatatcattgccaataagatgacccagcattggtagctgttacacattcaaggtgattttaagtaataggaatatagttattaattaccctttgtttaaaaatgtcaaatataaattgtctcttaaatgcaaagatttattaca

SEQ ID NO: 68848 - DNA, 1050 bp, Homo sapiens
ttgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttacttt

SEQ ID NO: 68849 - DNA, 1055 bp, Homo sapiens
cttatccgaaaagtgctttttaaaaaacgcaatgctgttgtttcttttctttatttagtataatatcgtgcgtgtgtatcatactatatgacaccgtatacacatatatttatatatatgctttcatgcctgtatatatacacaaacttccaaaggttggacatcagcgtgcatttcaggagctccagtaattttaatcataaattattttgctttatgttcacaaaattctgccttgaaaatacaagttttgctccttagtgacgacacatgtaggcccattcaatttttttgatgttaagtggtattactgtgactagtgcatatttataatacgtaggaagccatttagatggcatagtgctgtatcattgaatctcagtacaaaatatacagaatctcttaacataaaccctatgccaaatagtaaaataaatctttagtagcaaactgagtttacaataatccatgtataacttgacactacaccacaccagaggctgtttttcttaaataaagactgcctgtcaacagaaaccttttttaaattatccctggaatttgttctattggaaacgtacctggacgtagtgaaccatgttttatttactgttgttgtctcctccagttttcaatggaaaatatatctattttcacatattttacatcctatatcaataataactttcaagaggcatagtcttgatgattgctatcagaatttccaaaaaaggaaaaagaatttccttttttgctatggccctgttcataaacaactgaacaggtaattactgcaatgtaataggatatagaaaggatatgtcatatgcttttcttaaaagagaatttgtatttctgtgaaagcaattgatatttgaaccatttcctagttttcttttgaataattaaaatcagtttgagagcccagtatttgtgaagtttgaatggcattagagagtcgccaattggcattgcttggtagttctactatttgtttcagtttttagttggggaatatttttgtattctgggagaagctgttctaaaatatgtca

SEQ ID NO: 68850 - DNA, 1043 bp, Homo sapiens
ccattctgtctcttgggaaagttagtgtaaattgctagtacctaggtgacaaaatttaagaaggaatgcattctcagtgtcttgaaaatacagaagagttgacagtgtgctacctcaagagtgaatgcctgcttaaattttgcaccttggtgcttttcttacttcaccattgtctggtccagctctgaagacagagatccggtttatgttgcttctggctgtaccctgtagttatgatatatggacatttaatttttgtgttaagttcggaacctggcttcttagagcttccccactattttgcttaatcttcacacaacatgatcttgcttaccctaaatttgcgtcaagcaattcagcaaattctgcagaaaggcactttttagaattccccacctataccccataaaatacagaatagttttatttgtttttccttcagtccagtatagttcttcttaaatattcatgtgctgaaaagttactctttagggttgggtactacaaaatacatattgtaccttctgggtaaataaagctattttcaagggttattttctttataagctacttttggctaatgtactgattttagtgtctgcccctcaccctaaaggcctagcagagtgtatgtcaccgagtaggcacttaataaatgcatgttaaataaatggcttacactgtaactaccaatttttttactttaaaatttgtagtcattcatgattcgcatatattttatcaagaattcttgcagtgatgaaaaatatacaaatgtatatctacttattttcatatgaggagaatttatagttacaggaagattactgtaatttcagaggaagttcgaaaatccttaggtgaaagtcttacatgaaaaacgttttaggtctctcctctattttccaggttttatccttgaaattttttgtcttgactatcaagtccaaatttcgaaaaccttaattaaggtctcagtagatttctttataatattagccagttttacctttaagactacttagtgacagagaacagaagga

SEQ ID NO: 68851 - DNA, 1015 bp, Homo sapiens
agtttgcattaatgcttacatccattagtggccccactgggacactggagtgtacttctaccactctgtgtatggctggctcctccttgctagtcagatcccagcctaaatgccatcattttagagaggccatctctgaccgcacaatctagatacccagtcactgttgatgacatcattcattttaattctcagcatagcagttgtcaccatgtgatcatttattctggcttatttatgtagttttgtctctccttgtctgtcttattttctgttatagtcacatcttctagagtagtgcctaacacttagtaggcatttaataaatatgttaaatcagcagttgaaatcagtcttttaaatgtatagcaagtaaaacctgttaatgaactgaactctactacattctgtacttgagagaagaaagtaaatattctttttttctaacagagtgaaagtgatttttaaaatgagtctttagcacaaaaagaggagcaatttgaagtagaattttaagctttttctttcccagaaaagaattacgtattaaaaaaaattggctaatttgataaaatctataaaacaaacctctaaaggatcataaatggggattatgattccctaacttattttttccaccctagaacattgaaaggaagcatccttagaactttgaaaatctggtacaacccctacttgacattaccattgtctgtcacttcaaggaaaacaaaatcattcacgtccatgataaaatggatcattcaaatctgttatttagtaccatgtggtcaactggttgattgactgcattttaaaacttctctatggactgataaattacccaactgatgaaagaaagacattgtatttctcttaacagtacattatgactcatgtaatgaatctaattgttattattgctacattatcaccttaacttgatattgataataacagtgatttgtacttaatgagcacctaaagtgataataagtccttttctgacaagata

SEQ ID NO: 68852 - DNA, 1148 bp, Homo sapiens
tgttttgttagtttgttttgtttgcatttggctttttctgtgtctgtctttgcagcctgattcatggcaaggctgttttctttcagtccaggacagattttaacttttacaaataagtgaatgtatttttaaaaatacagaggaaaggtactttttttaatccctggattattacttaaaaactagatagtggaaactaatcattatgaacggttgggagaatactgttctccttatgttcagtgtttaaaagtgaatctcaaataaattgtcaacacttatttttacttttcctttgggcagctttctttgccttgcgtcactgggtaattctgtgtttttgttcaattctcccatctctggcccattgttcattcttaatacagatagagagctatagagatgtgctgagaacattttcaccatttcttcattttcttgttcacctccctctctcaaatgtctttggtttaatggatcagaagcctggttttgtgtatgtgtgtttatgtgtgtgtgtgcatgtgttataaataaacacatttataacacactgacacagacacacaaagttggttttagactgtttttattaaagttttctctagagcagaaacaagtataatcaatgctagaaattgttaagccactttcttctgaacctgcaatctttaaaattaagtgaaaattcctgatggcaggctttttcatggtatcctcacacacagtgttctctgttgcagaatttctcacagcagtggtttttaaaaggtggcagattccatccattccagcagatacttttcttcattccttctgaatgaacccactaacacaacccttaaaaatttattatttttgtctttaaatggataccacagctgaaatcatatattgtttgtctcaatttaaacattaatgtttcttcacctgcatttatcaacctgtctgcaaccagaatgtttagaagcaacaatttaaaaaaaaaaattacctcatcattttagaattcacaagaagaggtgttccattagcaaactgctcaatttctgattcagtagaacaagctaatttgccctaaagtagaagcctcccttcctgattttgtcaaatgttacctgggcagctctggtcacgtggcaaagaga

SEQ ID NO: 68853 - DNA, 1086 bp, Homo sapiens
ttattgaaattcagagtacattgacccataggataactgtaatgagctggatcttcaatctatccaaccaaatcccatttaggtatctatttaaaacagttgcgttgccccattgaacaagtaagcatttagagattagtaaattatacctgttgacattgaaaggtgagaaacaagttgtgactatataagttgtatttgtttctctgcatttgtttaattattgttttaattaagcttatagattctgcagagtggaatgttaaaggtatttcacctaccttgaactttgaactaacttagtgcagtatttaagtgtgttataataattgtatgcaattctgggcattaatttagctcaatgaaggattttaatgttttggatttatatttacttaatcaaatatttatacattttaagaagtttaaaatgcttaactatgtataggaatgccacgataccatagaaatgctaatgaaacaaaaatggagatcaaatagattatgaagtcaaaatgaaactctactacaatgaaaatggaaagaaaacactgaagataaacacttggaaatgagaaagtaaaatatcattagactaatcaaagagaagtactaaatgctaagcagaaataagttgtaatcatcatggacaaacataaaacagaatatgtcctataacttggaacactgcagataatttggatattgttttcatagcatgcacccttctcaattcatgtgataaaacaccattatttaccaaaagacattttctcacaagttttaccttctcaattaactattccatgcatagatttttaatgctgtagaaagaatatggtaatacctttaaaattcctatatttcttttattatggacaacttatgctcttcttttgagaagtaagccattgaactcattaattgttgtatctgagaaaataagatgtatatttatctttgcaatgaaatatatgagtacataaattaattgtattatagtttcttaagcattaagttctgctagaattatgctgggtacagctgttttaatacatacagcagataaacattaggaataattat

SEQ ID NO: 68854 - DNA, 1583 bp, Homo sapiens
acgctaatagtaaccagagaatattgactaccatgtatgaaatgagagttaattaaatcaatttctatgtaaataaaagatctcaatagtcaaagagtctcctgggagcattcagcagtcattgtgcaaggttagttttagtcacgtttctcagtaagctagagccacactggcctttgaagtccccattgccatgattgtggctaatggctgtgtgttcattcctgggtccagggaagtgtcttggttgtttcaacaatgctcacaactctcactattattgcttagttatgagtgaagacttggtggtcccctccttccttgtaatccttccttccttgtaacccctcccgtgttactgcttccacagctcccctggagtgtgtcttagctcctacacatccaggtcttctgtagaacaactaccagtggctttttcagttttcattatacagagagataaatgtctttgtccttcagtgtgatcagatctcttcaattaaaatgacttactcctaaaggaactaagcttaaagttattctatctggatgcctcagagattttgttatgttttagcatgaacattaggacattagggattggacacatttttattggcatgtaccttgagagaacactccttacccgcttaaagggaagataaatttcgactatatcttcatgcaatgcatatgcttaactctctgcttttagctaaatggtaagagtcctgcaaaaagctgtatttaaaatgatacgccaaagtaagtgtgtctgcactgattcttgcagagttaagaaccactcttcaatgatactttgataaagagtattctgataataaacattcccaaatttttagtttgcaaatattatggaaataaacattaaaaccaaataagttgaagctaaacgttgtggatgttcttgtcatccaacaattatataaatattggccttaaattgaatacacttgttgtttggctttcacatgtttggaagcaaaataaagaaggaagggacaaacatctcatagatccctgtagtcttatgagacagaaagaaacttggtccaatcaacttatttcacaagtctaaataactctcctctgtcacatggaacattagtaacagaactaaatctatgtttcttggcatgatgcaggtctactacattatgctacctcacaggttatggaacacaaatcattctgtatactacattgtgcacacacataaaaataccatcatatttgccattttgccaacttatcatttgataaagaatgctattggtactaacacttcactttggattatactaatattcaaagaaatcaagaacttaaaaatgtttttgatagagtcatttccctggagaagttttctgtttagctagatgaaataaaaagatgattatccattcattaattcatttattcatacaaggaaaattcctactctcccagagctttcattcctatggaagaaaacataaagtgaagattttgatgtgtatgtcagtggggataagtactaagaagaaaaataaagcagagatactagagaacactgaaatacc

SEQ ID NO: 68855 - DNA, 1518 bp, Homo sapiens
aatgcagatttgattctctcttctacagaactcttcgatggctcccagtgcactgagaataagtcccccaatctctaacaaggcttacagtttcctacctggcttcctctgtgacctcatatcatgccatttatattttttgctttttctactgtaaccatcatgcccctctcacctgcaggcctttgcacacacatgttgtaccctctgcttagaatgtgccactctttctgctgctgctccttatcccatcatactcatgcccatcagctgtgatgaagggccctgccatgaatcttttcttgattctccagaggaggtcaaattcatgccacacatactccatatgtctactgggctgcatcctgcactttttctcagtaactctgtgtgtgtgtgtgtgtgtgtgtgtgtgtgtgtgtgtgtggcagagagagagagagagagagaaacagagacagacaggcagggattatttgtataatgtctgttttaccattagactgtaagctccaaaagagggaagctggcttctttgttcagccttatactgtgcccctagaatactacctggcatatagtattgacaaatcaatatttgtgaaataaataagaatgaataatcaacctgtgttagtccattttcatactactgtgaagaaatacctgagactgggtaatttataaagaaaaagaggtttaatggactcacagttccacatccacatgactggggaggcctcacaatcatgatggaaggcgaaggaggagcaaagccacatcttacgtggtggtaggcaagagagcgtgtacaggggaactgccctttataaaaccatcagatcccatgagatttattcactatcaggagaacagcacagggaaaaaactgccctcacgattcaattacctcccaccaggtccctcacacaacacatggggattatgggagctacagttcaatgtaaggcttgggcggggacatagccaaaccatatcacaacctgaatacaaaatccagaaatgactcaggtcaaccaaaaaaatacaacctgatgtacaaacaccattacaagcattaaatatcaactttatttcctaattacaggtccaaaaagtataatatattcatttcacttttctacatttcactttatttttcgcccctattctctttagagaataacatggaatgagttttacatgaagaacagagcacatgcttatctactcttgtctcattttacaggtatctcagccttttagcatttttaacacatcgtattgtgtatgtccactaatgatttcaaataacttgtattataaaatgtaggaaataattaaaatatctaagcaaatgaccaatacagtaatatttatgatagctataaaataaattttttataaatgcaggccttattaataaaaattattggaaattagtcaatgatactggggtttacaggatttatattcaactagataaataaatttttccattacttatatttgtgtttc

SEQ ID NO: 68856 - DNA, 1035 bp, Homo sapiens
cctcagcctctcaaggtgttaggattacaggtataagccaccatgcctggcctgaattgttactattaatcagatgcatttactcccacttaccttatcaaactgaaaaactatcacgagtagattaaccatcttatgaaattacctcacaacccaaggacttttgtactatgacatttttataagactgtggcttttttctgtgttagtaggccctaagaaccaaaaaatgcaagaaattggtatgtggttgcccagatggctgttagagctagacgcacagagtacattaaatttatacattggatcagtgggcttgttgagtcctttcctcagattctaaccacctcagtggcgatgtgcacttcgtcaaaatgaactaacaacaacaacaaaaaatccttcagacaattaggcttcccttgctgggcttaaaataagtgagtgtgtagctctgtattaaaaggtgtgctcttgatagagtcttttttgaggtttcaatcaaaggactctgcttttcagtgagacctttaaacaacattggtctttccctcaaaagagaagggctaaaaagagtgctggactcaattgaatttaatagaaaattcattggtgaccaatgaagcagaaaggatgtgctcaaatcactgggctgaacgctctgttgtagagatcagacaagcccatttagtgtctgctggttcacaccagcttcagaaacttgctcaacagctttagctcccagatatttaaatggcaatgtttacttgttttagtgggaaaccaacaaatgaagaatctgtaggtggattcgttgtgtcaagctggtctctgtctcgaattttagttccctggatagcaagttgggtgccaatgctttgacatactattgtcatgttgagttatgtttaacttaacttgattcagcctaatactaggtttgggataatcttaaaatatcctttctgtaaatacactacctttcaaagcagattattcagtaatgagtgtgatataacttgcgtggtttaaaaa

SEQ ID NO: 68857 - DNA, 1168 bp, Homo sapiens
tctttaagttgctcacttacttcaagtttattctttcagaagttgagcatctctgtcgtttagtagtggtcagattaagtgtgctgttctgcttacttgctggctgaagtcctttttgttacttctagtgtaagcttttagaaagctacaaaatacagtgacagacactatcatattcaattggacatgctttctgcagatttgttaaggatttactctacacatttgtagcatttagttgccatggagatgacctcagtggtaagagagacagcctttaggttggacctcagattttcctttcatttccatttaatttgatttgactgcaaaatgtcactcccattgcattgattaagcttcgttgctgccaccagcactgttaggaaggtgaaagggcaggctagctgctgtcattttgcacccctacccttttctgatatcaatacagataggctttggagatgagaaactccttcactacattgatgcagacacaattttttcttgctcacttcgtgaactataataaaactgaaaatatgctcagaaatctttattcatcagattcactctatacatactcaatttttctctgcttcagctccacagtattgtaaggtatgatataaaatgtacgataactaaaaattaatatgtcttaatgtttccctgaaatatatttttttaaactcagcagctggccactctctactaaaatagttcttttatagttcaaataaatttgaaaaaatacaagataattatacaagtatgaagcattattcttgttcatatggattggaagtgtcatctttaggtattaatacaggtcatttgaaagtaaaatgatacagtagacagttttcctttggtaccctgtatactcctgtcggtttctttctttattcccttccctgattcttaatgtctccaggaacccagaactcatctctccttttagattgaaaaaatcgataaattaattcaacaataagatttaagaaaataaatgtgataacttcttaggattatcgtacttatatttaactggagaagcaggggacattatttagcacaagaaattgattgcaaataaaactccagttatatgtggaaagacaagttgacaggaaggcttccagatactctacacatcatagcacct

SEQ ID NO: 68858 - DNA, 1053 bp, Homo sapiens
ccctgtcatccccgggggcggctggccgggggaccctggagcgccggcttggaccccgacccggagacgggataactttctatttttgttgggaagcctgcgtactgttgctggtattgttttgtaagtggtggcggtggaggtggttgatgcgagaggagagtgcggggagaaccctgggctgtgctgggcatcgcggccaatgtccaaggccagaccctaaaagttggacaaagccccttaacccttctaggatatcagagcgacccctggcccaccccctaaccttagtcacccccacctcccgactctttcgtctttttgtttcgctttctgcaatccttctccctaccactccccctccctcccgcccggaatttctgaaacaagtctcatccttcaggattctagggatttcagagaccggaagctttaattctaattgcaactactttttccccccacctcactcagtgtaccaagtgaagaccactcacgtgttgtgtcactttaagcgcgggtttgggaaatctcgcttgcactttggggctacagcaataagaagcaatgaaaagaggttatacgagttgaaatcaaattggatttggaaatgtttgcgttggagagcagcagtttgttgagtattgatcggatgcacacgaagcactgtttacatattttattagtcattttccctacactttgcaaagcgactatattaataaatagattgaccctggtgaatatctgaagacgctggtttctgtgactaaattcagaatgtgatgatgaatgtgaattcattttaatgtgttcccttctcagctaaagcaggtcaagacgaggaatcctgtgaatatgcagagccctacactcggtgccaggcagtccaggcactctgggtggcagtcaactgtactttcttacaaaagtttagggatttgctggaacccacttgagatcctcacatacccagatagccaaaggactttgtcaaggaaggcataaggaggtgtccccagggactgccttctggctcagcagagttcttta

SEQ ID NO: 68859 - DNA, 1029 bp, Homo sapiens
cttctgaactttgttttctttcttcctgaactttcttgcttcctaaaacaaaactgacctcagacactgggaaaaatctaaaatgcatagctccaagctcatcatctgaggatgtaataatgagtgtgttgttgtaaattacttttcatcatggtccgtgctgccttcaaaggtcaggccttcatcccttgtgtgttctgtgggagtacacggtgcatgtgaccaaaagcagagctgtttccaacaaaattcagtaaggtttttgcccttctcacaaaagttgtgcttttttaaggtaaaagaatctacatttgattctctgaatctagctcattttaatatgagccatttttgtatgcaaaggagtgctgacaccagcaagttttatagtactgattactatggaaacatttatctataaatataaaatcctttaaagcttagccttttatctttatagaaaaaggcctgtttatgtcatttctaagattccagctttaatgtagacatgagctattctaatgccaaacaagataaccttagtgttggagccgtgtgagttttgaaaagtggaatttgtgctaaaactattattttttgataaaatattaataatgaaacgaattttattttattttattttattttgagacagagttttgctcttcttgcccaggttggagtgcaatggcacgatctcggctcaccgcaacctctgtctcccgggttcaagagattctcctgaaacaaaaatatttttaaaagcacacttaagccaaaagctctggtttgttgaattccttttgtagaatttatattgtgaatatgtctcacatttttttcctttctaactcattgttccctccattctttgtgcatgtgtatgtgggtttgtgtgtgtgtttgtaagctgtgatgatggccaaaatggagatgattggtttgttaacattttctgttggcacatttatggatttttcttctttaaagttcatgtaaaatcagaaatgatgatgtaatatgtatgtt

SEQ ID NO: 68860 - DNA, 1033 bp, Homo sapiens
ggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatgaaatcagcattgttgaatgcatgaagtaataatgctaaattaacatttttatgatgtctcaaggtttctggtcaagggaagtaaatgtaggatagtatttttacaccaaaatgacacagagagaattgagcacaccagaaagaccagaaaccacaccactggatagagattcaatatgtttctttttcaaacatttggacaagaaaaaaatgggcatttaaaaattcttccttcccctggttatggatttatctgtagtaaaacttagctttgtcgtttgagatttgcacagaatggggggagtagattacctcttcccattcattgtcataatggatctacatcactg

SEQ ID NO: 68861 - DNA, 1407 bp, Homo sapiens
agagcgtaacatcagctagatggtaacatgcaatgtcagctctcttgaagacatgggaaacctaagttacaccttgggttaaaattcttcaccatattagttttgttgcttcataaaatttacctaagcaagtggtcttgcttgcctcaaatccaagcagtcttgaacacttggaggcaattaatgagtatatcttagtcaaaagaattgttggagctttttattaaagctacagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacattgtttgttcactttcaaagagtgatagtttctaaaacatttagagcaataaatattcatcagaggtaccaagtaagccggcagaagagttaagggttagagaaatcccttatttcatgtcttgactctaaaattatcaaagtacttttccttgtaatgtggatttcttcttatgcggatatgcaaaaacttcagttatacgtagtaatgctagcaggtaattttagtagacattttataacaactgtcactttgtttcgccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatggcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattt

SEQ ID NO: 68862 - DNA, 1032 bp, Homo sapiens
gtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtg

SEQ ID NO: 68863 - DNA, 1854 bp, Homo sapiens
ccccagattctgattcagtctgagatgaggtctgggaatttgcatttttaacttgttgtctggtgatgctgatgctagtggtctgagaatacactttgaggatcactttttcacagtaaaagtcacagtcattaagcaagttaactcaatgagaaatgataatgaaaaggcatgtacctaaatagataaaggacctataccagctatgaatttgagttcagcaataattgtaaaatttgtaattcttttcaggtatttggtttttaaaaaactccctatgtatgcttttatcttatgttttatatggtgtccctcttttcctctctttctctctaatccagtttttaatgtgaacatgtttaatgtgaaaatgttgttcaaagcagaagcgaaccttttgtgtaaccttggcggtattaagtttgtttgtaagctatttctgccctgttagcttctgtactgaaacacgttttcttgcttttgttgcagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctcta

SEQ ID NO: 68864 - DNA, 1050 bp, Homo sapiens
aatatatagtttaagcagaggatgggagacggggaaaaaaccttttctccctaactttatatactccctctataaattagtgcttatggccaataagaaatgaataatttcttttttcaccgttggtagtaaagtataatggtagttaacacaaaaaactaaatgatatattcagaacctcatactaaacaaagaaacaaaggcatgcaatcacaggacaggtggaaacagtggttctgaactaaccacaaaccagaactaccaaatgtgctacaaattgtttagtaacaaaggaccatcccttcagaattgaagagcacgtctcagttatctcatgcctatgtgcatggaacttaaagtctcaaaattactcttacaagatggcaaattgaggctgtcagctaagctcctagattgtctgtttctccaagaaaaataaatttcagtaattattaaggaaaaagcatagaattgcatcatgttttacatttcattacttttggcatgacatgggagcatggatgttttctacaaagtgctctgataaattgaagaagaggccaacaacagccaccgaaaaaaccttcaagattcttgccagtatggctcaggggaaaaattccctcataaccacagatttgacttttcaacttctgtacttctgcatatgagtaataatctctgaggttaagtattcatcccatttagctaattgtccacataactccctgggtcttagattgctctataaatacctcctaagagaagaatttttcaaatgacagtttcgtttttcctttttcttcttttaaagcaacaaagaaaagcacgtctgtgtttatatttaaccaaacttaaacttggagagcattggccgtgttgtcgacgtgtttcttttctctactgttaaattccttactgttccagttactcaccatcatactcacctttgcctctgccacttggggtcctctgttctgcagttgtgttctgctctctgatgcctccaggttttgctgcaccttctagaaattgctcacctggataagg

SEQ ID NO: 68865 - DNA, 1034 bp, Homo sapiens
taaatggtagctataattattaatattatataatacattgttctcctttatggtaaagtaggttttaagacactgatttttttgttttgttttgtttttggagacagagtctcactccgtcacccaggctggactgcagtgacgtgatcttggttcactgcaacctctgcctcctgagttcaagcgattctcctgcctcagcctcctgagtagctgggattacaggcacccgccaccatgcctggctaatttttgtatttttagtagagacagggttttaccaggttggccaggctggtctcaaactcctgacctcaagtaatctgcctgcctcagcctccccaaatgcagagattacaggcatgagccaccgtgcccggcctaagacactgttaacacggagcatgcatcaagcagcatttgggatgcatcaattttgtgagactttatacaagttaacaaataagaaggcaaaaaagaaggcatatgttaaagtataccatgtgtcttgtggtgataatcttatattttatattctgataatctcatatataaatctgtgaccttgaagtaggttacttaacacctcgatgtgttcaccagtaagatggtgtgccacttccagctttcccttaaaggatgattgtgaccttgtctaagtgcaatcagaatgttaagcagaacagtaagtattgcaattgttttgcatgccttttcctttaaaatatacttgttattttttatattccatgcagggtgaatttaaggtgtcagagagatacctcaccatggatgacttgacaacagccctggaggggaacagagtgagagagatgtttggctctggtacagcctgtgttgtttgcccagtttctgatatactgtacaaaggcgaggtacgacaagtatttcctcatttcctatcatttccaatcacattaaattacatttaatttaagtgtatgaataaaattgtatctggacccagacccaagatgcaaaagttttgtcgttgttgttgtttttctttattt

SEQ ID NO: 68866 - DNA, 1054 bp, Homo sapiens
caattgtagactgagagaaattgaaactttcaaagagccatatttctattgcagatatattttcctgctcttccaaatctacttacagcatgagttcttcttttaaatattcaaatattttgaatattgccaagagctttgatttccatttttatctcttgtgggtttataaattaagaaaaaatactcatcttatttttttaaacctctctatttttattgccctttattcaaataacttgttgacaaactttgaacttgaaccactgaggtaaaagaacaagaattaaacagatagtttaaacacatagcttaaaaggatctttttcccatttcctatccttgagcaaagaatatattcaaacactttggcagaagtcaatgaggttataccactaattccatgatgaaaatcaactgaatgtgatactgaaagagaaggaagagaattgtcactgtaaagtcaactgttagtcatattaggaaaaaaaatacatacaatacaatttctcaaataaagtccaaatatacattcaacgtttaaaaataatgagtatttcagatatttgaactcagtctgttctttattccataaaagatataggtaagccgtgcacagtggctcacaactataatcccagcactttggcactttgggaggctgaggtgggaggatcacatgagcccagcctgggcaacatagggagacccctatctttacaaaataaaatataaaatataaaacctagttgggcatggcagcatacacctgtagtcccaggtgctcaggagactgagacaggaggatcacttgggcctgggaggtcgaggctgcaatgagccaagattatgccactgcattccagcctgggtgacagggcaagaccctgtcttaaaaaaaaaaaaaaaagaaagagacaaacgtagaaagagtaccaaatttggagccaatcagatcagacctgggttcaaattgagtttctgtcacttacttcctttgtggccctggagatgcccttcaacctccttgaaccttagtttcctcatctgtaaa

SEQ ID NO: 68867 - DNA, 1051 bp, Homo sapiens
ctttctttctttcttttttctttcttccttccttcgttccttcctccctccctccctctctctctttctttctttctcttttctttctttctttctttctttctttctttctttctttctttctttctctctttcttttctttctttctttctttctctttctctttccttccttccttcctttctttctctctctctccttccttccttccttctttccttccttccttctttccttccttccttctttcttctttttttaaataagggtctacctgaagtgtgaactgatttgggaaatttgatcatgcagaacagtaaaattttctttatgtttgttgctagcaaaattgtgatggttttttaaaaaaatggctattgataataaggcatgcctaatgtagtgaaagtttgaaaatgtcccaatttctgattgacagaagaagaactggcaactcctccactagatggcatcattcttccaggagtgacaaggcggtgcattctggacctggcacatcagtgggtgggtgcctttgatatgaacaacttttgtaagcctgaaataaaaaataatcaaaataagcccagcctagtgttgaaataatatcctgtggttccaaccaatgttatctaatctttaaattctaacgtgaatgaaaagtattcttctagaagggctttcttggcaagactattaaaataagtattgttgatagcaagggcagagagaaaccagtttagcaagatgtcatagtggagaagtattctagtagtagtctcagtctaccaggtatctcccaccaacttttgtctggttcatacctgatgtgcttccatccagacattccttaacttcccaagtctgtgttgcttccaaatggcaatgatacttcttcctttcctttatttataccagtgtaaccatgcttgccgtagaaatgaaataatttcactgacatataaatgtttactaatataacattattggtttgactgccttctttttctctctgtcctacccccatcctccaaaattcatatacatgcc

SEQ ID NO: 68868 - DNA, 1061 bp, Homo sapiens
ccttgcattgagacacaggtctcagatcaggtcaatggtcattcaccatataccgtatataaaatgctagagtaataaatgcagtgtactgattctactggaaggattttgtgtactctctggctgtaattgttttaacaattgttgccttttctacatattttgaaaatgtatcacaatctctccaaatttactctagaactcaatctgattaaagagcaccattttaaaagataaatcaatgtatcttgggattgtaactagatcctggttcattcaagacaatttcatatatccactatagatatcaatatttctctattatctttaatatcctgagtactcattacttttctttgctgtttttttttattagttggcagagaccataggggttcagtgaagtgttggcaacgtgtatgatattgaattaaatggccaacggtgggagaaaaacaggcatttatttctattagaattttgataatcataccaaatttagaagcgtatttttagacttgtttacattcttaggttgttcatttcacagtagtaattatagagactagaaatataaatgatgtttccaaatacttatgaagtctcagtgttagtagtttcaattaaattttttaaaatgcagtttatatttgaaagtagctacagtagcctctcttgctctaatgttatttggctacaaaaagaggaaaatggtaatttagatgtggctgaattcagagctaagtactaattttagtgttagttgcagagactaacaagatgagtcttatactgcagtcagaggtagaataaacagaagatatggtgagtaagccttgtcctgggcttggccattggtagtccttggcatatgaaaaaccagatacagatcattctcatccttccattcctgctgtttgtacttggcactgtttgaaaataaaatttatacaggaatatttatgatttataaatttgagttactgtatgtgacatataacaaaagctacacttggaagattgtagccagtgttgacctctgcacttagaagataataggc

SEQ ID NO: 68869 - DNA, 1165 bp, Homo sapiens
agacattgggcattatgtattccttggatacattaaaaggtgttagataagagcgctcacacttgctgctcttctattgcaacttgacagaagttacttctctaaaccttagtttctcatctgaacaatggaaataatgatagtgtctatctcatagtattggtgtgagatttaaatgaaataattcatgtaaaattgcttggtgtgtggaaacatagtaacttttaactgttctcattaacttggctatttacctgtgttcttctatcattacatttcaagttaaaatttcaaggtttcacgttgttctctctccaatgaatgcagttaaatcacttagattttctaatgagttttcctttaatgttatgcagttgactagagagtgtatatatattaagaacataataccttcactatgtccacatgtgaattaagagcttgaggctatcagagggtagaagatgagggagtggggatgaagtatgtttgtaacctgtgtattttctctttcttaaaggaattacggctcatctctttttgcccaatgtgaagcagtagataatgggtgtcagcaggtcctgtggctctatggagaggaccatcagatcactgaagtgggaactatgaatctttttctttactggataaatgaagatggaggtaatccactcagatttcactgtgtgcatttctcagtcattttcaacaggaccagaaagacaagagctagaaacttagtacaagggagtaagtagcacagttccaaaggctaagtaaggactactgtgcttttgctgcccaaatagacacaagtttcttttttttctttctttcttttttaaagaggtggagtctcactatgtcacccaggctgcagtgcaatggtgtgatctcagctcactgcaccctggttcaagcaattctcctgcctcagcctcccgagtagctgggattgcaggagcctgccaccatgcccagctaatttttgtatttttttttttagtagagatagggtttcaccatgttggtcaggctggtcttgaactcctgacctcaggtgatccaccggccttggcctcccaaagtgctgggattacaggtgtgagccactgcacccggccgagtttcgatttaaagaagctctagaggttttttgtttttc

SEQ ID NO: 68870 - DNA, 1179 bp, Homo sapiens
aagcctaaaaccatgtctaggttctcccctttctcaattcccaatcatgcaaccttgaaaggtgttatatagatagttgttagaaatatgtctgtcctccaaaaccctactaacacgcaaaaatggacaaatctagcttttttgctaaaatcctaacaactcagaaagcaaagcaaaatgaaatgtatgtactccattctcaggatttccttcttaaaaaccactaggctttgtgtaactcaattttaaaagtatggtaatagctcctgtaattcgatggcttcttctgggagacagatataaatctattctagactttaagactggtgtccacattttaagttacagttgtatgtacttctactttgttgcagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggtaagtaaatctgtgtctctgtctaaaggaaagacaccttcatgaccatttagttagtgccatttcacttcagtatgaacacatataatacttttcaaactttaatgctcattgtgtttcatggttaattttcagtttaatctttcagcaagccagctgtagtagcttttcctatataaacgcagtatgaattcagtgccctcgcttttagatgtgctagtttaaaggatagcccatggccctttgtaagggagaaacactggatatgatatctagggaagaactgaagtaagaaactacaacaagcatcacatcggtgctttggataaacttcccctgggcgctggtctctggctgcaggctgacggctggcattaaaaagcatctggtcctgggacccaggctctcagttggctccagggagtcatgtctggggaaggtgcccgcttcactgaagtgctgtcttcattgccacagattgtggccacacctgctgccaactggctgcgggacagccctgctttggctctgtcaggccagtctcataggccatatgtagctggcaggaaataaaagagcatttgaaaagtgttggacgatttcaggggtggacttggccatgagttgggaatgcccctatg

SEQ ID NO: 68871 - DNA, 1024 bp, Homo sapiens
ctcctacttaagaatcctttcctaccttaaggtcacagagatattttgtactttttaaataaagtcttagtattttgtcacatttaagtatatcatctaattagaattgattggggggtatggtaagatgtagggatctaatcttatctttcacatgtggatagctcgtcatcccatcacaatttttggggggaaaatcagaaaaaattgtttggttttattattactttaaaattttttttattggtaccataaattatacatatttatgaggtacactgatgttttcatgcatgcatataatgtgtaatgattaggacaaataagaaagaaataaataaaaattaggataattaggatatccatcacctcaaacatttcttatttttttgtgttgggattattaattttttaacagtttaaatgcttcagtgaggatcatttattattgccacattgtgagaaaattctgtcatttattatgtttttcattctttcaggtatttgacaaagaagagctcttagagtgtattcaacagcttgtgaaattggatcaagaatgggtcccatattcaacatctgctagtctgtatattcgtcctacattcattggaactgaggtgcaaactgactctttattttggggtactttgctgggcaagttattattgtttattgttgtttgaaacttctagcatatagtttgcagtagccccccagtagcatcattaatgacttcttccttctgattgtcaagattagaggtagcaaacattttctgtgaagcgccaatcagtaaatattttttggctttgtggccatatagtttctaataagaaattagatccctacctcttaccataccccaaaatcaattataattcgattatatacttaaatgtgacaaaatactaagacgtttattaagaaatacaaaatatctctgtgaccttaggtaggaaatgattttttttttttgaggtctctctctggttttttttttttgcccacgttgtcgcttagg

SEQ ID NO: 68872 - DNA, 1078 bp, Homo sapiens
aaccagctctggtcacatctggattatctactatccagcattcaaatgaaccagattacatgaaaggatatgggggtactctttgggggccacggtgccacaaggcctttggtttcgatctccattgcctagggaattaacctgtgctgtgtgattctagatgttttcttcctgctcccttaaataacacctaaatgtgttattcagcagtgtggctcctgctaagcagaggagaactcggaattcctaccaaattctgataataaaataactttcctccacctcaaccattgtttttaccagtcctgtcaactgttagctttcctggatttaatgatctcaagttgaggtcaatgtcaacagctttatgggatgaataagatgaacgcccataggaaagtcagtctcttgaacacgggttgttttcttttggttaccctctaagattttttctctttgatctccagttatttgaaggattgaaggcatttcgaggagtagataataaaattcgactgtttcagccaaacctcaacatggatagaatgtatcgctctgctgtgagggcaactctgccggtatgtaagtgtaggagtttcttttgtgtttcttttaatgtaacgggtcacggtgttgaccaccaaataaataatttctgaatagttagataaatattcagtacaaaccatatgaacattaacattatttctgatctactttagttaggtaaaaatacaagaaaatggccgggcacggtggttcactcctataatcccagcactctgggagactgaggtgggtggatcacttgaaaccaggaattggagacaagcctggccaacatggtgaaacaccatctctgcaaaaaatacaaaaattagccgggtttggtggcacatgcctgtggtcccatcggtgtggctgaggcatgagaattgcttgaacctggcaggtggaggctgcagtgagccaagataatcacatcactgccctccagcctaagccgcaaagtgagactctgtaaaaaaaaaaaacaaaaaacaaaaaacccaagaaaataatatcatttggcaattcc

SEQ ID NO: 68873 - DNA, 1048 bp, Homo sapiens
taatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagtaagtacatgggaattaaagagagtgacatgcttgcacttcactgtgggtactaagtagcttctcctgctaaaatagctcttgggcagtatgggctttatcatatttaccagaggaagccgaaaatgtctttaaaagttttcctatagacagttggattgaagataaatcttagcagctaatttttcagataatcttgcattttctgtgacgtcaataaaaaaattatttaaagcaaatagaaaggacagctggtgggaaaattggcaattaaaaagccagcactgttgataatttaataagtcacctttcttcttagatcttctaataattgagaaagggtcattgagaacaatattatgatttgattttaatgctaactccacatttttatgaccagtaataatgtctagttatgcatgttaagggacatgtaattaaatgtcctccttcagccatgagttgaaataattttaagcataaaatgtttaaagaattctttctctggtccttttcagggtgcacaattaaccagatgcacagtatacttcccattgtcttgattctcattgtattttacttttgaatgatttggacatctttcccagaataataggggtgctggaaataataatagtcttcctattaagtgctaaaatatggtaatagtaaaatattaatagattaatgataaaataacaacttttgtttactgaattcctgcaatacgttctgtattatgttccatatatgaatcatctcatttaattaccttaagtgagaaggcatgtgattaagcattcaggctttgaagtcagacatcctgggctcaaattcggtctcatttgctccatagg

SEQ ID NO: 68874 - DNA, 1002 bp, Homo sapiens
tttttttttttctgagacagagtcttgctctgtctcccaggctggagtgcagtggtgcgatcttgactctctgcaacctccgcctcccgggttcaagtgattttcctgcctcagcctcctgagtagctgcgactacaggtgcatgccaccacgcctggctaatttttagtatttttagtagagacggggtttcaccatgttagctaggatggtctcaatctccaaaccttgtgatctgcatgcctcggcttcccaaagtgctggtctcctgtgtttttgtcagcattccacagatgctataaagttagtggtggtatcgcatgcaatttgtacgcttaatgtttggccatttgcagtgggcaaactggctatgtcgggagctggtgagatgctgcttgtggggagttgtttcctattactctgatttatctttgtttaaataagagttcctttgttcactgtttcctccacacagaacagaggatttatatcttagtgttcattctcaactttcctgttttcaaagaggaaaacatttgcttcactttgctcatttcttctccagtgcacccagaggattttgaaggcttatgccaacaattctttggggcagttggagtgtaaccattgctaaatagcagttcagtacttaatgacattcattttagtttaacaaatcattgtgagtgttgccattttttattagggaaaacatctctttcatctttcccaaatactcaacatgagtcctatggtgagagtgaaaaagggttgtattctttttttgcatcatcttaccccatctgctattttgtccctcttctatatatcactgaaatttggttctgatattctattaggcagtgtacattgcagagattatgaataactggccgaattctgaatgcaggcatgatttgttcagctcagagtgttaaatttctgtgttagctgctaacctttaaaagtcaattgatttcctttttttttttcccctctgta

SEQ ID NO: 68875 - DNA, 1088 bp, Homo sapiens
cctccttggatctcttccttccccacccccacccccgtagttatttagcagattacgcattaaaacaaatgtctgcaggttttcccaattagtcccgcttccctgtgtctttatcttttaaattgcccactaataccatgaggtttaaggtgtggggtggatgctgcggcatcggaggaccctgctggtggaggaaatggttcacgcccgtccccgttccctttgcaggcttgctattgtgcgtctgtgattgacaagaccacgaggctgagcgcgccctggagatttttctataaatggcttaacaccccagtctagactatttgctcggatataagggagacaattgtttttttgttctttgccggcgaaccctggctctgtagggctgacctggaatttaaccagtcttccctgagccggcggaggaggacaaaaaccgccgcgaccccggcagggtgggaagtgcagggcagcgctcccaagacacgcttgttggaggttcgggcctgggtgcttggttgtctgagcctccttttttgtgtttgcctgggtcctggagaggagcgcacggtatcatggtgagcgtcacgtaggttaccccgggtcccgcttacccacctgcatttacttaatggtggtttaattcttctttaaggattgcagtaacggatgctccgcagagtgtaccggagaaggaggatcaaaagaggtggtggggacttttaaggtaagttgcttgccagaggcttagtgtctaaagcaacgttcaactgaataaatccatttcttgttgagattcggggaaattttcactgtgtgggttacccagttcctaggttgtgttgccagacttttaaaattccactcttagaggaaaaaaagccatttagagagtgacagtacattcatcacaacaaaaattatctagcagctaattgctgattttattttgagtcatatatttttcttgaaaaatagtcaatgcgtaaatattaaactagttgtttatcagattccataatacgtacaaaccttcagtctacttgtagaaaaagttaaactgtgatttttctctttcagtagca

SEQ ID NO: 68876 - DNA, 1052 bp, Homo sapiens
agcagcccttctccatcaattttttccccctgggtatttctttacctatttttatgttaaaattagagccataaccgtttatatcatcagcatgtaaatgtcatctattgataatgagttttccttaagacagaataaatgttcaattggagccatcccagagagaaaatatcaacagcttttttaggatgtaggagaatttcacaagactattgagaaccaaatgacaaggacaatgacattaactcatgagcatcatttttgttaagtgaaagtaatgaatgttctttattcagatgtcaattgtgggcatttcgatccttgtttcagaacactgaaacagaaaggcagcacaatgtaatcaacttgtcatctctggacgccatgatggatcaggaaatgctgctattactaagagagcccgcacagaaggcagtggaattcacagccacgcttcagaagctggtatcgtataacatacctttatcatggtgttccgttttggctggcaatatctgcagataactgacctgcaacctgtttgctgagtccaaatgtatctgtgtgctgctgagacccaaattaatacactctgaaaagcgaaggtttttctcaaacctttctgaagctggccttttagttctgggtcaatcagggctaacagattgaccattagatacggattgcttgaggttattttttcctgtgagctaatctttagtatcaaagggctgaagacatggtatctattgaacagtttccttctttaaattttcttctggttaatggctggtattcctttctccattttgacttttcactggaaactctggatgattggagaaatcagagaacaatattttcatactggtattgccagtccctttcatagtgcctagcatatagtaggtagcatttagtttggtacattttggtacattttacattttgtacattttggtacattttagaacggtaaaaataagtgaaaatggttgttttcttctatttaaaaagatggggtttgttctggaaaatgattctctctgtat

SEQ ID NO: 68877 - DNA, 1028 bp, Homo sapiens
aaaccatgtggaagattaagctaggcagagtgcctgaaaagccctctgcaataagttgagctggaaaaacctccatatctaaagatgctttaatcatctcaagaacaccaacaacattttctattataatataactatgatagatgtgaatctacctcttggattaaggcaataattttatagctatcaaattttcacagacaccattttcactactctgagttgcatctctaacaagcttctttagcctctgcctacagatttcagtgacaaagccattcagtttcttgttcccgatcttcagatttcattcctagatcaagtaatggggcaaatacaatgggaggtttaaaattacaaatgtgttcccttggagtagaatacaaaaagaacttgtcaatttcacccactttgggtagtgtcatatcttctattaagtctaatgtgtttgggatctttgactctttcatcattctgtctttgaatacactctaccattttctcttgacagagctttttagatgaggaatttcctcactatgattccctgtcctgcgcagatgcaattcaacaacctcttcaagaaaaattggtaattgcgagctttttgaaattatttaggtagtaattgtgaatcaacaactatcctgtaatagaaagctaaatccagtatgtatcagtagtcttagaactgcatatattgcttttatcaagagattatcaagtgaggcaacagatacgtgtttttgtaaatgtacacatacacacacacaaacctagttggtcctttgtcgcccaggctggagtgcagtggtgcaatctcagctcactgcaacctccgcctcctgggttcaagagattctcctgcctcagcctccggagtagctgggattacagtcatacaccaccacgcccggctaatttttgtatttttagtagagatggggtttccccatgttggccaggctggtgacctgaagtgatccacctaccttggcctcccaaagtgctgggattacaggcatgaa

SEQ ID NO: 68878 - DNA, 1073 bp, Homo sapiens
tagagaagtagaattccaaaatttctttgtgggcaaacctggggagatatgaattttttaaatctatacctaagcagacttgttaaaatatattttcttaaggagaaatttaattgtggtagtaattttagtttgatcatttgttatatactttcacaccttagttcctttttaacccctcactagagaatactgttattctttgtttcatttttactaaagttatatatgcacatagttttttaaaaggtcaatcagctctataagccttactaatttcccgtgatccagagaaacaactttcaactttttgtcttatttgttttgtatttgcattcacatttttcaataacatgctcatgctgccatttagtgatttattttcagttttaggtattatctgttgctcttccactacgaagacaaatatttagttcttttatcaatctctggcccatcacaccttttcactgtccctcaagctactgttggccatcctgctttcctggccaagcttatactccacagttaaacatagttttcactaccttgcatgtcccctcatcacttacccctttcttgctttgtcttactcatttggcgaatctacaagtaaatccgcttctccacctctcatgcctgcatagctggaaaatgtcacattcccatgctgacctgtttctctttgaattcattatcacaaacctcaagcgggtccttggggcttcccctcaatcaccctccttctcttttaaatatcaatttcccaccctttcctttctcctcaaaccactgtcatgtctttccccatattctctctcaaacacaggtaatgactgcttccaacctcactgaggaaactgggacaatcaaaggaaactgccacaaagcctcccagcgtgtgaatccttacacactcccttgctcttgttcctaaagatgcgttgtctctaaccctatccaaggccagccttccccactgtagatgggagccttcccgactaatttactcagagtcatgggaccaaattctcctgacttttctccatttacattttctccactctactgaa

SEQ ID NO: 68879 - DNA, 1045 bp, Homo sapiens
cagacggtcagtttagtgcaaaggtagtttaagcaattctcattttatatactttctttttgcattactggatattatatgagatttcctaaaagagtaaataactgcactttcccaaacatggtaagttaggcagaattaaaaatacaaggaccaccaatgtacaaaacccacttcctttagtttcttggcaaagcctccatgtctgtgtactgtttcatgttcgtcataaggctttagttcagtaagatccttccaggttaaactgtgagcttcttgaggatgggggtcatttcttaatgaacattgattcttctagcatctagcatagtcctagaatatagtagatgcttagtaaacatttgtgatatatgaagacacaaagtaacttctaatcatgaaaagtgaatttgtaggcagaagagttctgtactcaagaatatttatgaatgtatcagaaaatgacaatataagtagatatttatataatatttagaaataagtgtatgtacatatatgcataggaaaaaaacccttggttttagtaactcaaattgcctgttactctacattgttgaatgtagtgttctgctcatgctttcagaatattctactccaggaaatatttttttctgaacactgtgtgctaggcactattttagatgattaggatatagcaatgaatgaaacaaaggtccttacctttgttttctttcacagtcgaaggaaaacatttaaaaaaataaatgattagtatgttaaaaaggtgaaaagtgctatggaaaaaaagaaaaggtagatccggaatagtgaggctgaggccatatgacacccatattaaatagggtgtcagggagggcagcttaatgagagataacacttgagtgaaactcaaaggtggggactttagccatgtgcacatctggggaagcagcttcctggtaaacaactggagcaagagccccgagggagtggcttggtgtgctggaggattggagggacaccatggaaaccatggggcctggaactgagagagcaaagggag

SEQ ID NO: 68880 - DNA, 1044 bp, Homo sapiens
aatggttcagtaggtgaacttagtttttctatacttatttgtagttttgtctgaactctttttaaaaaagcattttattttgggataattttagatttgcaaggaaagttacaaagatggtacagagagttcccttatgccctttaccaagcttcttctaattttaacatcttacataatcatgatacttttgtatcagaattgtctttaaaattgatcaattcttttgttttccaacttttagggtcccaaagcaaaaaaggtatgtagaatttttttcaaaatagatagttgtataatcacttacagtgtatgaacagaatatttacagaattataaaatatttttatagttttagtttgtagagtttactaagcttactttttagacattaatgcagtttaaatcatggaataatcctttacaacagtaggacgcatttcaaatttgacataagagagttctaatttcacaaatactcttaaaaatagcttttaatttttacttatgtctagatttggggctttttgttaattctgctctagaaaatgttggattaggaacccctttttcttcactctagatacatatataaaattttaattataaaatgtgctatggctttaaagtgaaatctgaggtaatacaactttaaatgggttgcatggtaacacatacttggtgggtttttttgtactgtttagaaatttgagttcaataaacaatgtaccattctatatgcctttttccagaatgcctttttctctctttactttgtagatttatactttaaattagagtttataatccattggctggcagtccaaatttaccctacagacatattttgtttgaccttagaagtgctttttttttttttttttttaaatcagttgccaacctatttttatgcaacaatctgatttccatctattcttaagaaattggaaacctgataacattgggcctaaatagtcctgtaaggcaacaattggctgggctgaataacagctaccccttttaggaatgcataaaatctttgat

SEQ ID NO: 68881 - DNA, 1033 bp, Homo sapiens
ggctcactgcaacctccctctcccgggttcaagcgattcccgtctcagcctccagagcagctgggattacaggtgctgatcaccacgcccggctaattttttgtattattttagtagagacggggtttcactgtgttatccaggatggtctccatctccagacctcgtgatccacccactttggcctctcaaaatgctgggattacaggcgtgagccaccacaccaggcaatgcagtttatctttatgcagttgaccttgaagcatttaggtttactttagccactaagagaaataggtctccttgggttcacaatgtagtgaataaacaattttgagttcagcagggccctgaggctgctcctgaactctgcatgaagtcatggaggttactgttttaagtaaagagccaagagttaaggactaagagaagccccctattattctgaaaacttggatgtgtgcgctggatgagacagcggttgcagtccccattgatagttttttccccctgtcattctaggctaaggagttaggacttaaccagttccagttccaggctaatggaaaattgtcattttactgggggttatgtggtggccaaagttgttaatcattgttccccatggggtagatacagtgagagcttcagtaaagcctttcctctaaaagcccactattttaaggtaacttgggattactgaactatctccttaccccgatgaatcctaacttgagttgactgaggtgttttatcattaaacattagttttactgaaactaatttaaaaggaagccttaactttcatatcaaacagctatggtaaactgagtaagaactctgtacgaagtcgctattaaaatgtttttatcttgctaccaggatatggatgtaaaatgctaataactattacacaacctataatagttacaggttacaatagggataataacactttaacccacaaagactagcttagtcctactacttatctatgaataatgcatgtagtcaataacactggaagggatag

SEQ ID NO: 68882 - DNA, 1033 bp, Homo sapiens
tttgatcaggcttctgctcaatgtccttcaagtggctctggccttgccttgagagcagggtaaagataatctcttgtttgttgataaggaaaactcaggctcagcaaggttaattaatctgtacattatgcaactggaatttaaatctagtttaactcattccactgtggcataaaaggaggtacacgtacctatctgtgatgacaatccactttctcatttccttcatgtgacttctcacaatcacaattgtctttgcttatgtctcccataggaaaacgtcaattatgacagcaggtaattttatcggaagtgtttataactatatcccagtacgtggaacgaaaaagttatcaagaaatatttattgaatgtaaaaaaggttaccattttctcaatgtgtataacctttttttatttttttaagactacaatgcagctaattgcaaaaaaattttcctttctttaggtatgttatgcataaaagtggataatttacatgataaatgaaaatggccaattctttaagaggagaagtactaaaactttataaaaatgtaagtaattatgttgccaattttataaaaatgttattatatgacatggattgtttagaaatatataatctttctttttgaagctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaa

SEQ ID NO: 68883 - DNA, 3074 bp, Homo sapiens
taatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgactatgagtgtgtatttattcatgaaatttgaactgtttgccccgaaatggatatggaatactttataagccatagacactatagtataccagtgaatcttttatgcagcttgttagaagtatcctttatttctaaaaggtgctgtggatattatgtaaaggcgtgtttgcttaaacttaaaaccatatttagaagtagatgcaaaacaaatctgcctttatgacaaaaaaataggataacattatttatttatttccttttatcaaagaaggtaattgatacacaacaggtgacttggttttaggcccaaaggtagcagcagcaacattaataatggaaataattgaatagttagttatgtatgttaatgccagtcaccagcaggctatttcaaggtcagaagtaatgactccatacatattatttatttctataactacatttaaatcattaccaggaactgtttgttttgtagtgaaccttgagtatgtgctgttaatataccaaattgggtgaaaaaataagggattcctttcaaaagttaagagaagtaagtgtgtaagaaattattttgcttattaaatgttcggtaaatggcattctcttgtcagtaaaatggagaaataagctaaaaataattggctaagtcctattaagttagaggattaagtgtattatattttcattcaaaattgggtgctcattaatttatgatcggtagtatagctaaattgctatgtttgtatcaaaattgagcataaagttgctgatactttctccgtatgaacagaagttgaaacctatttagttcagtagggcagctcagggattttttacacaacatgtatatcttcccattttaagttagaattattttacaacatctggtatacataaacagctggcactgatagctaaattaaagtagtaatgatcaattagttttgttggtatctgaataatagcgttgtttcatagctctgtatttcctaaggaagtacaaagcttctagctctttcattacaaattcgccctgtgcaataagttctttgatcttctctggattcttcacatctttgtttttaaggaaaatgttcttcaaacgctttttaaaatagtctgctccttttggatagtctcgtccaagatacagcagcttcaaaaagaaagattatatatttctaaacaatccatgtcatataataacatttttataaaattggcaacataattacttacatttttataaagttttagtacttctcctcttaaagaattggccattttcatttatcatgtaaattatccacttttatgcataacatacctaaagaaaggaaaatttttttgcaattagctgcattgtagtcttaaaaaaataaaaaaaggttatacacattgagaaaatggtaaccttttttacattcaataaatatttcttgataactttttcgttccacgtactgggata

SEQ ID NO: 68884 - DNA, 3106 bp, Homo sapiens
gtatagaactggagctcaaatactgttactgtgtgtgaagatatatgaacatagtttacagttgcatggcttatatctaaagtccagaaacataaggacaattaagtgtacacacacacacatgcatttggattttgatgacttaggtttgccaatgtggaaaaaatagtagcaaattaagttctcctgtgaaaaagtcgttaccttatttaaaattctgtgccattggttatccttgtcttttgtgaaaattagtgttcctgtttataatattgacaaaacacctatgcggatgacatttaagaattctaaaagtcctaatatatgtaatatatattcagttgcctgaagagaaacataaagaatcctttcttaatattttttccattaatgaaatttgttacctgtacacatgaagccatcgtatatattcacattttaatactttttatgtatttcagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacc

SEQ ID NO: 68885 - DNA, 1062 bp, Homo sapiens
accaggattctagcccatattttaaaactgcatcctcagttttattcaaacagtctgatgtctgtttaaaaaaaaaaaaatctcaagctcataatctcaaacttcttgcacatggctttcccagtaaattactcttaccaatgcaacagactttaaagaagttgtgttttacaatgcagagagtggaggatgctttttatacattggtgagggagatccgacaatacagattgaaaaaaatcagcaaagaagaaaagactcctggctgtgtgaaaattaaaaaatgcattataatgtaatctggtaagtttaagttcagcacattaattttggcagaaagcagatgtcttttaaaggtaacaaggtggcaaccactttagaactacttaggtgtagtattctaacttgaagtattaaaagataagaaacttgtttccataattagtacatttatttttaatctagtgggaattaattataattgagacaattttgatggctgtagtagactaatctatatttggcataaagtctaatgatttaatgagtcttaagtaaactaaatatttggaaactgatatttacctttatttttaagggaaaagttttgagataatcagcagcttttttttttttttttttttttttagtagggagaaaaagatatgagctatagtagacagcagtaatattgaatggcccagaaggtgggaaaaagccactcttaaatgtattttttcttttggatattttacaagcaaataataacttctgcctaagttcgccatctcagtggcatcagcagcacagcactttcttatcccagtgagaaacctgggaattttaggatgactcctaccgccctcttttccccctggtttggaagtatccacaaattcctgtgacgttacattctgtgtcttttatgtcatcattagttcaggcccctatcatttcttgttggactgttagaacctcctatttggtttaccagttgctgccatcattcattgtgaaaccggagagatacactttaaagaaatgtcatttttggccgggcgc

SEQ ID NO: 68886 - DNA, 1058 bp, Homo sapiens
gtatttttcttggtacttggaccatactttgagtagaaaagcagtagaggacataaaaagagtcttgttagtcccactttgttgctgtccacttctcatttgataatatcctaaaatagctgtgtctcctttttggtggttgtatgattactacctcagaagtactaattgattcttgctatttgaccttaatactttaatataacacagcattcatatttgatcagaaaactatctggcttccttttataagagatttttaggttttatacagttttgtggccttgggtttttttgtttgatttgtttttttgaaggtatataatatgtaagtagataaacaaatttgatttgtagacatttttatgtggatcatctaattaaaaatggagggatacagtatgaaagaatacttgtacttcttaacagagcactcaacctttcttttacatcctgtttcactgatgttattatgtaatttatgttgctaaactataaattagatatttaatttctgttctttgatttccttttattattaaatggacttgttgatttgcctagaaattaatttgcctttcaaaagtcttattaatcttcctccgttgaaattaatttgatatttgcatgcttctggaagactttaaagagctattccgagtaactgtagagattataaaatgaaatatgggaattttaataaattttacatctccagttactggtgaaaatgtcaagtcctcctttctgcagagtattttgttactcatctgttattcagcttatttatttatttatttatttatttatttttctttctttcttgttttttttttttgagacggagtcttgctttgtcgcccaggctggagtacagtggtgggatcttggctcactgcaggctccgcctcccgggttcacaccattcttctgcctcagcctcccaagtagctgggactacaggcacccgccaccatgccttgctaaatttttgtatttttagtagagacgggtttcactgtgttagccaggatggtctcgatctcttgacctcgtga

SEQ ID NO: 68887 - DNA, 1016 bp, Homo sapiens
gcaatgtgtcgtactacagtgttaggatggctataacatcactaagcaataggaacttttaaactccattataatcttatgggaccactatcacatatgcaatctcctgtggaccaaaatgtcattatgtggtacatgactgtactaagaaattgatccatctatattccatcaatttgtttagggctttttctggttacatttacctgtgagcccagaaaaccagttttgtagaaattaacttctgtaatgctaggagttaaaaaaaattgctgaacaacttttacattgttaaacatttaaaaacaagcgttctagaagtttatcaaatttcataaaggtgcaaaaatgtaaatgtaaatcattatccagctaatatatatgttgtatttccctagtaggagagcatatgtacctcttcctagttatacaaatttgatatatagtaaagaaacagtaaattctacttcaagtcattttgggaggattaaaaactgaatttctctagtttgaccattgtacagatttatctggcaattttactaaaacctgatttataggttaaacttggtgtatatcatatatcactttactttagaggaattaagatttcacataaatccatttccaggttccaaagaccaggaagaggcttggtttttgtttttctttttactgtctttacagtctccttgacttttcttaggagagaaggtactgagaaaacatgattctaatatttattattttttcttccaacattttcttatgaaacattttcaaatacaaaattgagttttatttaaaacatttgcaaatatactacctagattctaccattgttgttttatatttgctttacttacaacttttaaaagatgctttttataccactgaacattttagcttacatttcacaaagaaaagaaaaaatttaagagactttgcataatgttttaaggggttgcagtaaagaagtgcttcttatattttcttatgcatacaaatcagctggg

SEQ ID NO: 68888 - DNA, 2877 bp, Homo sapiens
gctcaacctatatgaaattttattcctttttatggctgaataatgttccactgtatgtatatactacattttgtttatccattcatctgttaacagacacttaagttatttccacattttgggtattataaatagtgctgctgcgaacattggtgtacatgtatctgtttgagtccctgtttttagttattttggttatatacctaggaatggaattgctgatcatatggtaattctgtgtttaactttttgaggaactaccactgttttccacaatggcatcaccattttacattcccaccagcaatgcacaaagatttcagtgtctgtatccttgctaacacttattttccattttttgagtttttttgttttgtttttttaataatagccaatcctaatgggtatgtggtagcatctcatggttttgattttattttcctgactattgatgatgttgagcatcttttcaggtgcttagtggccatttgtccgtcatctttggagcaggaacaatgtcttttcaagtcctttgcccatttttaaattgaattttttgttgttgagttgtatataacaccttttttgaagtaaaaggtgcactgtaataatccagactgtgtttctcccttctcaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattataggtgggtttaaattgaatataataagctgacattaaggagtaattatagtttttattttttgagtctttgctaatgccatgcatataatatttaataaaaatttttaaataatgtttatgaggtaggtaatatccctgttttataaatgaagttcttgggggattagagcagtggagtaacttgctccagactgcatcggtagtggtggtgctgggattgaaacctaggcctgtttgactccacagccttctgtactcttgactattctacaaaagcaagactttaaactttttagatacatcattaaaaaagaaaaccataaaaaagaatatgaaaagatgatttgagatggtgtcactttaacagtcttaaaagcaatcgtgtgtatagcatagaattgcttggattggataaacagtggcattatatattttaaaaaataaaagttttgaaagattgaagaatttgggcattacagttctcttaaatctgacaaagctgcataaaactattaaaataatcattattatactattttatattctatttctttgagggtttagttttccaaaaactacatattaagcaaatgaatcactcagtggctatgtcatataataacgagttagcctagttataagaagtttaacattttatttaagaacattgttacagcatgtttactgtatagtctagtaatagaggaaaagacatttgggtgggtggtagtggtagtatttttatagaggagttaccaaatttcagctctattatccaagtttacccagctaatggtgttcggaaccgggaatttgagccaattctgactctgttgtctgctctgctccttcttttgtgctgtgtctttgaaagtcacctaaaattgtgagggaatgtaatttcaccccaaatttagagtttatgcacttgttatattgaaaatgattaacatgtagaagggcttttaatggaataagtggtgtagtaacttcagtgttgcctacctagaaatcaaaatctttctagttgtccactttgttttttgaaaaagtaatatgaaaattatgttaatgctttaattcaggtttttgtaaaatattttttatctttacacatttaacatacgtttctaaaattatagtctgttatatagcactttgggtctagaatttttcagtagtttctgttttactattatgatctacctgcatattaacctattaggttatagttttactatacttctaggtatttgatcttttgagagagatacaaggtttctgtttaaaaaggtaaagaaacaaaataactagtagaagaaggaaggaaaatttggtgtagtggaaactaggaattacattgttttctttcagccaaattttatgacaaaagttgtggacaggttttgaaagatatttgtgttactaatgactgtgctataacttttttttctttcccagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacaggtaagtaacactgaaataaatacagatctgttttctgcaaaatcataactgttatgtcatttaatatatcagtttttctctcaattatgctatactaggaaataaaacaatatttagtaaatgtttttgtctcttgagagggcattgcttcttaatccagtgtccatggtactgcttttggctttggtttctttctacattgaaaatttctcttcaattctgagcacatgttaacatttagaattcaagaggtggggatttttttttcccatggttacatatatatatatatatatatatatatatatatatatatatatatatataaagaacagggcaacaaatttttgcgttttctatttcggtagtacttttaaaccattatgtcatgtttctaggttaaacgttgttgtatttgaagaattttactttggcagaatt

SEQ ID NO: 68889 - DNA, 2448 bp, Homo sapiens
aaggtaaaatttattaaattattcttaatatatattgtaatttaaaaattaacagcttcattgtcttgataaaatttatggtatcttaaacatgtgcttgtttttctaagagaacattgaaacatagattttaaaacaaattgttgaaagattaaaaaatctgcctttgcacactgttacattgaaagtggggcatttgtcgtgaacattcatttcaaatatgtagtatcttcagaatatttgagaaggatttgtattatataattgaaaaatctgttaaattgtatttatgttaactgcttaattctaataaaatttccattcattttttagtatctgcatatatttacatcaaatggattcattcacttatttaagaggcagtactaattacctatagcgttcaagactgttaggtagagggtgtgtagtggtgagtacaacaggcgtgagccctaccaacacggagtttaaagcctagtagaggatatagacttaaacaatttcacaagtaaatacataattacaaattataatacatgctatgaaggaaacataggaggtaccagagaaggaagagtgctttgcatttttatttttaagaccgaagagtgctattggaggactttgagcaagtgaatgacatgatctaacctaccttcgttcattcattcattcattcattttcttccttcctggctcaagcagtcctcccacctgagctccccaaatagctgggactacaggtacacactaccacacctaatttttttttgtattttttgtatttttgatgggattttaccatgttggccaggctggtcttgaactcttgacctcaggtgatccacctgtctcggcctcccaaggtgttgggattataggtgcctagcccatggtgcctagccctaacctacatttataaactatcacttgctgctgtgtggagactatattgtgagattaacagcagggatacctgctaggaagcaattgctgcagattgcctgagacaaaatagttatcatggactagggggatggtggtggtggtggtggtaggtggttggatgtaggatatattttgaagataggtaaatggtgcaagattatgggtcagttttaaatgcttaagtaaattttctttgtaagacattttaggatgccatgttaagaatctctttataactgtcatttaaaaaaaaaccacatattttcttagcataatttcccatagtaacattactatgtcaaaggctatgaacatttgaatgactttagataaatactgtaattgctttccaaaaatattgtgcttattatgtcaccagaaatgtttgaattctgtctacaattcagtcttgccagtatagtacatttcatttagaaaaattttttactatgtagatggaaaaaataatattttagctgggagtggggggactatggggaataactttccttcatttaatattttattgtgagttagtttaagttactttattttatcgtagtttcctaaggctacaaattagtaaccttggtaacttatgtacctaatttaaaagtttacttttttgaaaggctggaaatactaattaaaaacgtaacaccttcatccttgtctttgctccattattaactagtttcattacagaatctctgtgttttaaaatcagatgggttttcataaccagtactttctcagagtggtaaatttaaaaaaatatataaagagaataaataatatttgttgagaatacttcaaataatgtgaagagttattaacttacagcaggagttggcaaacttttctataaagggccatatgggtctttgtcacaaagtcttgggtttttgtttttgtttttttaaacagctatttaactattcctagctaatgggcaatacaaaaacagtgggcaagatttggcctgtgggcagtagcttgctgaaaccttatttagactctaaattttttgaaagagtctacattgatgcatatttttttttcttcctccaaatacagttgacccttgaacaacatgcgtttgagtgaccatgggtccacttgtgatacacgtttttttcccaaccaaatgcagatatggagggctgacttttcatatacctggatgttcctgggccaactgtaggactagaggctgggggggtcttggaaccaatgccgtgtgtataccagggatgactgtttcttatggcctgacctgaagttggaacagaatctttattaatatataatttttgttgcgtttgttttctctttatatttatccattctttttagatcgtatttcatttaacactttttcttctttagtttttaccaagttgcactgaaaatagctcagtgactaattgcacttctaagagtgaggaccctagttaaaattaactctaaaaatactgaatttttaacctaaacctt

SEQ ID NO: 68890 - DNA, 2392 bp, Homo sapiens
ccagacatgtatgtatatcaagatgcctgcaggtcatatccaccaggacaacccatgagtacagggaattcaacatgcccaatatcactcatcttttccttcgccctcccctttgtactcatcccctgtcggtaagctctgttattttaaaaaattgaaatgtattcacatagcatacaatttacacttttcaagtgtacatggtttttagtatattcacaagggttgtgcagtcattactactaattccagaatgttattatcaccccaaaagtcccacatccattagcagccactccccaatcccttctcccaccagcctctaaaaactgctaatttttccatctctgtggatttgtccactctgattatttcatataaagagaatcgtacagacgtggccttttgtgtctggcatcctccacacaggatgatattttcagagttcgtctatgtttttgcttgttgatcattccttcattcctttttctggctgaataatactctgttatatggatataccttattttgtttatctgttcatttgatgggcatttgagtgatttcctctttttggcaattttgaataatgccactataaacatttatgtacacgtttttgtgtgaccatatgttttcacttctctcgggtgtatatctaaggtacagttgctgggttatatggtagctctgtctttgactttttgaggaactgccaagtggttttggtagtgattgtactgtttacattcctaccaacaattttacctaagtatttctcaaatctatttaatcttttcggtccatactgctgttgctgccttagttcagattttgtcatttcttgtaataattcgtagctcatctcccagtctctgctcccctctctccctccctcccccttcttctctctcttatttccacccatttttaacatttatagaagtcaaaagtctagttcagaaagcagaaaccatactagatatttcagcacagagaactaattaggtgttggaagactgaaaggcaaaaaaacactgaagtaacacagtaacatcaagaatgggcactactcctaagattcagggaatgctgggaagatttggggtttatcagaactggaagctcagaggaggggccccttgtcgctgaggcttaatccctgcagaggtgcctttggctgctactggtgaatctgagtgggtatgatgagtcagtgtctgggaagggccaaaacattttgtccctttctataatttgtcatgataatgctagtaatgaatctgatctcccttcctattttaaaaaccttttagtgattttgtataggatgaagtttaaaactccttacttaatatacacatgaccctccgtaagctggcccctgcttgattgtccagtttcacttcttggtgcttattctaaggcctctaagccttagagatcctctaagcctttgagatccccaaaccctggactgcggactggtacccacctgtgtggcctgtgaggaactgggctgcacagccggaaggaggtgagcattacttgccttagctcctgtcagatcggcagcattagattctaataggagcgtgaaccgtgttgtgaactgcccatgcaaggatctaggttgcatactccttaggagaatctaactaatgcttgatggtctgaggtgaaacagtttcatcctgaaatcacccccaactcggtccttggaaaaattgtcttccacgaaactggtccctgatgccggaaaagttggggaccgctgttctaagctaaagttatatggagctccttggttctgtgtcctcaacatgctgttctatgttttttacattctgtttgctccttcctgcttggaatgtccttcccctccccgtctttcttaatgcatacaaagttgatctctcctgtgtgccaccattgtacttcgtcttgcatatggtgttacattcattttattttaattatttatttacgttcatgtctcttccactcaccttagttgcttgaggtcagaaactatataatgtgtgacacggaatgtgacacctagattttcaataagtgtttctatgatacaagggagactgatgtgggtagatgggaatgaactcatcaacctctgtttacataccctaaattccctgtttcttccctattataattctgacagtctacaaccgtctttgatggcttataaacggaaagtgcggaacacatcattctacagtgaatttaaataacctttcggaagagtaacgtaaagtacttgagcattaattgagtaaaagtttctcatcttttcctacaggtgttattaagcagtatgtaaaaagtccttacaatacttaatacattaagaaaacatacaatttcaaga

SEQ ID NO: 68891 - DNA, 3577 bp, Homo sapiens
gcatattgacttctaacacttagaggtgggggtccactaggaaaactgtaacaataagagtggagatagctgtcagcaacttttgtgagggtgtgctacagggtgtagagcactgtgaagtctctacatgagtgaagtcatgatatgatcctttgagagcctttagccgccgcagaacagcagtctggctatttagatagaacaacttgattttaagataaaagaactgtctatgtagcatttatgcatttttcttaagcgtcgatggaggagtttgtaaatgaagtacagttcattacgatacacgtctgcagtcaactggaattttcatgattgaattttgtaaggtattttgaaataatttttcatataaaggtgagtttgtattaaaaggtactggtggagtatttgatagtgtattaaccttatgtgtgacatgttctaatatagtcacattttcattatttttattataaggcctgctgaaaatgactgaatataaacttgtggtagttggagctggtggcgtaggcaagagtgccttgacgatacagctaattcagaatcattttgtggacgaatatgatccaacaatagaggtaaatcttgttttaatatgcatattactggtgcaggaccattctttgatacagataaaggtttctctgaccattttcatgagtacttattacaagataattatgctgaaagttaagttatctgaaatgtaccttgggtttcaagttatatgtaaccattaatatgggaactttactttccttgggagtatgtcagggtccatgatgttcactctctgtgcattttgattggaagtgtatttcagagtttcgtgagagggtagaaatttgtatcctatctggacctaaaagacaatctttttattgtaacttttatttttatgggtttcttggtattgtgacatcatatgtaaaggttagatttaattgtactagtgaaatataattgtttgatggttgatttttttaaacttcatcagcagtattttcctatcttcttctcaacattagagaacctacaactaccggataaattttacaaaatgaattatttgcctaaggtgtggtttatataaaggtactattaccaactttacctttgctttgttgtcatttttaaatttactcaaggaaatactaggatttaaaaaaaaattccttgagtaaatttaaattgttatcatgtttttgaggattattttcagatttttttagtttaatgaaaatttaccaaagtaaagaccagcagcagaatgataagtaaagacctgtaagacaccttgaaggtcatggagtagaacttccatcccaagcagatgaggatttatttaatctcaaagacctccaggaggggacattccccaactgtccttgttaactcattttcagaacatatttattagcatattttacatgtaatttggatcttcatgttaaatttaacatcagtggagatggaaaataagcatatcgccttgtctttgaaatagccctatattgttagattgtttcttaggcttctttaccctgggttaagcagtcctaatactttagcatttattctacatctagtgtactaatttaaaaaaatcagttctgaaaaatttctaagaactttcttcaagttccaagctgtgaaatctagaacaggtcaaagtgccttattaacgtactgtactgtgtagtgtcttgaagagacactttgcgctgaggcaagttctgagggcattgggtggccttgggaagatatttatgcagtttagaacctggagaattgattagataactaatcataaggaaacgtcacatatttttggtactataaaaaagtggagaaataatgcctatttgcaaagatttgatttaaacatagaaacaactttatttggcttccaattttaagaatttacagcagtaaaggggaacagtctaattgaagtagactgcctatgcaatagtctctgtatatttacttttgacaagttaattcaatgtgtactatagttttgtttctttgaagaggtttgaatagtgcacccattttaatctgtattgcaaattcagggttacttggcagactctactatttaaatcagatgtaaaaggaagttttaatataattcactttatgcctgaaagttttcctgggattttggaaggtgattttactggaaatgctgtctgtcttccctgaaaatctgagaaattccattacactttgtttccaatcagaggtcatgagtgctatatgagtatatacagcatgacgtcatgaatgtgataaagtgggttaggaaaccttttgctaatgattgttaaaatgcaatataaatgttgaagaaataaagctaacagttaagcctttatttgggcggaaggctgaaaaagtttataaacttaaacctataactctgcttatgatttctgccaaaccagaagacttgactctgggaagcattggttacctgtgaactttgaaactgacggtccctgacgtagtttagtcacctgggaaaaggtatctgagattatctcttatctcccaagttacagtgagtctctgagggaactgacacattacattaagttcttggtgtagttaaactgtaagaaaggcaggagaacttagtagttaaatagttggttaaatggaaatgctgactccatgttattgtaaaaagttaaaaatttaggaggatatggggatttcactgccattgcaggttttgattggtatttaccaatccgtgtgggtcagagagaaaattagaaaggatatgactgcacattttggaattattagcagtttttctacatttaaaatggaaataaattttttaaaaatttaaatcaagtaatactgtattttttggtgatttagatttttcaaaatttacactaagagatagtaaggagggtggctattgtttctttcaataatgtctctgagaggttgtaactcatctaaggatacgtagctaataagtggtaggatttcaatttaaattctctgagaccaagttaagtagaatttgcactgtactcttgtataactttttaaaactgaaaattagctatctttcaaattaagaaaatatttactaatggagactaattcagatttgtaagtataccaaaatttgaacttagcctgctatctaatggcaacttagtggcagaggtatgatgtaaaatcattcaggtatgacacatagatggagtatgtttgtattcgaggctgtgcacataatcacctttacttgtattgtgaagtatatattgttatcttttatgaagcccactaaagagataatgaaatacctcgttattagggcaagattattgaaaactcaaaatagcccccaaacacaatacttggctagaaatatatacctttatagttcagagatcatttattatcaaaaccctgaagttttttttctaaggtaaaatttggtggaagaggaaaagtctcgttttaaaaaaatgtaggtagttacagagatcagaatgattagttgatcacttaccaaatatat

SEQ ID NO: 68892 - DNA, 1547 bp, Homo sapiens
tctaccctctttgtttttttgagagagagagtctcactctgtcacccaggccggaatgcagtggcgcgatctcggcccgctactacctccgactctcaggctcaagcgattctcccgcctcagcttcccgagtagccgggattacaggctcccgccaccgggctaattgtatttttagatacgggatttcaccatgttggccaggctggtctcgacctcctgacctcaggtgatccgcccgcctaagcctcccaaagtgctgggattacaggccaccacacccggcctacactcttaaaaattatcgaaggggccgggcacattggctcttatctgtaatcccagcactttgggagactgaggcgggaggatcgcttgaggccaggagttggagaccagcgtactcaacatagtgagaccttgttataaagaaaaaaaaaatccaggattaaaaaaaatctttgatttgtttgggatttattaatatttaccgtattggaaattaaaacaattttttaaaatgtattcatttaaaaataataagcccattacttggtaacatgaataaaatattttatgaaaaataactattttccaaaacaaaaccaaaacttagaaaagtggtattgtttcacacttcagtaaatctctttaatgatgtggcttaatagaagatatggattcttatatctgcatctgcattcaatctattatgatcacacatctggaaaacttgtgaaagaatgggagttaaaagggtaaaggacatcttaatgttattatgaaaacagttttgacctcttgcacaccagaaaagtcttagtaacctgaggggttcctagaccacattttgagaactgttttaggctatgcaaactggttggggggaggttggggtaggcagagagctagaagatacattttagtgtaattctcctcatctattcctaattgctttggcctacatttgaaataaagcgtggaggcaaacgggataagatacatgtttgtagtggttgttaacttcaccctagacaagcagccaataagtctaggtagagcagagtaaggcggggaactatgccgtgaccgtgtgtgatacaatttttctagcctgtggtgctttttgcggcagggcttaggagtaaggttagtatgttatcatttgggaaaccaaattattattttgggtcttcagtcaattatgatgctgtgtatatttagtgtttatctacaatatatgcacattcattaatttggagctactcatcctataataaatagttgtgcatttactcccatttttttctgcatttctctccttatttataattatgtgttacatgagggaaaggaggtgaaattaaacattcatattatttcaaaaaatttgaaacaactaactaaaaaatatgttttattttctgtatggtgtttgttatacaatctgtcaatattcatgcacctcttgggagacagtgtatgaaaagcaaagagtaacagtcacatggattactgattactgagatatattcacttgcatcttt

SEQ ID NO: 68893 - DNA, 1027 bp, Homo sapiens
tgcggtggaggttactcccgcggcgccccggcctcccctccccctctccccgctcccgcacctcttgcctccctttccagcactcggctgcctcggtccagccttccctgctgcatttggcatctctaggacgaaggtataaacttctccctcgagcgcaggctggacggatagtggtccttttccgtgtgtaggggatgtgtgagtaagaggggaggtcacgttttggaagagcataggaaagtgcttagagaccactgtttgaggttattgtgtttggaaaaaaatgcatctgcctccgagttcctgaatgctcccctcccccatgtatgggctgtgacattgctgtggccacaaaggaggaggtggaggtagagatggtggaagaacaggtggccaacaccctacacgtagagcctgtgacctacagtgaaaaggaaaaagttaatcccagatggtctgttttgcttggtcaagttaaacccgaagaaaacccgcagagcagaagcaaggctttttccttgctagttgagtgtagacagcaatagcaaaaatagtacttgaagtttaatttacctgttcttgtcctttcccctatttcttatgtattaccctcatcccctcgtctcttttatactaccctcattttgcagatgtgttctacatctcaagagttattacagtactccaaaacagcacttacatgattttttaaacttacagaggaattgtagcaatccaccagctaaccgcctgaaatagacttaaacatgtgcatctcctttttttttttttttttgagacacagtctcgctctgttgcccaggctggagtgcaatggcgcggtatcggctcactgaaacctccgcctcctgggttcaagcaattctcctgcctcagcctcccgagtagctgggactagtaggtgcacgccaccatgcccagctaatttttgtatttttagtagagacagagtttcatcatgttggtcaggatggtctccatctgctctgttgcccaggctgga

SEQ ID NO: 68894 - DNA, 1034 bp, Homo sapiens
attacaggcatgcgccagcacgcctagctaattttgtatttttagtagagacggggtttctccatgttggtcaggctggactcgaactcctgacctcaggtgacctcaggcccgccttggcctcccaaagtgctgggattacaggcgtgaactaccacgcccggtcattatatccttcttaataaacctgcattaattgagccaagtggtcatttctctgttctttgcactctgaaagaatcaaattaacacaatattgaaagaagcttgcacggcacctggaacataatgggagctccacagagtgtgcttatcaggattttaaaagagcttctatgagcaaaagcagaaattgcagactaactctcaaatccaagagtcacagttggtttggattttcagtttggtagctttttcccctcttgctttaaaggttttttaattctaagagaaagcccaaattggataaatttaggtgtggaaataaaacacatgttctcataatttgggagagatggatgaatctcttgggatatggggcttcacaaaatatttcaaattattttttaaatattacgggcttggcaaaaacaaaatgattttctaaaagaacttgtcttcttaacattcaaaaggtctcaagggaaatgtaatgtacatatttctgactcattttacataactcaatattgtttaataggaattgattgatgtttaaaaattcaataaatgtttgaactaagaagtattgttggatggtaaaactgtcttctgagaaaaaggttgaattagatgttttcttaaaagggtctcagtgcttggcctcaaactttaccaagtattttttcttcctttgtataagagaaaaaagtaattctgaataatctcccttttttcccagttacaaacaaaaagacagaaatttgaattccagaatattaatatattattgagcaacagggaagaaaccaaacatataattaattggggcataaaaagagaagagaaaaggagaaacagagagagagggaaga

SEQ ID NO: 68895 - DNA, 1071 bp, Homo sapiens
gaaaccccgtctctactaaaaatacaaaattagctaggcgtgctggcgcatgcctgtaatcccagctacttgggaggctaaggcaggagaattgtttgaacccaggaggcggaggttgcagtgagccgagatcacaccattgcgctccagcctgggcaacaagagcgaaactccatctcaaaaaaataaaataaaataaaataaagaatataatgtggagaagtaaaaaaatatataaaggtctcattaacaggactagaattgcgctatagtcactaagccacaactgagtaatagctctgatctagtagtataacttatcccctggtgacctcacacaaactcttggctccttgccatgcacatgactcagctcttctgtctccatttctctgtacctgcttatttttccaaccattgctactgactgtactcactcactttctctctgcctcatggctttgctacatggctgtcttccctctctccacttctgcatttacccaatgctgacccctccttggatgtttcctactcagaccctataagacagaagaaagggctctcctcttgcgccaggcttcatcataggccattggtcatcaggtcatgtttaattagtagggtgacagggcaaacaacaacaacaacaacaacaacggggaacctctctcaaaaaaccactctgatgcttttcagtttcagaagagagcaatgaagctggctaggagccataaaggcctgcacatagtttgttatttaactttgaaactaaacaaatgtgcagtgtttacatagagtaaactgtaccatcattatcattgtcatcaccacagccatatctaccttatataatatctacagcctcacaaacgttatcttacaaaaatgtgtcactctggtttgtcaagtattcttgtttatagagaatggtttggtacactaaatgaggattgttgattttagaaaaactaggacaagacggcatgaaggcaaaacgcagtcattttcaaatgggggggtattgcagggcagagggaggcagagacagagagggaagtgaagcagcaa

SEQ ID NO: 68896 - DNA, 1028 bp, Homo sapiens
tattgagaaagacaagtaaaagcaaaacaaaacaaaacaactctctatttcacacaaaaacttcatggaatattcaatatttaaaattttatgttaattttgatctttatatattattaaaatgttataaattacaattattcctctccttagctgagacctcggcaagtagcctaaaacccaacagtaaagagtggttcccaagtctcattcaaaatatgaatggagaacacaaaggtgtcacatggcctcccatgatttattctcctgtgtctcaattctgaacaaccatgagactaaataaatgtattttttgatgcttttctgattattttaagatttccaatacaaattcaagaaaaatgtcttagaaacttaattctgttgtgaaatatataatctctaaaatgaatcctgtatttgggtttccccagaagcctttgaaagaaaatttgtatatgtgtccagtaagatctcataaagcgatatgtttaaccaatctataaaatgctaattaattgcataagctgtagagtcagacatacctaagtggttccaaaccaccttactaactcctctaactcaaattctctgtgcttaaatgttctcacctgataaattgctaattctagtccctccctcaagagttctggggtgaattaaataagataaaatgaagtgtttggcacagtaccataaatacagttagctttgaataacaataattgttattatacttggctatatggcaatacataaaaaggaaaaggaataaatgattgtccctaccttcaggaatgttatcctctcactgaggttttgacatatgcacacgaaaaattaaatatactgaaaatcagaatatgattcaatgagtcttgtaaaagattagacttccagggacaggaagttgctgtggaatgcagtggcctaatatgactttaagggagagaaaggatttgagctggagcataaatgaaatgtagtattcagatattgagaaaggtgtggttcattccaaacatgag

SEQ ID NO: 68897 - DNA, 1019 bp, Homo sapiens
tataggcctgactgcagactaaggtcatagggattctgggaaggatcagagaaaccttcagagcacagctgaatgtgtggctgcaaatttttatggtgcaatttatcacaatggctaacatgatagtattaagaagtggggccgttagggggtgattaaatcatggaggtagatccctcacaaccaggattagcaatctcatagaaggggtggaggtgactagctaggtcctttgccttactggccctcttccatgtgagggcacagtgtccatctcctctcaaggatgcaacgctcaagatgttatatgtgaagcagagaccaggacctctccagacattgaacatgccagctccttgatcttggacttcccagccccttcaatggtgagaaataaacttctgttgtttacaaattacctagtctcagatattttgttatagcagcacaaatggactaagacaacagtcttttgaactctcttaggtcacatttgtccacctcttgtgttctgcttattttacgtaacttgtttatacccatttttgtatacaaataagctgtgttgttaatcacagtaagatgcctcatatggggaaccatgatttcatgtcttcttgaagaagtcttacactcttctctagttataacaaagaatttggaaataaagaatcatagagatactcttttttccctatgttctgagagcacatttacacagacactttacagatacattaatgccaagtatccctgccaggtacgtatttattatactagttgggataaggaattcatgctgctctaataaacagacccctaactcctactgatttagcaaatgaacatttactattggtttatgcagcacaaggtggatgatcctacttggtgggaccacgcagtcattcagagattcagattctttccagtctgtggctctgctttcccctggggccttggagtcctctgctagatcctcagtaggcagccagcagacagggaagagagagtgtgga

SEQ ID NO: 68898 - DNA, 1008 bp, Homo sapiens
attaagtcagcaagtacttattgagtgccctttatgcgccagaccttgctttaggtcctagggatacagcaatgaacaaaatagccactgtccttaagaagcttccatgctagcaggagcagacagatggtagacatggcaaataacaattgcataagcttaggtgctggcaaataccagaagggagatatctgggtgtggtgcctcctataagcttttctttatcccaccttaactaagttagatgctttggacatatgctcttctgtaagcacttgtgtcatcacactttagcacctctgtgttatttcttgtttaattgcctatctttcatgctggatcactataggtttggtaagggcaatgattcattctagataccatcatttcctaatgactagtttttgcctagcacatgtcagaggcttagtaaatatttgtcgaaggaatgttacttcttaagtatgaattaattggtaggctgttatctgattgggtaaatgaaaatatatatagttaaattaaaaagttgggtgaaattaaaatttatcattcttctgaagtttacacctgttcagatatctacagacctatgtgcaatatattgaactatcaaacacacaagttgatcaaacttatttacttcaaatcacccaattcttacagattatgaattttatatattactgattttttagtttttcttctcatttgctaagaaagccagattaagaaagaactttgtggccgggcacagtggctcacgcctgtaatcccagcactttgggaggccgaggtgggcggatcatgaggtcaggagatcgagaccatcctggctaacacggtgaaaccccgtctctactaaaaaatacaaaaaaaaattagccgggcgtggtggcgggcgcctgtagtaccagctactccggaggccgaggcaggaaaatggcaagaacccgggaggcggagcttgcagtgggccgagatggcgccactacactcctgcctggg

SEQ ID NO: 68899 - DNA, 1260 bp, Homo sapiens
gaaagttagagaaattttaaaaatgttcttaagatcatgcaaataatgaatgatggagcttgtattcaaactgtagcctgtacttcccacaaacaggcttttatctaagctgtataactcttcatcacttgatatacaatgagtaattgccttttaaggtaacaggggaaggcaggtacttccaggggactccggcagtacccctcatccctgaactacagatccactgaaggccctggcactgctggctaatagaaaaagtccgaatgaagtccaagatgtagtgattccaggtctccaaaggtcctgcttgcattgcccaaagggagcttgtactcaggtggcaatttgtttttattgctacagttactttttatcagtgctgctgttattctatttccttcaggatttttctctatcattggtctctctcacgtttatattcctcccctctatcagtccccttctcttgttatgggcatactcaagtctcctcattctaaaaaagcaatcaaccactagcaacaagaaatatttcttgactctgattctccttcccacggttgctccactcttacaccctcttctgcctcttgacagagtggctgcctcacttaatatctacaaatcattatttttcatttacttttgaatcaattgccgcctggttttctcttcctccactcactgaaactaattgaactatttccagcaagtttcatgatgctgatacccaatagccttcttgctggaggaaaatggaaatataaatgacattttatattggaggaaaagggaatataaatgacatttgcggaacacatcctgtgagtcatctttctgcaatgttctttgtctatattttcttatctaaccctcatagtaaccctgtgatattttaaatcatcaatattattattatttaaaactcaggaataggttcagcctattccagtaaaataaggtagagacctgactcaaacctagttctgtctgactcgaaattccaggttattttattatacaaggtgtaaacaaacaaaccaacaaaaaagtctaagcccccacactgcccgcccagccaactgaatagaccctttctcttggccaagggctttccaaagttaacctgaaaaacttgttcaggccatgatgggacgggggagccagacatgcctcattataccttcctcccttttggaattactgatagagtagactctttaagtctgataggaaatattcaccatctattctcac

SEQ ID NO: 68900 - DNA, 1650 bp, Homo sapiens
ccgatattttgaccttcaatctggacattgtcattattggcataaacccgggtctaatggctgcttacaaagggcatcattaccctggacctggaaaccatttttggaagtgtttgtttatgtcagggctcagtgaggtccaggtgaaccatatggatgatcacactctaccagggaagtatggtattggatttaccaacatggtggaaaggaccacgcctggcagcaaagatctctccagtaaagaatttcgtgaaggaggacgtattctagtacagaaattatagaaatatcagccacgaatagcagtgtttaatggaaaatgtatttatgaaatttttagtaaagaagtttttggtgtaaaggttaagaacttggaatttgggcttcagccccataagattccaggcacagaaactctctgctatgttatgccgtcatccagtgcaagaagtgctcagtttcctcgggcccaagacaaagttcattactacataaaactgaaagacttaagagatcagttgagaggcattgaacgaaatacggacgttcaagaggtgcaatatacatttgacctacagcttgcccaagaagatgcaaagaagatggctgttaaggaagaaaaatatgatctgggttatgaggcagcatatggtggtgcttacggagaaaatccatgcgacagtgaaccttgcagcttctcttcaaatgggctaattgagagcctggagttaagaggagaatcaactttcagtggcattcctaatgagcagtggatgacccagtcatttacagaccaaattccttcctttaataatcactgtggaacacaagaacaggaagaagaaagccatgcttaagaacggtgcttctcagctctgcttaaatgctgcagttttaatgcagttgtcaacaagtagaacctcagcttgctaactgaagtgttttattagtattttactctagtggtgtaattgtaatgtagaacagttgtgtggtagtgtgaaccgtatgaacctaagtagtttggaagaaaaagtagggttgttgtatactagcttttgtatttgaattaatcatcattccagctttttatatactatgtttcatttatgaagaaattgattttcttttgggagtcacttttgatctgtaattttaaaatacaagtctgaatatttgtagttgattcttaactgtgcataaacctagatataccattatcccttttatacctaagaagggcatgctaataattaccactgtcaaagaggcaaaggtgttgatttttgtatatgaagttaagcctcagcagagtctcatttgttagtttttagtggtaactaagggtaaactcagggtttcctgagctatatgcacactcagacctctttgctttaccagtggtgtttgtgggttgctcagtagtaaaaactggcccttacctgacagagccctggctttgacctgctcagccctgtgtgttaatcctctagtagctagtaactactctggggtggcaggttccagagaatgcagtagaccttttgccactcatctatgttttacttgagacacgtaaatatgatagggaaggaactgaatttctccattcatatttataaccattctagttttatcttccttggc

SEQ ID NO: 68901 - DNA, 1019 bp, Homo sapiens
aaatccagtaagccaataattttaaagattctttatctgcatcactgctgttttttactataattaaatgaacctcatggaaaggttgaggtatatacctttgtgattttctaatgagttttccatggtgctacaaataatccagactaccaggcctggtagatattaaagctgggtactaagaaatgtcatttgcatcctctcagttactcctgaatattctgatttcatacatacccagggagcatgctgttttgtcaatcaatataaaatatttatgaggtctcccccacccccaggaggttttatgattgctcttctctttataataagagaaacaaattcttgttgtgaatcttaacatgctttttagctgtggctatgatggattttattttttcctaggtcaagctgtgtaaaagtcatttatgttatttaaatgatgcactgtactgctgtttacatggacgttttgtgcgggtgctttgaagtgccttgcatcagggattaggagcaattaaattattttttcacgggaccgtgtaaagcatgtaactaggtattgctttggtatataactgttgtagctttacaagagattgttttatttgaatggggaaaataccgtttaaattatgacagacatccactagagatgggtttgaggattttccaagcgtgtaataatgatgtttttcctaacatgacagatgagtagtaaatgttgatatatcctgtacatgacagtgtgagactttttcattaaataatattgaaagattttaaaattcaaaaaaaaaaaaacaaaaaagtcaaaaggtatccacatgatacttacactcaaaaaaggtggcaaaggaagtaagcagaccacaagatgtctttaaggaaatgactaagaaaccagaaagtagagatcaggaacatttagtgatttttggccatcccctgaccttcctaaacatcataacgtcactgcatgctgggggactgacctgcaaagggagcttgtcaacttt

SEQ ID NO: 68902 - DNA, 1121 bp, Homo sapiens
aattaaatgtcctttattttctccctcatagcgtaatcacttttgcttctgaatatttaccacaatttatatattatttaatcacttagggtccttttcttgccctttaggttaatatgaagttgataatacctggtttaatcaccagtgcccagtatatgtagtaggtgctcaataaatatgttgatataatgagtaagatcgtaatatcagtttgtatctttatcttttttttttgaaatggagtcttactatgttgcccagttggtcttaaactcctggcctcaagtgatcctcctgcctcagcctcctgagtagctgggactacaggtgtgtgccaccatgcctggcttctgtatttgtatcttgattgccttctttatcactgttaaatttgcttttcatgatagaaaagccagacccacacttttctatattccttctttgctggttatatgtataatatgaaacggcctttgcaaatatcaggtaaaaatgcatgtaggttctgtgaaatattcgtagtaataaattgagacaccttttaattagtgttacccttgtgactttctgttgtacataatcctttttctaaatacatcattaaaataattatttttttatcagcataagcttactgaaaggaaaaaaaatcttactgtgccttactattttacagagcgtcacatgataacacgttagtcagctgctgtcggctggtggtgccagacatcaaaggaagattgggaaaactttagtagaaaaacaagacctagagttctaaggatgctcagtgctgtccagctgttgatgtgacttgcatggtaaccagacatcactggaccatacacttaagagagaggaggagttttttttaaaaaaagtgggagccacctagaagtctggaagttcttttcttctctctcactaaagcattccttgttttagccaaaaaaaaaaaaaaaaaaaaaagtctcatgaccttccaaggccaaggaaggcttacagctttgagtatttttgtcatgtggttgctctttacgaaatattagcttgatgtcctctaactctgaagtacttatgtctgttattgatgtttgtaatctctacttcttacataa

SEQ ID NO: 68903 - DNA, 2056 bp, Homo sapiens
attacaggcatgagccaccgtgcccagccttaaacagctttattgagatatcattgacacacaataaactgcacatacctaactgtacaattttacaagatttgatctatgtatacacatgaaatcattcccacatcactttcccaaatttcttttttttttttttttttttgagacagggtcttgctctgttgcccaggctggagtacagtggcatgatcttggctcactcaaccactgcctcctaggttcagtcaattctgcctcagcttcccgagtagctgggactacaggcttgtgccaccatggctggctaagttatgtatttttagtagagactgggttttgccatgttggccaggcttatctctccacctcaaatgatccgcccaccttagcctcccaaagtactgggattacaggcgagagccaccatgcccaccccaaattttctcattctcctttgtaatttatcttcctttcattctcccgtttcctctaaaccactggtctgctgtcactatagagtagttcaaattttctggaattttagattaatggaattatgcagtaatatacttttttttgttgttgaggcttcttaaactcagaataatggtttggagattcattcatgttgatttatgtagtagtagtttattcctcttcattgctgagtagtatttcattgtgtgagtacacagcaattcatttatctacctattgatgaacattagatttgttgctaatttttggctattacaaataaagctgttatgaatacttgcatacaagtattgtatagacatatactttcatttatcttgggtaagtacccaggagtggaatggctggatcttatggtaggtgtatgcttagctttttaagaaactgccaaactgttttcccaagtgattgtaccattttacattcttaaccaccagcaggtaaacatgctgtttcctttgcatccttgtcaacacttggcatagttggtcttttttagacatttgtggtattttattgtgggtttttaaaatttttatttttttaattttaaagacagggtcttgctctgttgccgaggctggagtacagtagtacagtcatagttcccaagtagctaggaccacacacatgtgccaccatgcccggctgttttttaaaatattttattttgtagagatgaggtcttgctatgttgcccaggctggtcttgaactcctggcctcaagcagtcctcccaccttggcctcccggtgttgagatcacaggcatgagccatgtgtccagccatcattgtggttttaatttgcatttccctaacaactagtgatgtaaagaatcttttcatgtgttttttatgctatctttgtatcttctttggtgaagtgtcctagtcttttgctgatgtttttattgggttgttttcttattattaaattttgagaattcttatatattttgaatacaagtgtttcatcaaatatatgctttgcaaagaatttctcccagtttgtgtctcatcgttttcttaacagtgacttttgaaaagcagaaggttttaattttgatgaggttcaacttataaatttgttttttatagattgggcttttggtgtggtatttaagaaatctttgcctagcctaaggtcataaagattttctcctatgttttcttctagaagttttatgttttagatttagatctgtgatgcattttgtatttcttacatggtgtgagttatggatggaagttaattttctgcatatggaaattcagttgttccaacactgttgaaacgactattctttctccattgaattgcctttgcacccttgtcaaaaatcagttgtctgttatatccttttttattgtatcagttgatatacacatggtattacacagtattgttaattatcacagctggatgaccaactaaatgaaaagcagctatctccaagccagtacttgataatgtgtttttgtcacgtttaatcacatttctagtttccttacaatagcctttgtggaaggctttcctactcagacatt

SEQ ID NO: 68904 - DNA, 1063 bp, Homo sapiens
ttccaaactggtttaaacaaaaatgattacttagctatttaaaaaacaattgatcatatctctttcttgtcttatcccttctcctctgccactcttctgatttcttgcataacatttaataacaaatcataagactaacaaggatgcatttcaattccttatggtttatggatcagtttattaggtcaagggtgtggtggggcatgggggtggaggaattatggtagagagtatgaacatttgctaagagcagcatgggataggtgaatttacccagtatgggagtctggcagaagttttaaaatcaagtacatctgagttcaaatcagggctccaccgtttactagtcacctgaacccgggaaggtactaaatctgaaatcttagtttcttcatgtgcaaaatggagactgtaggattgaccttgacaaggttgtgaacagtgtctgaactgggcagagtggtgcctgggacttatttgttgagtgcctattattactttttaaagcaaggaaatgcatcctgatcaagtcacctaatcttaacctcaactttgtataacctgtataatgggaatattgataaattaatgtgaaaaaagtaaaaaaaattacagccatatataagcataaggggcttatttcatgaaggcttcctggatatccaccagccattagtgatttctcttgtatgaactctgctgtagcttttttccaaatctctttggtgtttatcaaacatttatttgatactattgttactaggcattagttacatttcacaagtactgtagttagtggaatgaaacccatatcttcatcattgtaatccctgtggtattttaaatatgataagagcttggtaaaggtttattatataaataattaattttggtattaccatttttctctgctttgcaaactaatatagcttaatagcatcataatggatttatttccatagaatatctaccttattgtttctgtgatcatcttattaacatttcatatggactatgtaaaacctaagataccttccttactaacattgtgtattgcgtttag

SEQ ID NO: 68905 - DNA, 1056 bp, Homo sapiens
tagtcccagctacttgggaagcagaggtgggaggatcataagcctgggaagtcgaggcttcagtgagctgagatcgtgccatcgtactccagcctgggtgacagaatgagatcccgtctcaaaaaaaaaaaaaaatccatatatggtcaaaaggtattttaggctctctactgatcccttggtaaaagatgctgcacctactgcaagattattgaggagcactttgtcatggagatcagggttggaatgtttgagccaaagaccacaaaaaactgacagtaatcaattatcgttcctgcctgctgcttagcgtttacgtttctagaaaatgctctcttcagttttctcctctgaaatctgagacacagagccgagaaatagaaaatagtttatgtcaaaatatttttccgttgataggccacctgacaagcaaagagattgaggtgaaatctcatccaaattaatgtgtgaggccgtggaaaactgcttatgttttgtgtacgtctttaaagttaagtaagattatacttgaagttacttatctcagtttgcaaagaaacagaaattatacctacttattttttagtgatgttgttagaataagaaaacaatacctaaagttagcggacctattgtgttgtaagaaatgctgatttggatgtgctttggaaaaataaacgaaattaaagaaaataactcattagcaatgttttttttcaggtttgctttgcctgttcagtggtacaatttctcttttttctttattgataagaataaagctgtgcatactttaagaacacaaggcggcacttctctataactctgtgatcacatgatcacagaccccactaactaactaatggttactttcaagtgcttgtggccagttggagtttataatttgttaccaaatcactaattatctttatttttaacctgtattttgcctgtcgagcagtcataatctctaaaattggagactcagaaccttcaactataaagagtttgtttaactagaggcaggaagagctgattttcccttgaaatgcatggaaa

SEQ ID NO: 68906 - DNA, 1067 bp, Homo sapiens
taggtttgacatgcaaaactaattgaaaaaagccgtataaaattttactgcagtgttagttgaagaatgtccaggagtggttgtgtttatgataacagtaagaattctggaaacctcttccagttttctccattatccctcattagcatggtgctattccacaagtctctcttctaccagggaactgcatcctgtccctcgcccctcagtgatttttctcatgtctatcatgtagatcactttagcctctcaggctgtttgcagctctcctcttctccattaccagcatgtctgcattagggagaggtgtggggcaggtctagcctcacatatgttttagctggggaaagaagaacattgacaacccatgttattttttattgtattcctttaacaaatacacagtaagtgacagtgcttcagaagccctgctttttaatctgtctggggaagggtgacctctggtggctaaaaccataagccccaatttcaagaaacaaaaagatttctttttactgttgtttacattatattcatatgtttatgttttgtcactttttataatgtactatatattcattagaagtaaatcagtgtcttctgccaccgtgtttaaatgcggcatcttctgttaatcatcagctgtgctctgtactcatgattggccttaatttgagatccaaaatatttccttaacagattattttttgttctgaggaacaagatcatttccttggcactcttttgttattaaaacttaaaacttctctgttggtttaaatgttgaccattattattataacagaaaaacagttttacccactggttaaaggaaaaaaaaatcaatctcaaactatgacgtccgagttatactcctggctactatttatctttgaatcagccatctaaccaacatttaattggcttgcttcctcagagatatttattcttaacttgtttagtctgccagtaaatgaccaccaaatcgtcagttttgtttttattacagtctttgctggtttgcttatttgtgcatcactttatttaaaaagagtttagggcaacta

SEQ ID NO: 68907 - DNA, 1080 bp, Homo sapiens
aaaatatcctgtttctcatcatcatgttagttactttgatgaaatacatgttttggtttacatttatgtgcatgatgtcagcagcttacagtacatgaaggaaacttcccatatcccagaagtagtgacttaggagaactatggtcttgagatgcttggaaattttgtatctggaaaatttaccaatcagggaattttccattgagcttgcttttttgaaaaggtccttcagtttgtagcagtttgttagcccagtttatcctttcttgtgatgagctagtcattttgcattttcacatataaaactttgaaatgtcttttaaaaagtttatgggaatattgtgtatgttattgcttcattttccccgaaaggaagtgggagaaatttgagtcattaatatacattaaaattctgtgtatgtttttcgtactcatagcaggttgttccaaatcatctaggtaacaaactttggaatgttgatagaaaacaaacttctagcactgtttgtatggagaagtatttcccaaagtcaagttctaggactcttgggactgtttcatggctgagtcaaaggttcccttgtgacatgtgaatttttaggaaggagaacaatgacaaatttttttgaaattgctacattagcatgcaacaaaaaattctgagggaaatgtttcctggcagtttttttattatatttacctgcaatttatagcttaagggagttttaacccatgaaacctccaaatctattaaaagtgaaaagagctagatagatttcattagcatgcgtaatgcccagtttccatacccatctataatcatttaaagcaggaatcataatgggaatatgagctgagaaattctgttgatgtttgaaatgtctggagtgtcaacataattaaacagcgtatgtacacaattggccctgctccaaaaccagtgattatgtgtctaacatcaatccccatgtgtctacaaagctgttagagtaaacatctggaatcttttactaccaaagctaaaatattacataatcagttaaaagaaagagcttcctacccacagaggtcctgcagaga

SEQ ID NO: 68908 - DNA, 1046 bp, Homo sapiens
ttaaatcaatactgcagggcttttctgcagtactgcttaaaatactcgaatgccaattttattgcctctgggatcacactgacattttctcattagtattgtgcccattccccccctagttaagcataaactctgtttgtttccgtcctgtacaattagtgcctatattattcgacaaacacacatggttcacccattctgtgccagccactatgctgaggggttccagaggtaataggacaatcagaggagtagccagataaccactttgatatgaaacaaaactacctaatgctttgaaagcacagggagagtggccacctccacaccaaaaaactggggaaagctgcctgttgaaggatgtgcaaaaattagcagagaagaatgcaaagcatttaccaaggaaggagagcagcatatgcagctcagagatgcttgggagagtgatagattgagagaacagaaatgtcttggcataagggtagaggggaactgggagagttgcaagatgattaaggggtagcacatcagtaacctgcgcagagtttggattttatcctgaaggcagtggagagccgttggaggattctgaccaggggaatggaatccagttttatttgaaaaacatttacctctagcagtaatctgcaaagtggatgtgcaaggagggagacaggatgggaaggcagggagatcagttagcaggcaattgcagcatgcagcagttttgttcctaagtacaagtgctcaaagcagcgttatttgtaatagacaaaaaactggaaatccaattgcctatcagcagtagaatagatgaataaattgtggtttgtttattcaatggaaatctctactgcagagagaaagaatggacgattgctatgcacggcaacgcagatgaaactcagcaaacataatgtaacgccaaagaaaccagacaacattacatatgatgcagtccgtttatagagtccaaaaacaggcaaaactagtctgtgatgataaagatcataataatagttgcctttgagggagggtgttgggac

SEQ ID NO: 68909 - DNA, 1029 bp, Homo sapiens
tcaaagtcatagagctttaacattgtatatggtcgaaaaaatataattgtcagtaagctatctggagctgggcttttaataagaaactcaactgagtgcccttgtagcactcagtgtaaatttgatgctcaatgaaaaactaaagttactagttatattcatttgaaaagtttatcctaaggaaaagacggaattcttttttttgttttttgagacggagtctcgctctgtcacccaggctggagtgcaatagtgtgatatctgctcactgcaagctccgcctcccaggttcacaccattctcctggcctcagcctcccaagtagctgggactacaggtgcccgccaccacgcccggctaattttttgtatttttagtagagacagggtttcgtgtgttagtcaggatggtcttgatctccagacctcgtgatctgcccgcctcggcctcccaaagtgctggaattacaggcgtgagccaccacgcccagccaaagacataattcttaatagaaggatcagtattctcataccaataactttaacttgattcatagcatgttttatactagatgtgactgaaattttaaaatatgaattacaatttctaatatctgcttacaatttttgaatgtgctgctgctctaggtatgtggattagtaacctaaaatgtctttattttcagatgctcttattagtataaatgtttctgaaaatttgcattgctattgatttgtccttccataaaaaagaagtttatactttttaagttagaactttcacttctgtcccagacctaactcttgaattcaaactgtgtgccgagccctgtactagataaggtacaatttgaaaagacattatttcatgccatttcttacaaatgctgcttggaaaaatatgcgtcttgactcaaatcacacaagaggtagtagactcgggatttgaaccttggtgcatcttgtttccactaatcaacattgtctcaaacaaaatgacttattccagaaagtatattttaatagtgtg

SEQ ID NO: 68910 - DNA, 1003 bp, Homo sapiens
cgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggtagggacactttgataaatagaatgtttggcccatgtaaaatagtatcttcttggaatctccttttcatcattgtcaatttttccttatattcaaagaattagaaacccagcct

SEQ ID NO: 68911 - DNA, 1016 bp, Homo sapiens
atttctgtaaacatcttccaagatagaactgtaatggattgaggaaataacacagaaaagacaaaaacttttgatttcaggcatgcaaagtgcttgggcagatggacagttcccattgtgcattgcctttgataaatttggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttcgtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggcattacagttgtcagtttgtttcttacatcctttatatttttaaatacaattttacttcctttaaaagataccaaagagaatagtggcacatatcactacacataattacatttttcatatatacttaaagaatca

SEQ ID NO: 68912 - DNA, 1050 bp, Homo sapiens
tctctgatggagtatctgggactagtcctcttgccttaactgtaaaactggatgaaatatcaaaggcaagtgttttcagacattggcgaacaagcaatacgaggcagagtaggcaatgcaagactgcaatcaatccctgaaggcagggaaacctaagaggtgaacgtcatgatgagcctggctccctgcctggggaaattttcctaactgcagagtagtgatccagaatgcacgcagagcacagcagtccctctgaactgaggaggaagagatcagaggttggggcagctgaagtgccagaatctgcaaggcaaggtcccagggagatgggagctgtgcaggttacagaaataaaattatgagttcatactaatacctctacttccaatataattgcactaggctttccctagccttcccccagcccatatttctggctccctttcagaagcccggtttgagagcagacaggcaaagtcaccatttccactgtccagtttcctagccaagggaaaacctgccagtgataaggtgcgtaaaatgagggatgtggcccaagagtcattggtttgaaacccagagaactgatgacgtaaaactcagagaataacagatttagtaagggtgcaccaaacataaatagaaatgtagggggtagagaacagcatatttgccatctaaagccccagttgtgatattctttaacaaaaattcccagttatttagttgtagtttttttaaattgactcacttattactgcttaccacagctccttcctttctgagtactgtattttgattcctttctttattgtctggtgtccatctttcagtaacttttttcaagaaagcttcgtggatttggtctcccttggttccatgattatcaccttggccacatatcgtaatgaacttgaaaacttttgaaaaactactgacttttgggcatcatcccagaccaattcagtcaggttctctgagggtaagatccatgcaacagtattttaaaaaaaaattcctctagtgagtctaatatgcaaatgaatatct

SEQ ID NO: 68913 - DNA, 1247 bp, Homo sapiens
tgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatct

SEQ ID NO: 68914 - DNA, 1742 bp, Homo sapiens
ctgccccgcacccctgcacccccactcccccctcctcctgccgactgcatcgcctttgggaagatgaatagcttggccgaagttgtttttcctttccggtggccctgatcaggtgtccccgccccctcctgccgttcgccttctctcgccgccttctcccgacgcccccgcccggcccggcccctcctcccccgcccccctccgggctggaccgcggatggtacgttccgcacgtgagctgggtgctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttatagggtaaggtgcacgcacccttgcgaatatctgtctaggctttggtttgatttttttcttctccagaaagtggtatggagctggcgagggcagagcccctccccgaatgggtgcctgatgctgatttctgttttgcagactggactattcctctttgtatatgtgtaaacccaaaaggagcatgaaacgagacgacaccaaggtaagtgtaagttcccgatattcctcataacctgcatgggtagttaattagagccattgatttcacagtgaagctctgcccgcaaatatattccagcccctgagcttccccaactgtgaattttaagtggcttgctgggtactctcagggggatattaaacatcatacctgaatttaaattgcattgcagaacagtccagaggaaagaggtttcttgggtgtagtttatcacatagtatgttttatggtgggggggcggggggggcagacgagggtaatatccaataagtgaatgtttcgcttactgttttctcttttccatgactctcatatattaaggatacctacaaattaccgcacagattaatagaaaagaaaagaagagaccgaattaatgaatgcattgctcagctgaaagatttactgcctgaacatctgaaattgacagtaagatgcacattttcattctttgctgctctccaagggcgtgttaatagtctggtgcgactcccagaaaatataagaataaatgtaaatataagttcctgacttaaaacttgtgctataccgtacagagtttcccgcaaactggagtaggtgctcccagctgaaggcaagaaatcatttataacctgtcttgtggaaagctcaagaagtaaaagaacagtacttctttcaaagtgtttgcttaaattgctgtgctgaatggacagccaattaagccaaatgtgtgtttttaagtaaccaagtgcccgtttcttttttgcaccactgcagactctgggacatctggagaaagctgtagtcttggaattaactttgaaacacttaaaagctttaaccgccttaaccgagcaacagcatcagaagataattgctttacagaatggtaagtcagttcagggaggccagcctaccctgatgaagcggggcagcccacagggg

SEQ ID NO: 68915 - DNA, 1009 bp, Homo sapiens
acaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacct

SEQ ID NO: 68916 - DNA, 1023 bp, Homo sapiens
ggattgcctggtctctaatttgcattttaacactgttcatcaggaagaaataagaaggagctatatatacttgaccctgtatggccaagaataaagcctactccagaaattgacaagtcattaggtcctccttagctccccaatcactgacttttggaattgacatttaactaccttttctgtaatgtctgggataggagaccactgtgccaaaatgcatttagcagaatggcataataaagtcctttctaaagaaagtgaagtcccaccattgtgggaaagacatgtgtcagtcctagagaaatgtaagtggttctggaaataggctaggaagtttttcttacaacacttaaagtagagatggaaagtgagccttatttttccaacttgggatactatttatattcatttcacaaacatttattgaatatactctctatgctagacagtgtgctcaatcactatgcctagtgtgatttttttaaatatttttatttcaggagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggtaagtgttcggcagatgctaaaataatagatgaatagactgtttgcaggaaagaggggctagagggatttttatttttcatgctttcggaaaaattatttcaaaatgaaggttggataaaattcagattatgtaactgagcattagactggaattctctgcttctataaatagagagaggaattataccccaaagctatcctgtcattatttctgtgatttacatgattctctgactatagaaatgtgatgcaaaatgccaaaaggtttcaccaactggcaaacagatttttaatcacagtaacatatttattatgcaacagaatcacatttaattttgttagaatatgaatccaa

SEQ ID NO: 68917 - DNA, 1080 bp, Homo sapiens
acaacgaatgtgagccttatgttttgtgctttttgtcctgttattttctacctatagaagaaacaaaatatttgaggacattacatatgtggcttcatcattatgtgtcagtcatgtgctgccacatatggaacagatgctgtgtgacttccaaaagttgtgtcacggcacaattagaaatagccctttggaaggaggtaatggtatttttttaaaacgtaagtttgctacactttttaatattatattcatatacatttgtatgtatcttttattttatgtatatttaggtatatttatttattgtatgtatatttacatatgtgtataaatttacatacttatgtatatgtatgtatatttattgtatgtatatttcattttatgtgtattttattttatatatttttacataattttatatcatatatttgtatgtgtttttatagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgtaagccagagtaaaagtattttttcaaggagcacatcttttttttaaacctttcttcacagcatttataatttagttttggttttcaggaaaatatattgtaccatttgctttaaaagtataaccatggctgttaaagccaattaattgtttgctaggattacatagctaatgtactacaactctttgtgtgttcgtagagtggtgaaatgtttccaagttaatctgtgtattgtattacagcaatgaaatcatgactgcgaactttatataggagttgattgttacacaaataacataaacgaggttgcctcttgcctatcaggtttcttgagcatgaagatttactctttgcttctgcataggaatagcctccatcatttatctatgataaatataacatttgagcaaattctaacaggatttcatatattaaaatggcaaagtggaaacatttctcactagctgcaaaatctcaagtgccaggctgggagcttgaa

SEQ ID NO: 68918 - DNA, 1064 bp, Homo sapiens
ttgaagtggggattgagcttaactgcctgggtcttcttgtttgagatttttgaagtaatctccaaccttcaattgtatatcctaaaacttgggcaagatacttagaggaagcttgctgttgaaacacttgcattagctctggcagtactgtggaaaccttatatcccataggccagtggaattgtacaaggtcaccttgtaaagtgatgacatgcctaggatcttcagccatcactggaagattccacagatgcttgtttatcttgcttctgaatgggctcatcgtcactgaagaaggatctaagtggaaatagtcggccagcgtgtataccaaaaagagacgctcttggacaccaagagcttcagcagctgctttaagagtaatttcagctataatggcagaaaattcctttgaacctccttcggccctaatgctgaagatttaaaacaaaaacacagcatggattactgcttgactagcaatcccttatttttatgtattccttcagagtttatgtggtattctcacatacatcctctcattgctacatccaacaactaggagggaagagagggcaactattatttttcttagtttatagttgaagaagctaagtttcaaagtagctaagtacccaaagacgtagagtaagcacctgatctaaatccagttattctaacttcagatgggaaagtaggggatttcaatggaacagctgtgggttttggagtttaaaagtttaaactccaatttgtcggttagactggctacattattttgaggtatttaactgatctgagtctcggtttcttcaaataaaaaagaggaatagcacttaacttgcagggatgttctgaatcttaattgaggtaagacactttgcgagtgagctggcacactgatgagcctttcactaccctgggcctttactgttcctttctttcccttctctttccctccctctggccttctctatccttcctttcctcatgttcctccctctgtccttcccttcattattccttttgtcctttccttctccatatcccatatccttcccttc

SEQ ID NO: 68919 - DNA, 1007 bp, Homo sapiens
tgaagcagtgagttatttgctttgttatttctggcacatttcaattaaaatcattagtgtaatttcacgtatgtggagaacaaaagcttccaaatggtaattttgttacagaggtgctgctagatgtgagcaaatctaaaaatttccatatcataaagatgggaagcattagacttaggaaattccaggatctgaatttattcttaagaagtttgatttcattgagatctctatttcagtgattaaaatgaacatcttagattgaatcatgaaattaccatttttatatgcaaagtatattgaatatttgcaatttgttatggtacaatatgtatgtttgtctttatatcctgtctgaatattcaatagaaactacatttagcagctggtgtatattgaaacaagttccccctagagaaaggtacaaatttaatttagtgtttagttagaaattttcttatttgtaacattttaaatgaattccacagctgttttgaatcagttgaaagtgaaaaggcccaaaggagaaaaggcgatattaagtgcccctataatttcttagtaagaaataggggagtaaacaataaactctttagaagattaaaaagaaagtagtgtcttattttaaaatagataatcaccttaagtttatgtacttaccaagttcaagaacaggccttgaggatcaagtttaaagggacagaagagaaaaaaaaaggtcaaagaggtaggcataaagtgccacgggagctgcagagatgttcagaagcagaattaaaacaatgcatttggatatgccaaccaagatgctggtaatgacttccaaaaagccatttccatggaatggtgggaatagaaacaactgcagcaattaaaatgttacatgaatgaagttaaaagtagaggatggtgaatgttgtcagctgtttcagaaatatggtaacaaaaaatgctcttgcttatagcttggtagaagagaaatgagagaagttttgttattttttggt

SEQ ID NO: 68920 - DNA, 1045 bp, Homo sapiens
ttgcaagtgtttttgttctctgatgaaactctaaaagtttagagttaagtttctgatttgcagaacataaatacatctacacaatacatagactagagaataaatgggaataaacttattaatcttatttgtaatttgaaattcagtgttattttgttcctatctttaaaaatcagaattgtgcaatttcttctgaagatcacatcatttcctaccttttaaattttaatttaagtatcttctttttttttatattttacagctaattcctgaatcattgcattattattatgaaggaaaagggaaacttgtatttaattcattaatttctgttacctggttttagattgagatttttgattagtccctaggtttattttatgagattagccatcttttataaaggttgatatgcaaagttagtttaattattagaccattagacttctaaaaatttgaactttacatttcattatttgtccctctaaaagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaaggtaaggtacagctgtggtaactaggtttataaaaagttttccaggccgggtgtggtggcttacccctgtaatcccagcactttgggaggctgaggcaagcagatcacctgaggtcaggaattcaagaccagcctggccagcatggtgaaaccccacctctaataaaaatacaaaattaggcgggcatggtgacacacacctgtaatcccagctacttgggaggctgaggctagagagtcgcttgcacctgggaggcggaggttgcagtgagccaagatcgcaccattgcacttcagcctgggcgacagagcaagactctgtttcagaaaaaaaaaaaattttccaatgaagctctgttttgtacagtgttatttaatattgttgtgtatgtgaggaagagttcttaagtatttg

SEQ ID NO: 68921 - DNA, 1049 bp, Homo sapiens
gtcaggctggtcttgaactcctgacctcgtgatccacctgcctcagcctcccaaagtgctgggattacaggcatgagccactgcacccggccgcttttattattttttaaattaaaacataattgtacatatttatgggatacagtgtgatgttttgatacatgtatacaatgtgtaatgtctctgacatatttttaaaggtgattcgcatctaggtggcggcagtcgagaaggctcgtttaaagaaacaataacattaaagtggtgtacaccaaggacaaataacattggtaggtatttaagaataactgaaaaagacgaaatcaaaaggttcttaaggtattatatgggggtcaatttattctgttttgcattttcgtttttcattgtttcaggactcaatgaactcagtgaagaagtttttttttctttcttttaattgtgggaatatttctttatattctttcaaatcagtgttttcttctatttcagaattacactattgtactggagcttatcggatttcacctgtagatgtaaatagtagaccttcctcctgccttactaattttcttctaaatggtaactttaattatttaatggttttgactgaaattatttatattatttgaattatttattattaaattattatttgagtgaaattattattaagaatatgaactctggaaagctatattcatcactgtagctttgccatttatttgccaaagctgttttaaacttatgtaatttgaaataccctttaacagtttttactaacatttaaaagatgactttaggtttggctttcaggctattgcatctaagcaggttttatttaataaaattgtgagtatttttatttaaaaaatttgaccttcagagtctaaattgatttgttttagaagctataattagaaaatagatttgaagaattaaatagaagctagaataatatagaccatttatcttggcccattgaattttaaatcaaatcaaaggtggacttacttatatttgaacatgatacctttatcataaataaa

SEQ ID NO: 68922 - DNA, 3009 bp, Homo sapiens
ccactacaccccaacctgggcaacagggtgagactccatctcaaaaaatacatatatatcttggggctgcagttgaccacaggtactgaaaccacggaaagcgacacagcaaagtcgggggactactgtaacagctttgagaagttcttcagtacaaaccagactgactagttcatccctgtgcaaacttatctgtcagtatcacctattaatggcaatggaactagtgtcctgtggaatttacttcggaaaagactgggctaatagaacaaatactgagaaagatagccatggctttctcaaactcattacagtttcatttgcaggcaaacaaccttgaggaagggaaaagaataggagcaaactcgaaagagtgatagactttcaacttggcctagaaattaaattttgaaatttaagttagttttttttcctctaaaaattatttcaatccatagatctcatctcccaaactgatttctgcaactgtattggcttggtttaggggagaagactctggagttaggagataagttttagctaaagctttgccaccaactggcaagacccatatgtttctagatgtatgtttgcatgcttatgaatgaaagatgctggattagatgagctgtagtattccattcaattctaaaatacaatgaaaattttaagatgttgaaggtcattttaaaagcctttaagctttgacatttggttaaattctttagaatgttttctagtaaattgatgctgccagagaaacggttgactttgattatgttgtatgcatcttctgaagcataatcatgagccaattgtgacatttgttacatgtctgaggaatcttagaataaacctaatgaactgctaacatgaaagaaactattatgatgcagggatatataaacgtttaccaaaggaatatagagaacttgtttttgaaaatatattacatggaaattgctacgaacctgtgatgtgatatcaatttttaaaatgttattttaaaaacttacaaaaatgggccaggcgcagtggctcacacctgtaatcccagcactttgggaggctaaggcaggtggatgacgaggtcaagagattatcctggccaacatggtgaaaccccgtctctactagaaaatacaaaaaattagccgggcatggtggcgtgcgcctgtagtcccagctactcgggatgctgaggcaggggaatcgcttgaacccgggaggcagaagttgcagtgagctgagatcatgccactgcactccagcctggcgacagagcgagactctgtctcaaaaaaaaaaaaaagtgtcaaaaatatcctttgtaacacaaaatagttctttaaaatagttgttgacttggcctgtagttatatgcattacatgtggacactatgtgtcaaaagttattttaacaataggaacagagtgctgtgggagcacggaggaggctgcctgtggttgtgccagtaagagttaggcaggttttactgaggtggtaacagtgtagctaggtcttggtgagtaggcttatactttagcccagataccttccctaagttccagatctttttttttttttgagacagagtctcgctctgtcgcccaggctggagtgcagtgacgcgatcttggctcactgcaagctctgcctcctgggttcacgccattttcctgcctcagcctcccgagtagttgggactacaggtgtccaccaccatgcctggctaatattttgtgtttttaatagagacggggtttcaccgtgttagccaggatggtcttgatctcctgacctcgtgatccgccccctcagcctcccaaagtgctgggattacaggtgtgagtcaccgtgcccggcccctaaattccagatctttatattctacttcctaattgtatctcttagatgtctctcagtcacctacacttcaacatgcccaaaacaacttaggagctttgccacctgaactagtctgtttcctttttcagtgaatggccctgttgtctgttcatttatgtaaggcagaaaacctcagaatcgtttttgagacatctaatccatcatcacattttcttgattttgtctactaatttttctctcgtacatcaaaatctccatcttagctaccaataacatttccctaatccagccttttatttccttacctagtatctcacagtagcctactaaatggcctgtccctatctactctttaccctctagctacagtaactttcagaatgctaatcctgaccatgttctcatgaccttaaacccgccccgtgcctatgcttttctgttgcccttaggaaacaacagagctgtttaaatgtcttacaaggcccttcattgtctggccccctccccctttttattctcatctcaaagcatactaatcttctctgtttcagccacacagatctaatatttttcatgcttcctcctgccacagtatcttggtatccattgttcttttgcctgaatagtctttcctctatttcttcttctttttttttttctttttttctttttttaatctgagacagagtctcactttgtgactcagactggagtacagtagtgtgatcatagctcactgcagcatcgacccctcgggctacaagcagtccttccacctcagcctccggagtagctgggactgcaggtgcataccacgaagcctggctaatttttgtattttttccatagagacagggtctcactatgttgcccaggctagtttcctgacctcctagcaatcctcccacttaggactcacaaagcactgagattttagatgtgagacactgcatctgttccatttctttacttaatttctactcatacccttataactcagaccagtcttcacttctcaaggaaacttctcctggtgttttggaataggacagatctccctctacaggcactcatagcactgtagattttccttcaaagccttgtcagctttatggttgcacatttgttcattattatta

SEQ ID NO: 68923 - DNA, 1586 bp, Homo sapiens
tttattactctctaactgaaagaccatagatgtgagctctgtgattttactggtggattttttaaggaatctattgctagctgttcattttcattatattaacattatcattaagttgttttagggctagcacagtgcccggcccatagtaagcttcaaatgggtttttactgagtggaatggaatttaattgtattgattatgtttacaaatataaggtagccactatatctcaaaattcaaatttttcttacattccagtttctattttctgccactatattatgaacaataaattgcatgagaattataatcttttcattgttaatttcttaatgccattggccggtttttcactacaaatgttaggcttaccctgtagaaccttttggatgcagaagtaaataacataataggtacactttaatatatataatgtcatgtgttataagaaaaatactctgatagcttgcctgttaattttgatcatatttgtgtgctactggtgtgactcttcaatctttgtgttttttggtaaacagataatgttgaaattcctatttcctattactgaaaacaagttactaaacttgtttattagtttatattttatataattgatatttggtaattcactgtaggtatttaaagatgctatttcctctttttaacaatgatttcgctttaaatttatgtaaattatttcaattacattatatttgtatattaaaaatattggcaagactgcatttggagtaaaaaaaattcaaaatttctgagttagtcatctttgttaattctgacataatgtaaaaaaatcattaaatactttattacctgtatattgccagttgttttttaatggagtttatgttgcatggaacacttgcatctttaaatagattatcccattattttagctaattattattgaatgtatttgccctcattttaaacaaaaagcaaatgaataattaataattttattattttgaaagcaaaaccaagttttttaaaatgtttgaaattttacttcaaggaagaacagcatgctaacacatctgccaattatgatgtggagctacttcatcacaaagatgcacatgtagatttcctgaaaagtggtaagagacatttgaaagtattattttgtatgatctaacatatgaaagcatattacagtagcccccacatcctcagggaagacattccaagacccccagtggatgcctgaaatctcagatggtctcgaaccctatactgtatacactgttttctcctatacgtacatacctatgataaagtttaatatataaattaggcaaagcaggagatcaataacaataagaatgaaattgaacaattataacaatatattataatgaaagttatatgaatgtagtctcttggtctctctccctctttctcaaaatatcttattgtactgtactcatcgtttttgggatgatgtgagatgataaaatacctacatgatgagataaactgagatgaatgatacaggtattgtgacatagcattaggctactatggaccttaaacacaagcactatgatacctcgacagtg

SEQ ID NO: 68924 - DNA, 1066 bp, Homo sapiens
tctctttaagtctcatgcagattcaaaaatgtgagttggtcttgatccacacctacccagttggtgaagacagccttgtatctgatcgttctaaaaaagaggtgagtgttgaaataatgaaagaaaagactattgtggttaataataataaatactgagaagggttatcattaaaatgatccattgccaatattttctgccaagaaaatattttgagttttcaaagtaaacctctatgtcaagacatctaggttggttctttatggtataattgtggattttaaagtgtttcctattctgcctgccttttcatgtttgtttattttatcaaaatgtgttacaaaccatacatagtttgtattgttcctaaaattttattttagtgattatttttattctgtaaaaatctttttccttattagaaaagcaatacactctttaacaaaaaatattccaataaaaaattaattttacacattcagagggaaaaatcttattttccaaccttggttttactttttaaataaatttgaataattttaaaggaatagatgatcctgttgattgtcaaatagatccacatcataatattctctatcagtaatttatgtttagaaatatagatatatgtcctggtttttcattttgcattatttaatataaacatcgctagtattacttttgtccatgaatttttgtagttaagtggtatttttagtcattattgccatcattgtgtttttaagtggtttccagcataagcctcttttttattaacttttttctgcctcttttgataatgtggcaatgttagttttattttatgataatgaaaacttatttgtaattaatattattgccctggaatgagtaagattttgtgttatcttgttgtacactacttctagctgccttatttattggtgacagaatgaaatttttgtggcgatttccacattcattcttttagttttatctgcagggttttgtcctctcaacaaaataaattattttttctgcagtgtacttcaaatcatttttgcatatagataaaaagacgtaaaaa

SEQ ID NO: 68925 - DNA, 1032 bp, Homo sapiens
cacaaatctcgactagtggttccccacactttcgtctgacttggctacaagttaggtgtttccacaaccccctcctcatgttcaatactttgttctgatgggctcacagaactcagggaaacacttcagttttctgatttattatgaaggatacagatgcacagacacatgaagtgggtgaggttggaaggatcccaagtgcatcaggttctgtccctgtggagttggggtgtaccaccctcccagcacatggatgtgtttaccaacctagaagctctctgagccccatactttagggatttttatggaggcttcatgtaggtgtgattgattattaactcagtatctagcttctgtcccctctctggaggatagcagagtggggctgaatgctgctgagcttctaatcattgcttgttctttctggtgaccagaccccattggggagctgtccaggatcccactaaagttgcctcagtagaagaaaagatgctcctgtcatccaggaaattccaatgaacttaagagctatgtgtcaagaactggggtcagaaaccaaatattagagcaaaagatgctcctagcacccctgtcatttaggaagttacaaggattttgggagctctgtgccaggaagcatgagcagagaccaatatgtatatttgtgattgtgtcacagctagtaaagacatgtttggaactattgcaatgtggacttttttagagtgattattagttttcttaggtgcggtcatagtgttattgttatgagtaggattgttctcactaggcgaagcaggctgaagtgttcaggactacacgtcaagccctctgcaacttactctcaaatggtttaattaaaaagtgtacatctacctaagtatagtatatagagaaagcaaatatagctaacagtgactctaggtgaaggacatacgttgttcattgaatagtacttttctttcaactttcctgtgggtctggaaatttcaaaataaaaagttgggggaaatttttagcattaccaatcct

SEQ ID NO: 68926 - DNA, 1039 bp, Homo sapiens
tgagtttgtctcctctcccactgcctgctctgactttcaccctttccagggtatatgcttagatgcctttgcatttgttatttgccgtacccagattgtctatccctgactttacggtggctggttttggattgccttcagttgccacttctatggagagtccttctgtaaccacctaatctaaagtagctaattaacttatttttcatagcgtttatcactctctgaaattatcttgttcatttatttgtttgtattcttcccgcagtgccttctgtcctagtagactcccctcccctgactttccccacattgtgagtgacagaacttttttattcatcactctattcccatgtactcagtgccagcaatagcacctggcatatactacacattctgtaactataaaaagaagaatgaatgaatcagtgaaacagtgttacaaattgcatattacttgaaaatatgttggtgattgagtgaaattagagttgaatactaattgtttctttggaatctattaggtgaattttattgtgagtgactctggagcacatgttttaaattcttggactcaagaagaccaaaatttacaggaggtatggttagattttgagctgtggccatttgtaaattatctaaatgtggtaatactttttaaaaaaatgactaattttttaaatcactctaggatttgcatatagtgttaaaatgccaagtcatatgaaaacagctatccccattctaggctttccctacacccagcacccccaagcaaacttccattttttagtagttgtcatatttacttccagatttctaaataacatgtttttattcctgtttattgagttctctgtttatttatctacttatttatttattttgagacggagtcttgctgtcacccagactggggtgcattgcgccatctcggctcactgcaacctctcccaggttcaatagattcacctgcctaagcctcccgagtagctgagactacaggtgtgtgccaccatgcctggctaatttttgtatt

SEQ ID NO: 68927 - DNA, 1461 bp, Homo sapiens
tcagtataagattttgttagcgaagcaggggagtaccgtatgctctgttttaataagaaaaagttttaaaagttttaaatttccttctacacaccagtgtgatggtaacaactaagtttttctgctctacctggtaaattactgtgatgtttcaaaagctaaggggagagtgtgaagttggggtccttatcctaaggcgaagacctgatgtgcggttatcttaggagatgtttatctttgttttggccttttcttttgctgtcactcctctttcctgttaattccgcacccctacccgccagtcccccttcaaacgtttttcttggagggaagtgcaaaaatgctggcttggggtttatatgtgactaatgtcaattagcaaggatcataaagttgtatttcaagagtctttgtcacttatgtttcgtatatgtaagggaatcaaatacaattaaatgtcaaaatgtttccctctgacaattttaagttcattttaaaagcaaaaccaaaaatgcatgcactggtatttttgtctgggcctggtagagtgacagcctaatatggtgtattgatacccttgctttctggtcatgacctcattaaactgtcctttgtcggacagatttctttgaacatattattcatgttccctaccaagtcttcttgagggaaagacaatcttcttgagaaaattagaaaaaatgtaagatgttatgtacaaatatttggctaatatgtttttccccttacaggttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgagtgtgaagtacaaacaaaatcatgattttggggatgtacttaactgcataaatgaatttttatatgaatttgctatagataatgactgtgtgtttattacttaaaaatgtggtacataacgctgccctttgggattaatatataatggatatttaattggggccagtaataataacagctaacaattattgagcactttacatgtgccagacatatttcaaagtgcttcatatttattaatttccgtaattctcataacagtcatgttaggtaggaactgtagttattgaagcaatattcaaagtatgtaacaaccagtatagaacacagactgaccattgagagctgctgtcaaactgtgctggcatgtagcagctgactgtcagtcttgtttgttgcttccctgttgcagatccggaaactgaggtaaagagaagaaacttgtcctgagtcacatagttacgtagag

SEQ ID NO: 68928 - DNA, 5528 bp, Homo sapiens
cgttagcattagtgtattttatgtgcagcgtgataattcttcttccgatgtgcccagggaagccaaaagattggacacccctgaactacatcattttacattccatcaacaatgtatggaaggttgcagtttcttcacatcctctccaacaattgttattgtctttttcattacagtcatcctcgtgggatatattgaattgcattctcctaatgactagttaggttaattaagtatcttttcatgtgcttattggccatttgtatatcttctttagataaatgtttattcaaatcctttgccacttttaaaaatggggttattttcattttattgttgagttgtaagtgttctttatatattctggatactaagctcttatcagattttttatatgtatatttcagatatatttatatttatatatcatatatatatatatatatatatttgcaggtattttcatcccacatgtttttctcccccattagtatcaggaagaaattcaagaacttaatgaagtcgcgagacatcggccacggtccacgttagttatgggaatccagcaagaaaacagacaaatcagagagttgcaacaagaaaacaaaggtaagatacgttactttttgacattaatcccatttctagtctatattcctaaatcgtatttattgctctttatcctgtcccacatatgaacatctgcctggttgacatcctcttagattctcacccttaatatccagttagcactgctgttgttagctatgaaataacccagcttcattctctgcagtcccactgcattggcccccagattagatgctcagtctcttgcctgaaatgtccaaactgatctccctgattccagtctctcttcccccttccaatctgtcttcaacataaccatcagattgatatttcaaaaatcagtctgatcatgtaattcttttgcctaagaactttcattatatacttattaccttttacagggtccctaaaaatcatttcccagccttttttttaaatcttcttcccacagctttcttcactgtgaactctttgctcttgccaacaccaatcacttcctaaacacgtcatctgttttcatgcctacctgcttagaaggtccattccttcacttttcaactgagggaactcacactgtacttctacaaagcttccaccagtttcttcccatagacatctcttaaatctatttgacttaacactccactctgccacctaccacatgcttgttttctctactagactcttgaggtctgtggcccttaatatagagggagccttggccgatattaattgctgtttagtacatctttgttgaaatgattctcaagaaacaagcttaaaatattcaaaaaactaatacgggacttcatttggtgtctcttattgttatatggctagatttttgtgcattgtgttttctttttaaaatgtcccgttcataagttgcttagtggaagagaatattttgtgtacttttaactcaagttggaataaaatacaatattattcttgatagaattacgtacatctctggaagaacatcagtcggccttggaacttataatgagcaagtaccgagaacaaatgtttagattgctaatggctagcaaaaaagatgatccgggtataataatgaagttaaaagagcagcactccaaggtaatccattctataaatgtgacctgaaatggaaaagagagacgattgattattctgtgttcagattttttttgaaaaaaatcacaggtatctagtaatggcattttaacatgatgttgaatgtttcatctttttaattgacattttctcctttttcttatttttccatttcttgttatatatcattttctgtttgatttataaactctcactgtttcttagaaactttaatttgtacgttgaaaaataaattttattttggatataaaggtaagtctggtctcttcaacattatttttgtagggctatatacttttaagaaatatttcttaaagggctgggcatggtggcttacgcctataatcccagcactttgggaggccaaggcaggaggatcacttgaggccagaagttcaagaccagcctgggcaacatagcatgactccatctcttcaaaaagtaaaaaaattagccgggtgtggtagcacatgcctgcagtcctagcttctcaggaggctgaggtggatagaccacttcagctcaggagtttgaggttacattgagctacgatcatgccattgcactcccatctagacaaccgagtgagaccctgtctcttaaaaaacagaaatttttttaagaaacattttttctaataaatttgtgtattgacttctcttgcaaaaacaaaaaataatggaaaccttttttaaaatctgaaagcagtttaatgtagatttttcttaagactgttttctgaataaggctaattcatccagactataaatgatcttgtttattataatggaaaaaacatggggttcaggagaagaaccaacatagtaaaattttgctcccttgccccagtattgtataccagttgacatcattttttagaaacaaagctgaagtagttagaaattagtgttttacctgctgttcatccctttgtcatccctgtgtctattccctttggtatgtccccatattttatggcatattttatggcaactgctatgaagacaagtagaataatcctttctcacatatttattttaaactgagttttagttgctgatatgaaataaaaataataaactagattgtggaaactagactgttacctgtattagataatggtgagctgactattattattaccaatattatttaagaaacagtgattatgagccttcttttccccatttgttacaacagaaataggaaaggacatattttcatatttatctattattgaaacacattttagattctttaaaatacttcttccattttggtgcttgtacgtgtttttaacttattagtaattaattctattagaattaaatacctatcaaatagctctttatatgcctttattatattagaaaacctaatgataggtacctcttgtgtcaaccagtaaaataataaattaaattaaaaatttgtgtttaatgttttctaattatgctattcatctcctaatcaaatggcaatccagggatgtttaagtggtgatcttttgaatacaaaatttaactattgttaatgagaccattctaaaatcatttaaatttaaaggtataataataactatagtaactaagactttttaaaggcactaaaaggagttgacttaatattatttgtaagataaatataatcttgagaatttctaaaaggtttgtatgttttataacctaaaaataaaatgttaaagatctaaagcgaagaataccattacaaaaaaagtgcttagaataggataactatagcttgcaggtcccatctggtagcaactatgacagaagcaaatgtttcctaaaatatattagattttactattcaccagagctggtttattaattagtaaggttaaacatttcctaagatagctgtaagccatccttttttattatgtagattgaattcttcatctaagttcagatgatccttgcctcccataaaatgactattcagttatttgttattaattttcactaatacatattaatgtttgtgattttgatttttcccaaaaaggagacacttcgacttaattaaacaaacattaatactggcactgggttagttatgggaaataataagatgaatgtacaagcttgcagtatagtgggagatacagacacaaacataacaatctactataaggtagggcgtgatgaatcccaaagtagatgaattgttactggaacgctagagggaacaatattaactgtcataaggaaaatctggaaaggtaacaaggaagggaagaaagtctgtctcagtccagccttgaattaattatgggcaggtaggtaaacaagcagaagtgggtgggtgggcagagaaacttgtataataaaagcacaaaaagtatggtattgtagggtgtgtttaggtactagtgctctgatatgcctaaacacaaaagtaattttacaacacatttagagctaagaaacagagttacacataacagcattttggattggagtaagagatccttttgagactgttataatacagaactttgcccttaactagaagtttttgagcacatacttaaaaaatcagtagaaagtttgagagctcatttttacccaaatactaattttcatgttatttttgaacagatgcctttttggaaatcttaaaaaagcaaacatttcaaacagttggctaacacgcatgaactaacactcattcagtttttaaattacggatgatatccgtattaacattataatgactctatactacagattgacatggtacatcgtaacaagtccgaaggattcttccttgatgcatctcgacacatccttgaagcacctcaacatggactggagagaaggcacttggaagcaaatcagaatgtacactaaataaacagtcaacttttggggtgtggatggaaggggggtccattttaaaagtgcttttacattgaatttccctcccagattagatcagcaaataaatgaaatttattaaaagaatgttgtgtctttaatagccatgctgttcagtgtagaaactttaaatctctcattaattttctgtgtattgtatcatgtacagcctgttagatatttgcaggttttataggttattcagtccaacgctttatttatttgctcttgttagttgttgctgtgaaacagtcatttcctttctggacatcaaagatattttcttggcattaattttaaactgatttcataaggtcaaagtattaaatgttttaattcagattgtggatagtttgtagtcctttgattttgcaaatgaaattaaaatgcctttgtttagatgttaggattaagtatagtagtgctctctccattgtgtcttaatttttttttaactcacttgtggcaggtctttattgaataaaggaggaataaacctagacagggagttagaaatgaaagacatttcaagacagttcaagggttatgttggtgacacttcttgtcttccagacagttttgaaagcacagatcttgcctcttgtgcttgttaaaaaatctgtgatacttctctgaagattttataattaaataagtgaaccattaccatgaccttttataaaagtgctgccctatttgaagtattgggttttttctcatgatgagctttgttagacttggtactgaaaaaatcagtagtttttttccttctattttaaaggcaaagaaatgcttgcttcagctaggcatggtggctcatgcctgtaattgggaggctgaggtgggtggatcacctgacgtcaggaattggagaccagcctggccaacatggtgaaaccccatctctactaaaaa

SEQ ID NO: 68929 - DNA, 1006 bp, Homo sapiens
cagactttcttcccttccttgttacctttccagattttccttatgacagttaatattgttccctctagcgttccagtaacaattcatctactttgggattcatcacgccctaccttatagtagattgttatgtttgtgtctgtatctcccactatactgcaagcttgtacattcatcttattatttcccataactaacccagtgccagtattaatgtttgtttaattaagtcgaagtgtctcctttttgggaaaaatcaaaatcacaaacattaatatgtattagtgaaaattaataacaaataactgaatagtcattttatgggaggcaaggatcatctgaacttagatgaagaattcaatctacataataaaaaaggatggcttacagctatcttaggaaatgtttaaccttactaattaataaaccagctctggtgaatagtaaaatctaatatattttaggaaacatttgcttctgtcatagttgctaccagatgggacctgcaagctatagttatcctattctaagcactttttttgtaatggtattcttcgctttagatctttaacattttatttttaggttataaaacatacaaaccttttagaaattctcaagattatatttatcttacaaataatattaagtcaactccttttagtgcctttaaaaagtcttagttactatagttattattatacctttaaatttaaatgattttagaatggtctcattaacaatagttaaattttgtattcaaaagatcaccacttaaacatccctggattgccatttgattaggagatgaatagcataattagaaaacattaaacacaaatttttaatttaatttattattttactggttgacacaagaggtacctatcattaggttttctaatataataaaggcatataaagagctatttgataggtatttaattctaatagaattaattactaataagttaaaaacacgtacaagcaccaaaatggaagaagt

SEQ ID NO: 68930 - DNA, 1325 bp, Homo sapiens
acctcttaaccaacaaaaatgtaggtccttttcatggggaaacctatacactgctagtactcagcaagaaggtactctaaaaggctaatctgtgctgtccaaaacaatgttaaacttaattaaaatcaatacatttttaaaaattaacaattcagtccctcaaacgcattagtgacactgcaagtgctcaacagccacatgtggctactggcttccacactggacagcacagataaaaaacattccaatcatttcagaaagttctactggatagttttgaattagattatggtaggaagaatgatattaagacaagtatctgtcatattctgcaagttaaccattaaaattcctcccattgtcaaggaagcataatatgtaaaagcaggttaagtacagatcattgcagctgcaaactgagtaagggtaatgagtaaaaactttgaataccaacagcatcctcaatttatgatttggtcagtcctatggcactgacctaagttaaaaaactacacagaaagcaagcatttctttttttttagacagagtctcgctcttgttggccaggctggagtgcaatggcacgacctcggctcactgcaacctcccactcccaggttcaaacaattctcttgctttagcctcccgagcagctgggattacaggcacccgctatcacgcctggctaactttttgtatttttagtagagatggggtttcaccatgttggccaggctggtctccaattcctgacgtcaggtgatccacccacctcagcctcccaattacaggcatgagccaccatgcctagctgaagcaagcatttctttgcctttaaaatagaaggaaaaaaactactgattttttcagtaccaagtctaacaaagctcatcatgagaaaaaacccaatacttcaaatagggcagcacttttataaaaggtcatggtaatggttcacttatttaattataaaatcttcagagaagtatcacagattttttaacaagcacaagaggcaagatctgtgctttcaaaactgtctggaagacaagaagtgtcaccaacataacccttgaactgtcttgaaatgtctttcatttctaactccctgtctaggtttattcctcctttattcaataaagacctgccacaagtgagttaaaaaaaaattaagacacaatggagagagcactactatacttaatcctaacatctaaacaaaggcattttaatttcatttgcaaaatcaaaggactacaaactatccacaatctgaattaaaacatttaatactttgaccttatgaaatcagtttaaaattaatg

SEQ ID NO: 68931 - DNA, 1819 bp, Homo sapiens
gggactgaattgttaatttttaaaaatgtattgattttaattaagtttaacattgttttggacagcacagattagccttttagagtaccttcttgctgagtactagcagtgtataggtttccccatgaaaaggacctacatttttgttggttaagaggttattaaatgtgctttgccaaagatactaccttgtcatttcttccagcttattagttccgtgggtttcttggagtactgttaaatcctttttacaaatatatatatacacaactactgaagagactgtttatttggggagttattcacttttatatttaagtcttaggcttaatatgataaaatacctctcagttgctgtgaataatggtctatagaagctgttcattgagaaaatgattattctcgagtttctgttgattttaaaccttttttgtctgtctctttcactagactgtaagcttcttcagatcaggggacatgtcttgacagtctttgtattcctgttgtttagcatagtactggcacatcataggtgtgcaagataagaaaatgagattggaagaatttatgctacttgctgcgcctaacaaatgtggatgtctgtattatactgatactatattttcaatagttagcaaagaaggccatttaatattttaatactgaaaagcagaattgtgctcattttattcaatacttaccatataccatacactagatagtaggtggatgtaaagatgcagttcctgctctcaaagaggattatgacctagaaaaggttacagattggattgagataactttataggcctgaacaatacagaaaagatttctaaatcattgaagacttcagggaggaaaagagattgaatgcgtcggcaatttttatcattcccgttactttgaacaatagtgtatgtaagtgcaaaaaaaaagaaaaagttgctgatcattgtggtgagaggaatgtaaaatatgagtatttttcttgctgctaggtttagttatattgtgctgcttattcttaattctagtcctaacaaatttgatttcaaaagcacatctgtggtcaaccaacttcattgttaatatttgttttattcatattaagtgacaatgtaagaatattcatgttaagtggtactgcagattttataaaaaggagaggatccaaaaataaaaaagtattttgctgatttccaactcccatccctctttttcaggaactgcaagcacatgttgaccagataactgaaatggcagcagtaatgaggaaagccattgaaattgacgagcaacagggttgcaaggaacaagaacgaatatttcaacttgaagtaagttttacattgcaaatgtagatgaaaactgtccatataaagatttatgccagaaaatatatcccatttttaaatatatatttactcttcttgggtactggtaatgttctcctggatgctgtctatgtgggcatattatgcaagaccatttatgtggtgatgcaagaatctaggattattagtaacttacaatataccagtaatgtagaaaattgatgtttcattctatattgcttatcttatgaagtgaatgtacttcttcaattgagtcatttttaaaattttgtttattctattagagatcatagtgatacagggaaattttttttaatccacaaatatttaggggcactcttatttttctggggattctaaaaacctttgtcatctgtcctttattttatgacagtgaaagtaccagtctctgaataactgaaatcagtacaatagacttttatgccttaagagcttcattttga

SEQ ID NO: 68932 - DNA, 1727 bp, Homo sapiens
tcaaatgccaatgagctaaacttgtcctacattccatgctatcatggaaagtaataaaaatactaaaaattactaggagattctagcctattcactggctttacgagtttatataaaaataaatctagatgttattttcttcatctctaatgtgattgtaaaataaggcaatttctgagcttctgtttacaattatagctgcttaagtaagaaggctttgcagtggtggaagatgttgaacacgattcctagctgcataagtgttctttagattcaagttgccaactgcatatatcattgagtagattaatgccaattacagaccttgcttgtttgttataccttcatatgttcagtttttcctaacatatgtttgtgatgttgtagctaccttgtagatagtgactgcatctttgtttttgcttgccttttagcaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaatacaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagtt

SEQ ID NO: 68933 - DNA, 1038 bp, Homo sapiens
aaggtttaatattctagcaatttctttgttggaatcagttttctatttcacctgctacagaaaactcaactggcctgtggtacaatatacctagtatggtttggcaacctggtagctaacctataacagattaatcagaactttctgaaaacattttaaagaacagttcaacagagtttcctgttaactactacttttctttagtctgacacacctgaagtgctaataacaccaaattagtcttttaacacattgccccagatttcatttcctgttattatctttgtgattttttaaaaatgaagaactatattgtttgcccatattaaataacttttatagctatgaaactcgtcatgtcttgttgctgtggtacaaatataatctgaaaaattttatgaaaatatttaatgaggctttttagcatttttttcaaaatagggatttattataaaaactatacaaactttttatcactcacaaatgatgaaaaattttaaacaattagtatcctccctccaaaatagtgtgttctgtctttacagtcttcactggcagtgcattcagatagtatagaaaataacaaacattccatataactttgtccctacagtaaataattttttaaaacttttcatcaagtttcagtgttactgaagttaattatagacagtaaggattacagaataagcagtaaatggtcacctgcactgtatttttcaaagcaaaaattgttttatattttctatgttgttttatcctgccccaaacacttaaagcaaaagttaaatatttttccagttacctgaaacttcaaaaatctattgtactttgaaaaaactttaaaaagcagcatcatttaaatagtggttaactcataaacgtgtatgcaacaacattccacaaccctaataccactcaggcctgcagagtcaccagctcacaataattcagtgctctgaaagctggggggaaagcccctgagtagtaagtatgcaacccagggtgtcgggtgctttcttgtggtgaaacaagggt

SEQ ID NO: 68934 - DNA, 1546 bp, Homo sapiens
acaaacaactgtgggtacttgttacataatgttggaaggccaaggatccaaacaactgatttttttacaacctgtctggactttcaaatgcctgtaatagaaaattcctagtttcaaaaataagactgtggcttccctactgattccttggtttgtaactgaggaactacatatgtgtttggactaactcaccagaaagtctattagaaaggaatatacagatttagtccatgaagggttgtattattatgttagattttaaaatactagagttcaaactgtactttttctactgttttttagacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttaccctttgtttttttttcagtattttttaaaatttttaagttgtgataaaatacacatgaaatttaccttcttattcatgtttaagtgtacaattcagtaggttccctttgtttttg

SEQ ID NO: 68935 - DNA, 1064 bp, Homo sapiens
aatagccttgttactgtgaaaacgaagttctatttatgattaccacatggtgtttgtttttttcttttttttccaccaaatggagcatcacagtcaatatgcttttaacagtgggagcagagaaggtagtgcttactctagtacaccaacctgatgggtcattagtttcaactggcttcagaagagtgattcttcctctaattagattttattgttgaagttccttcatatggaagatattttccatagtatttggataagctgaactgtgttttaagaactcatatggatgttgaaggttgttttcagtttatctttccagggaacttctgttcagctctgagtgggtctggtcctttttcatgcctgagggagcagatgtgattgcctgtgattgaagccagtggagagttataaactatttttgttctaacatggatgatgcctaaactcttccactcttccacagctgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatggtaagactcttaaatccaaaaaccagtgtgacagcacagtaggagtcttgacccacctatgctaaccagagcacttggaaactaaatttaaagaaagtcaactgggacaaaaggagggaacacagcatacaatgctgtgagaaccctctgttatgataactcaggatcatgggagtaaagcatttaaaattttaagatgaagataaaaatctactaaatgaatttcattaagaaatttccaagattatttaggtttacctggtcattctcagaggggagaaaaatactgacagtaaagatgtttgagacttatgggtggggatggaataagggatgagaatgacaacctgatttaatgttaagttattcccttgtttccctcctttaatgaagcatgcagtttgctagttgaaagagtttttaattagtaag

SEQ ID NO: 68936 - DNA, 1009 bp, Homo sapiens
cttttacaagaaagccacatatgtattttgtgaaggttaatatagttaaactagagaatagaatctataagttcacctcaatggcatattgctgttggcttcagagaatatggagtctcaaggtccagtcctgtagcctagggactcccagtcttccactctgacctggatatgtaggtcttgaggtatggggccatttacagatggactgaatggtggtgccagtgtcagtattaaacagcagtcagcctattcttgctttttaaacttaatttataaagaggagttctcatatatttgttctgggtcggcctaagttgtgcagcattttagagtccagcagcaggagaagggtttgggaagagcagatagttggttggttcctctttcctgatacatgaggaaatcacatgtcacagtgtgcagtggcatgacaggacatgctttgacggtaaaaatctgttaagtggactcactgtttacattgggttcatggcttaactttgaatgccttttacttgtattttttattttgcagtatgaaatcatgaagtcagcaatgtagagctaacaggtgatttagagcttggagatataattcaatgtcattttgagggttaggaaactgaggctcaagttcacagagctagtgaatggaagagcttggactattccagtgtcttctaaatgattttgttaataagtgcagagcgttgacctgcttggttcctcccacccaccttctagaacacatccttcaaagaagattgtattgacagttaaatgaagaaaattagaattcatttctagttgccaacatattccctggttgttactttaaggctttgatgtatatctgtgttcagatgttccaagaaaccaactctaacttggtaaagctgttgtttactcttagtttctttttgctttttcaggaaacctaaagatttttcatgatgatggtgtattctgggtcactttctcttgcatagctatcctcattccagta

SEQ ID NO: 68937 - DNA, 1823 bp, Homo sapiens
tgattgatcattctaaacaggataggatgaattaaaagaagatataaaagttatattttgctttgggacagtttgggtttcttttaccttttacattttatttctgcttacaaaactattaaaatttaatgtgtaatttcgtatcacatacacgtgacaaagtgctattcttattttaagcagaaaacataaatatattaaaatgagctatgaaatgaacaaataacaatttaacaatggaaactgacctatatacaagaaagtgtatcctgtagttggtactttaatattgtatctgtttaataataattactcccatggctgctgaatttcttctgccttttagattttttttttcttctgaatgctgtaacatgtaaattccaggagcttaagcatgtatttgtagattaaatatttaaattgcactgtaaaaagggtgcttaaccatagcttttgttgttttgcttttttcctttcctggtggtttgccacttagaattattcttcataggctttatcatcatgggattcttcttttatatactgattacaagactgacacctatcaagtatgatggtaagtgaaaattatatagtttaactgggtattcaagaaggcaggtgctgtgttttacttcacctttccttctacagtttggcctatattgtgtgtgacagcctattacttatgtaaaataatggtccatctagtctctgaacaccttttctgaactactcattcagaccttctgggtttttaatctgtatggtgaattccttggtacttagggaaaggaggggccatattgattatagacctgtgttctggctatgtgatatgttgaagatatgagatgtacaacaagcaaaatgttgaggttttctttacctgaaaacagatacctccctaccccattatgtttaacagaatgcttgtcaacttttccttctcaatcccaatttattgacaagccaagcctgtcactggccctgtgaggtttagctccctagctaatttccttgtctcagcccagacccctccctagagagggttgctctatgctggcttcatggcaccactgaagagccctcagtgcctgacctacagaaagctgaagctggcactggtaacggtattgtatgtctaaggcacgcggttggaagtactgccggttatccagcagttcatcctctctctttgtacagtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggtaggcgatatgtaacagatgttttgtgtgttcgagtgactgtttgaatactgcctaattggatttgcatcctggagtggtgttgcatgtcagtgcttctcctgtggagttctggaaatctgcattgatggtgtgacactttcagacagcaccaggactagtaaaagtccctccttcctcaaaggcacagtagatgaaatatagaatgtctttagaggtagctttgtatctatttgttgtgataagtggtatgtgtttattagaaataatggaggtaaaggaaataaggaggtaaaggctctgatggcagctgagtcggggaacctggtactttgtttctggtcttctgttgtaccctcaacctccactcccatccgctgccaaaccccaggtgtccctcaggtacttaatcaccctggggcagtagcacagggctggttctggggtttttttggtgtttt

SEQ ID NO: 68938 - DNA, 1422 bp, Homo sapiens
tttaaattgtgagtttcggtttaaattttttattgtgaaaaacttcagcgagcctccatacaccaattatccagccttaacaattttgatttatggccattatcttgtttcagctgtgctgtacctgcttctctgcctctccacctcatcaccctcctttatcactggattattttaaagcaaatccctggtcatcatgttactcacaaatatttcagtatgtataccttaaagataagcacttaaaaaatagaaccaccgtgtcattaacataattttcattttaaaatattgaaaatatttctttaatagcatcaaattaacagccagagtttgcttctggagtcatctcaattgttttccacagtttgtttgaatcaggttgcagatgagatctatacacagtatttagttgatgtgtcttttaaatctcttttaacctgtattctccctccacccacccccaccacctcccccccactccctgccaccttttgtccatgcagtttatttgttgaagaaacaggattatttgttttaggaacactctctctctgtttctctccactttacccaggaatatgtcataggaagtgttccataccgctatcagcaagcatatattgtctggattctctttttgttatagcagcagttgttgatattgattgtctacataggttcattcattaggggtggcaagagtattttaaagataaatttgtaatatacatgtatgggataaattatgtcagttcacttagcttttttgatgaaggttcgttctataaatattaatacaaagtatcaaattggatgtattatccactaaattttcattattttttaggaagagtgtcttccaaagtgttcttcactctttttgccctgcttggtttcttcatttgtttctttggacacagattctggaaaacaggtattatgtccaatgtagttgctatttccattttgcagtcttttcagtgttgctggggaatgacctgtgaggagagtaagcacttacttatctctactatcttcatagatttgtagctggggtcttgtagtcgtgagtctactgagttgcaatgcatttttatttttttctattctccctacagcggagtataaccttctcttattaacaggggaatacaattatgcagtgaattttatcagctgctagatctgttagttgactaaagataaccgagattagacattggttgtcagggccgggctcagtggctcatgcctgtaatcccagcactttgggaagctgaggtgagaggactgtgtgaggccaggagtttgaaacaagtctaggcaacatagtgagatcccttctctaccaaaaaattaaagacaaattggggctgtgtgtggtggctcacacctgtaatcccagcactttgggaggct

SEQ ID NO: 68939 - DNA, 1148 bp, Homo sapiens
acaagagaaatacagttcccatccttgtttatagtctagcagaggtgaaaaaacttttttcatggtcgtaactagcatttatacattgtttatatcgcattttccttaaactattaaaaaaaacctttggaagcattttgtgtgagagcttgtttacattagcacatacaaaccatgtaagatggccttttgaccatattaaatgggttggtgtatattttaagcaagaattataatttatgaatataccatttaatattacacgtaggtgggattatcacagaatagcttaaaaaaatcccctaaacactaatcatgtgttatttttggcttcaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggtgagtatgtggctttaaacttttacaaattctcctttggccttgcagataatgcttttgtctagttctcattcattcaacacataccttttgagcccctacgttattccactctctgttctaggcactgggacatagcagtaaacaaaacagcaaaaatacttgttctggagcttatattatagtgagggagatgagacagacaagataaatttataaaatatgtaatacgtgagaaaatggtgagtgctaagaagataaataaagtaggaaagggagataacacatgccagtaagaggaaaatttgagatagatagcatggccagggcagtccttgatgcaccacgcacgtacctgggtgtggcatgtaccaggcagagggagcagccaggatgagggcctgcacctgggagcctgtctgagggtgtgaagaactgcagtgatgacaggggttgcaggagaacgaggagggcaaaggaagtagaggtgaggtgagaggtgcaggggcaggcagcctgtgtgtggccttgtagactgtagtatgggattttgcttctattctgaatgaaagggaaaggcattggaaggttttgagcaaatggtgccatgatctaagatattttaatgagatca

SEQ ID NO: 68940 - DNA, 1223 bp, Homo sapiens
ggattacaggcataagccactgcacccagcttttttttaaaaaaaatttttttgcctccccagagctgtagtattttactctaggcctgactgatatcagaatccagttatgtaatcacctttgcctgttggtgtttgtcttagtttgtggtgctgtaacaaagtagcacagactgggtggcttataaacttctttctcatggttctagagggtagaagtccacgatcaggatgccagcacagttgagttctggtgaaggttctcgtccaggttacagactgctgggttgtcattgtgtccacacatgacagaaagaaggctagagggctctctgggatctcctttatgagggcagtaattcgattcattagggcttcaccttcatgacctaattaccttccaaaggtcccacctcctaatatcatcacactgggagtgagggtctcagcatattaattttggggagacacaaacattcagtccataacagtgcattacttttcttcagaataccaattgttgccactgcaaaaggtgaactgttaaattgtaattattgttgcaagtgtttgaaattagggctcttggttcctttttatagatgggacttgcaccacaagagactgatgtttcattttgttggttgactttagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtaaatctgagtcccatgatttgtgtggctggattgtgacacctttgtcagagttgagaaggggagaagctaccaggatcttatttctttactcttttctcctttttgggggacactcactttattctcttttgttatcatcttgggagtctttgctggtgatatctcaaaatgatgttggcctttgaggagatgcatgtaaattatgttacgttttagttgcagccacatctgtgacttggtaatctgaaatgtgaatggaaggaggtggtaattttctgtgtactcccacgactactgggtaaacatttttggcaagtatgaagattacattgttttgagaaaaaaataatgagaaactgcttaaggatatacacattggcattcatatttgaac

SEQ ID NO: 68941 - DNA, 1060 bp, Homo sapiens
gggagcccttggagaagcagtaatagttaaggcaagacatagtccttaacagtttagttgttctaagcagaagcagtaagctcgacgtcatgaagaaaaatgatttggagaatggcacgttgtgagtgtggctgcagctggagtgtggagggccttgcatacaatttgaggtttgtactttatttcgaggtaggttctaaggaggcatagagtttttaagcagaggaatggtgtagtccatttcatctcttagaaagctaactctagaagtagtgtggggatggattggagagggcgcagcagagtcaggactcagcacaaaatgagaaatgaggatctgaacagaggccatgagaggcgggatggagaagaggagcaggatttgagatatccagaaggtggaattgatacaacacaatgactggtggttatggagtataagagggaagcataggtttcctatttgggcagcagggaaatagtgatacaaaataggtgtaggaacagggttatggtggtgctggatgttttgggaggtgggacggagtaggtgatgacttcagtttgggacacagtctgagatgcttgtaggacatttggatggaaatgcagagtacataatttaaataagggcctggagtggaggggtgagattagattcccaactaaatagctgttaataaaagctgtggcagtgagtgagattatccaggcatgtacttggatatttagggcaaaaaaatcatagcaaatactttactagtgcctactatgtgtcaggcactgtttctggtggataataactcctgaggaataagcacaacactgtggagtagtcaagaaggtaggaagaaagcctggagtttctgcctttaaaagggagcaggccgggcacggtggctcacacctgtaatcccagcactttgggaggccgaagcaggttgcaggtataatttatataatcgggagtttgagactagcctggccaacatggcgaaactctatctctactaaaaatacaaaaattagtcaggtgtggtggcaggtgcctacaatccca

SEQ ID NO: 68942 - DNA, 1032 bp, Homo sapiens
ggccttataaaagggaccccagatatgtttcttgccctttctctgtcatgtgaggatacaacaagaagttgggagtcttcagcctataagacagctttcatcagaacccgactgtgttggcaccgctatcatgaaccaccagactctagaattgcgaaaataaatttctgttgtttataaccaccttacctgtggtactttgttatagcagccttaactaagacaatcgtatatttttcaagaatgctttttccatgtatatgtgtgggcatgtgaacatagagatgaaaagaattccctggttatttaaggaaggttttttttttctatttgttttgggaagatttggaataggacatgcacactggatcagctcagtaatttatgttttggtcgacttcctattcatgacaatgtttcttctggactgcagactctcctttccaattcctcggaaacaggcactgccagtggactggttttcatccttagaccagagcagagtacatgcacttggtacttggggacttcaggcatacagcctgtccagaatatggctatcctactctcctactcagaaagaggtaacccttctgtcttctcctccctcttactctttggaatatggaatgtgttcatgaaactttaaggaaaattatcctattgagattgtttgttgcaagtataatttatataatcggattttttttttttgagatggagtctcgcactgtcacccaggctggagtgtagtggcgcgatctcggctcactgcaacctctgcctcccgggttcaagcgattctcctgcctcagcctcccaagtagctgggattacaggcgcccgccaccaggcccagctaattttttgtatttttagtagagatggcgtttcaccatgttggccaggctggtctcgaactcctgaccttgtgattcgcccgcctcagcctcccaaagtgctgggattgcaggcatgagccactgcgcccagcctataatcagaaatattttatagtaagagaattagcac

SEQ ID NO: 68943 - DNA, 1027 bp, Homo sapiens
cgtgcctaaaatcacacagctggtaaacaccggtattaaattgcagccacctgtgtctcttcgggctacgctgacttcagaattcactagacggttatggttctttaacaccagcacattcatgattgttagtagccccacaggattgtcatctttaaattcagggactctgttccagagatcattgttattgctgctaccagaggggaagtttctctgggttccaggagcctgtcttcagcataccttttgaaatacctcttgcattttagttctgagctctaccattcactggctggatgaccctggatgggctgcatcactttttaagccacattgtctttagcagtgaaataggagcaataaccatatttacctcaaggagtttttctgaggattaaattccacattcatttatgaatatgatttctgcaaattgatatgagagtacaagtgttgtaatgaaaagtttatctcgttgtaggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccggtaagtgcaaagaattattttagtaaaaatcatttctatattttgggggtctggtatttagtatgagcattagaatttgatatctctatctcttttatgtttatgatcttatgtcttaaattttaaaaaatcaagataggatgttttcaagttagtgactgagagtatctcaggcctttcttgagtgtggcagtctctgacctaaaaaggggtaatggagagctgagctggggagaagggcaccctgtgacaaatgtcaccactatgcaggcaagttttcttcgtgaattcccaccttttcattttcttactttagtggggccttaataacttttacctgagaatatatgtttaatgggttttcattgttgtttagctatagtattga

SEQ ID NO: 68944 - DNA, 1036 bp, Homo sapiens
ttgcttataatagggcactaacattcactctgtatagtgtgtgccaggtgctttccacgtgcagtgttatttaatccccaccaccctacaatgtaatgatcttcctcccttgtcagaggaacaaatgaacagctgctagggttacagataggacttgaacccaggtgagtctccctgcaaatttcatagtccttccacttccgtaaagctgtcttccaataagaatatcttacatggcatggtgctttgtacttaatccttctgtgaatcctcattcttcaaaatagccttatgatggaggtagaagagatgctatctctattttaacaggtgaagaatttgagatattagagtttttagttgatcgaggccagcccctgagtcaggagagcaggcgtccagaactttttctttctacttggtgttagtatttaatacctagaaatttttatacaaaagttaaaaaatatgaataaattgagaaattaatttttttcagacactgctttttgcctctttgctatgattatagcactgatattcctcaatgttattctttttgccttgcattggtattgtcattctgtgcagaagagggacaatgtggggacttaactgctgagtgataataaaagctgatattctccacatctatcagctaaaaatcagtatagaaaggtagaaggacatagttcaggacttgcataatcctcctagaaaatggctggattgatgtttgatgatgataattctgataaccatacaaactgaagaaattgagcatctgctgtaatttaggaggatttacccatctttggcaggatgagctaacttgcatgacttctgtagtggcctgaatgctaaataaatcttggaacgtggcagatggagttcctagaatgtctgaggagggtgctttctgtgaccagtaggcacatgagatggatcatacttttaagcagttttcccttctcttggagtcccagttcactgctgcctttaacatctttcatttgtttagattcatatccagtaa

SEQ ID NO: 68945 - DNA, 1070 bp, Homo sapiens
gcagcaatggggttcctgcagctgctggtcgtagcggtgctggcatccgaacaccgggtggctggtgcagccgaggtcttcgggaattccagcgagggtaaggtcggggcgcctggcttctgcaacccaaagttgcttttgcatttcttgcgaggtcaaaatccgccaggggtctgtcagcctagcagggagatggtgctgggggcgttggtacacgctgggtggtgagtccagaaccggcacgaatggtgtttcctgcagcggaaacactcatggctaaggaggtcttactattaacctcctcatttagcggaggaaatgggaagagataaataattctctttttttaacacagtattatctcccttagggagcagccatgtttgtggctttaattcaacttactaaagcgcctctttgctgcccagtggactgtctgagcttctggacagcaagacttggggtggaactagcggcttaatgactgatggctctcaagctgcatggaatttttacacccccaaatctagaggcttttcaaactggttatgttctacagagtttgagagggaaaatgaacccataatgaggctttatttttaaagagcctttaccatctaatttattaataccatctggagacaggaaaacattccatactcacaatgagaaataaaggactttctgaattacagatacatagacatacagatagaatgtgtataccctcaattctacaagttcagccacaaatgaaaaataaacacagaaacacaaaagcttgccagtccaggtatcagagttgttctccttacttgagggcaagaaatttctaatcgatttgaccttaaaaaagacaaatggacaaaaactgtgttctctgttgtctcatatccaacaggaaatagatctctatgagatattaattcgtttacagagatcacaaaattcccaatcattgcagctaccaacaggaaataacttgtcatccataaatgaactgtaaaaaataacaatttaatagagagtaaaactaaaatgagaaaaacaagaatcaacgaagttctatt

SEQ ID NO: 68946 - DNA, 1051 bp, Homo sapiens
taaaaatattttcctcctgtgaatctttattttggattttaaacgctctcattggttcaaaaagcaactttcattaagttgctgttactgcttcggctcttggctatttttagatagagttttcactcagctgtggtttgtttacttagctgtaagtaaatataaataatacaacgaattaaggtcaattcatttactctaaaaattgtagggttaaatggctaagcaaaaagaatgagacattatagctccttatccattccgttttgagtagaattagcacagcgttggaatgaccatgtataggaaagatagtactgaggtgatctgctgtatggtattatgctgatgaattagctagggtgtgtatattagtgcaaaagtttaagaactttgccatgcgatttaaatattatgctttgttttccttttgatttcccctcaaggaaggactgggaaagtagctcttttccctcctttatatggtcataataaaggattgcaaattaattagctgcattcaaggcatcacacagattgaattccatatttgtcttggagggaagtccagacttctgcctggggtgactgaatctgctttgtgagactgggtgcaacttccgtgtattcaagggtgggatcatcttgtcaacagccaaatatcttacaagatgtaagtcacttagaagaaattatccccccaaatgtggtttgtttttaatgtttctttcaaaacctctttcccccaacacacacagtgcagcagagaaaagttgcacctgcctgctacttgacagtagattctgtgatgattgattgtaggcattgttttctgtgtgggttgggaacagaaaaatgctctttaaccttttgccaggtctctgataagtactgaaaactttggcagttaaatgtggactgtaaaacacatgaagaaatactggaaaaacaaaaatggactcagattaaaaagctgaaatgcattattttctaaactagttcctttggggccttgattgtgtcagaaatacttactgatttttttcttttt

SEQ ID NO: 68947 - DNA, 1026 bp, Homo sapiens
actttgctgcaggggtagtacagtgtcctggagtggtcactgcactgtggactctcagctagaatgggagcttcacctgaaggttaggtgacatggactaatccaaggttttccaccaaatagctaaatgtctttgggcctcacttccataaaatgagggagatggactagataatatagtctctctcacttaatgacagataagatggtctgtatatcacttaatggtgaccaccttctgtaattgaaattgaattcaagttttgtgattttatcagccttgcctcttgatgaactaaatttgcaatcttagacctgtagtagagtctagaaaattgctaaatagaattgaacttataaactgatttatgggagtgtttgccagtgtgcttacttgaattacaggatatccttgatgacaaccaactatacaatttactttttattccattttaggtatttttcccctctcctagatttgttttcctaataatccggaattgtgttctaaagatcacaagtcaataaaatggtgtggtcctgttcattgcttaggtagtaagctgttcaggtattaatgataaaggtcattaccacataaaaatttccttcctgcctcaaagttttttgtattctggtatcttaatgggatggatgccttctgttttctcatggttgcggaagtcaagtggtctgtgtgtttaacacaatatctgagtctgatgagtcacatggtatgtctgcttttagttgggaacagttttttttggtcagttgtgatggtcaaaaaagtctcttgggagagtttaaatgactcaaaataaccaaacatagctcatagctacttaggtcttaaaattgtgagcttcgtgataccatattttaattttagtcttgtctaatttttgtacccccaaaggactgctgcttctggctcttaagttgttaaaacattagtctgatttctttcagggggtggtttttatttgaaaaggaacagcaaacaaaataacacagcaatttaaa

SEQ ID NO: 68948 - DNA, 1054 bp, Homo sapiens
ttaatgttcctcaaaagttttgtccacctctagccccccaatttggcttcattctgggaaggcctagtctgtagcagaccatctcctacagccactttccagtggacataggtgctctaggcaagatagccatcagccttgtgtgttttagattccaccttatcccaatcccattcaacatttaaattgaataacagttctctttgttttgatgccatgctcgccaagcaatcttctgaacctaatttcttgttactcagtgtcttactgtgtaaatcagtaaactgcattctgtcttgtatatttgtcttttgtgaactttgttaggataaagtgacttccagaatttgattgccctgagacactggcagctgagggccagaccttgccgcttggcagaccgagcagggcagcctgctcgacaaggccccttggcagacagtcagctccctccaaggccaaaccccaagttcaacatacatctttctctcccatttctgcaagcataactgtgaacagcataattctgtgagtcatgtgttatttctttgtgcttttttcaagaggcattataaaaggttttttatgtttttcaccattcactttttgaaaggaatatataaggccttggacaactagagttgggtctttaccttttgttaaggcaaacttgtaaagtggcaaaccactttataaatttttattggctacagatcttctggacattttctctgttcattagtatctgcttgctagaacaaatacaaggcaagtcagaaatcattctacaatcgtagggtgttgctctttaatggtacttttaaggttttcccaccccaaatatttgttgaaaaagtaacaggcagttgtttaccaaaaagcatttgaagagaactatctatgaactgcaattttatatgcctagggaaggttcactggaatactactgcaaattgtacacctgtcctccttttgaggattcaggatgcatgttagcatattaaagatgctgggaaggctaggcaaggtggcttgtacctgtaatcccagcact

SEQ ID NO: 68949 - DNA, 1237 bp, Homo sapiens
acaccttgacagaagaggaaacacagttctacatttcagagactgttctggcaatagatgcgatccaccagttgggtttcatccatcgggatattaagccagacaaccttttattggatgccaaggcatgtgaataaactggtgaattactaggctgttgattattttttagagcagtagggctgattttgtgaatggaaatcagcaactgcaatttagaatattgctaaacaacattatatgataaggtactaggagaggacttgggaattaaatgacaacagggaatatggctctctttttatctccctccattttctacttttaaaaatcatcatcagatacttaaaattttacattttacgtgtataaatcccaagctaagaatttttattataattgccatttaatagaggagtttataacaaggctttttgttttcaaagttaatatgatctaattttactggatttttttttagggtcatgtaaaattatctgattttggtttatgtacgggattaaagaaagctcacaggactgaattttatagaaatctcacacacaacccaccaagtgacttctgtaagtttggttgttgtttttcttctttcccctggttaagatactgtagagaacagaaggttctttccctttccccactccttaatccactgtgttttagatgtatatgtattttctttttgtggagagcatttttccctcgtgattacaattccatattgttgaaattagcatttcagaacatgaactcaaagaggaaagcagaaacttggaagaagaacaggagacaactggtgagtcaaccagtttttaagagaattttatgccttggttctaaaatcttacctggttttaacttgattatttttatctttataataattagtatttacttcataacaatggtagcgcttgctctgggatcacacagttttcttagtttctctgttaagtttccttgcctgtaaagcaaagtgttggtttttactttgtaactttagagtagtttactgagcatacctacaagtaagctgtttactagtaattagcactttaaataaaactcactgaggtgaatgcaattgtaatgaatgccttgtgatttccatttttccatttttcataactgtgttacaaatcctgatacaacaaatatcaatcagcaagtaaggtggttgtgagtttctaaaaacttctttatagacaaagtaaac

SEQ ID NO: 68950 - DNA, 1035 bp, Homo sapiens
ttcctaaaggataagcagtaccctggaattacatttataatgaaaatacctcatgcttatttttgtagtttgtagtttacaaaacacatgccgtttattgtttcatcttcatatcaactctattagggcaggtattattattctagttttatgtaagcagaagctgagcctcagagaaattgaataatttgcccaagaacacattagtagtgagtggggaagccaggtcttctaggttcaactttttcattctttttgaaatagactgaaggctatatatataaataacttaactgagcttcttgtgggggcagaaatgatatattcttataaaatgcctggcacatatggacactctataaatatttgttcaactaagtgatgaaaggaaaactaattcagcattccctcaggaaagtaaatagactgaaaaatagtagtctataacatattatctgactcactacctaccactaagccttgcacatgataaacatgcaaaataaatacaagtgaaaatttaactcctctatatattgctttttccagtagtaagccatcctcagatagatattttttaaatgttaagaatgctggtttgacgagttgctcctttgtaggcatattccacagttgggacaccagattacattgctccagaagtattcatgcagactggttacaacaaattgtgtgactggtggtctttgggagtgattatgtatgaaatgctaataggtatgttttatcattcatttatgtacaaaatatatacatttccttgagtgccattgtttgaacatattacagatatcattgactaaaatatttgaagtcttttaagcttaattctgatgttcccccaatgttaaatacatactgatcaataccagtgagctccccacggatcctgtttcaggaaggtgggtatttaacccaaactcccacgtataaaagtggttatctacatagcttttcaggtaaaaggggaggcagtgctttcaatcctttattttattgactttattagcaacg

SEQ ID NO: 68951 - DNA, 1080 bp, Homo sapiens
aaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtattcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttggg

SEQ ID NO: 68952 - DNA, 1001 bp, Homo sapiens
ggggttcgcgtgggttagtttcgtttctgatctggaatctcagtaactacaacaagaaaagtttaaaactcgacccgccaggttcttccccatcggattatctccgttccttagagatagcaggaagggcagcattttcttccatccacccacttccagccctagtctggctcagcgaggaatgcataaaattagtggactcctctgagtgacgttccccggctccaatcagcgggcgcgcaggcgcccccggccccgccccactgctgactctctttggctgattcctgcagggagggaggagagaagggcggcagtgggagggggaggtacctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccaggtaagggcgttttgctccactcccagacgggagggaagtggcaccgttgtgtggctgcagctggctgttgcagctgctcctcctcttccccgggtcgatttccttgtgcaactcactcctgtttcccaatgggaacgggcactttttgggggtggtgggggtggaggggtagggcttaactcctggggcttggaccgagcttgtacgtgaagaatactccaggattggacgtttaggtcttgtctgtatccttagacccccacaccctaggctcccggtaatacctgagaaccccaaccagaggggcgtgtgtgtctctctgtctgtgtgtattgaggcatttaaaaatgccacaaaaaattatggatcatcgactcaaaaattatgctcgttgaaaagaaaaaaaaagttttgtatttttttgtctccttgtggcctattatatattaaaagaatatcaatgtt

SEQ ID NO: 68953 - DNA, 1056 bp, Homo sapiens
aaaagaatgagttcatgtcctttcagggacatggatgaagctggaaaccatcattctcagcaaactaacacaggaacagaaaaccaaacaccacatgttctcactcataagtggaagttgaacaatgagaacatatgggcacagggaggggaacatcacacattggggcctgttggaggggtggggggcaaagggagggatagcattaggagaaatacctaatgtagatgacgggttgatgggtgcagcaaatcaccatggcacatgtatgcctatgtaacaatcctgcacgttctgcacgtgtatcccagaacttaagtataataagaaaaaaaataagcctagtgatcctgagataacaatccagttgggtagcctcatgctgatcccttcaaatcactttgtcaccagccctttgaaacagagccaggatagtacatatgagaacccagcaagtttcaccagggatttcttgttgctggctggttggctcagggagtaaatagagtaattagtgctcattagcactcccacgagctataatgcatctacctgaggcagagagatgcttgcctgtgttcctgaagcatagaaatctccatgtgatctcttcagtccagacatttttgcactgcagaaacaaatgccaacttggcaagagtaaaatcctccaagtgcctcaaataacagtaggcaaaacccgtggactagggacagaaggctttcctaggaacggttagtgtgtctaagaaattggtgtgctgtttaaagctttctcttctcccccaaccggccgcctctcagtgtatgcgactgaggtgaaccagattagtcagagatgttggacacggtagtcgtataacttgatcccctcagcctcttgtcagctgtacttcagaagctatagtctccattaatggagggtctggattgtagagtcattgagaaagaagagagagcaacctttgacggtgatctgcggccctgtccaggaccttgtgccattgatagttcttgttcctgtgaaatattaatctgtggtatgaaggtgggagt

SEQ ID NO: 68954 - DNA, 1661 bp, Homo sapiens
aagcaagtgagtgaggcacacaaactcagacttagaaccttccagggggccctggggatggaaggcaaatataggaggttatagctttggttcctgaatcaccttatgtgatattttagtcatagtcgaggataatgatttaggagttaaattgccaaaggataagtcaatatgctttggcgggggtagggaagaatcaattttctggcatttccgaaagccagttgcactgaacaaatgtctaaaactggcatggtttgttgtataagtgggatgagtagacaaagccaaagttatacctaatctctttcccaactgcagattaagtcatatctgtaaaaggcaacatggtttttcttctgcattttctgccttctagtaagtgaaggaggcaatgggttgtgctcctccatcatctgagtagtttgagtgtattttggggactggaggtggggaagcctgatgacttcgtcgtggcatagagcaaaggtgatcgggggtgtgtgttcagaccatggacttcgcttcccagtgagccccctggactctgtgtattctttgcctttatctgcattgccacctggaagctccgtaatgtcaagtcctggaagatattactaacctgtttccattatgggtgtagtagaaatataagtaggtcactgttcctaattcagaaactgaagagagtcaagctgccatggtgacaggttctgtataaaaacacccacctctgaacctcttggagagatgtgatgatttggtcattggatgtgaaggggataatctgccagctggtttattgcattggctagaaataggagatgcagaaactaaaaagctctcaagaagtcatcagatgagaaggaaattaatgtagcatagtgattctgctgtagaggaaaggctaaaggtgagactcttgaatatgtgcaccatttcttctgcagctcttgacttggatgatccttctcagtgtgatcccacgagtgtttggtgatgatctgatagtagaaagggcagagcgatttaactttgtgcacatcttcctctgacttctccatctttctaacatgcctgtacgtgtgcctttatcattggcattctggagttagggacatgaccttttctacagtccggatgaggaatctccaactatgacttttcattgtgactcacgtctgcaaagaatgaataaagaagaatttgttggccaggaagtgtgtactatgcagagagaaataattgttgttgggaaagaaacttttgaagaaccagaattaaaaaaaaaaaaaaaagaagaatgaaggaagtctatcaagaaaaggaagaaccagaagtgatctgcagggtgttgcctggagatatgggaaataaatcaagaacagagaaatgggaaaagataaaataaaaaacattgccggttaggaccagctggggtcctaggaaagtggcagttccagcggggcttggaaagctactgaaccactcacttatgcacacacaactgccccgccctctccccttctttggcccccattcacctggtgtaggagggtctgacaccctcaccagggagagtgctatttggctgttttgaaggcgagaccttgaagcgtgggagagcttcgcctctttcgtaagctgatgttgcgtaacct

SEQ ID NO: 68955 - DNA, 1009 bp, Homo sapiens
aaaacctaattatagttatacctcttggcataattataagctcctctccttccagacacaaaaattaaatggtgaaatttttatgtacatacatagcaccaatgtggaataaaccctgctatttctctacatgaaaaataaatgtaattggggtaagttgacattttctagagaggacatataggctaggagatgctgaagctgtttctttctcccctcagaaacaaaacactgtaattgtgatttgaattagaatgtaccatgccagggactgaggctttctttaatgataaaatacaatctacgtaatgttcttctgtggagagaatttgtgttgacaggtaagtattacacatggacaactttactcaaatgtttttaaaatgtacacccagaagttttgtctttgtgtaaaatatattactgctttttcgtctttgaaatgccaaggttttcccctgtgttcccagatagcagtcagtaatcctgcactttaaattcaaattattggctggcttagatcctgactaaaaatttgggaggaataaaggatcatggatttgcctgaggaaagatgagttcacaaaacctcaggaatgaattaaatgcaaaatgagtctgtttctttcggtggtttggatttggggttctttgtagcaaaacctcaaggattctatcagtttggattttggaaattaaattagatgggactagtattgtctttgagagagacttgttgaggacagactgaagaggaaaagctcaggtgaacacatgatttgcatccagtacatgttgtaaattattggcatattttggctgttcctcaaagcaggactggctgcatctgtgcttagaggtaaaactaatagaggaccacattttggttcttcctgtgagctcagtactgtgtgagtgagttacttacatcaacacagccatacgagttgagtattattattacttctgttttaagatgagtagatagaggttgagagggcttgggtaa

SEQ ID NO: 68956 - DNA, 1405 bp, Homo sapiens
aagggatttagaaaataagcaatagtaacaaatgtgttttttatctcaaagagatccatagaaatcacttatttaacagttggagaattatcttggaatttgagacctgaggttgtgggcaggatgttaagagtttgtttgattaaatggacccaaatatagactggtttcttttttgcttctctatgtatgggataggtttgtgagtcaaataacaagctatttgtatttatgcttgtcatttcactaagggtttttcttctagaaatgctgtttgcatgggtttggatttttttatggcttacttttcagttcgataatgtgttcttgttttcaaattaaacttgtcattgagattttttgcgagtggctatgttggttagttagtatttatagcttaagtctgtttctgaggaaatgactaaagtctcttcatttgatcaaaactgtagaacaaagaacatctttgacttacttaaacaagtcctatgatgaaaactcaaaaaatataatggttcatgtttataaatgtttttgtgtattcagtcctggttaggccaaataatcagagctctgtgctgagggagggattgaatatactcagtgcctgttagttaatgtgaatttctctggagcacattcaggcaatacttattttctcataatcctcctcccatctctgccccatcccccaccgctttttttttcatttaacatattgttttgaattggattttatagaacataggtttttgtcttcttcttctttttaaactattctactaattttctcctttcttattcctagccaagagccctgatccaggtgaagcgtgtaaaccttgcacatggaattcccagcaaagaggctggtggggatcgggacagggcctgggaagtgactgacttgcagaaacccgccatgtcttgttctctgctggagacctttgcttatccatcttgtgaacatctgcagcctccccctgcagcctaatcttgccctcttactgttgactcagtcctcatggaagtgtaggtgcccttccttctgctcattacgttccagagcaggagatgagggggctaagtagggaagaagagaaggcccagctcctgtctgctcagacccggactgacctctgccctggggctcaggctgggacttgtattttaccataaaggccctatgacaggtggcggttggattttggtgttagatcagctgtgttgtggactgactgggattttctgcactagattttaatctaattattctttggtaacattgattgtttcagctctttcataaacagctcaaggcaccacttctccaactaaatcttgtgtctaagtctgaaacagatgaaagtgaaatcgctgtgcccatggctgcacatccactcac

SEQ ID NO: 68957 - DNA, 1020 bp, Homo sapiens
gtatgtatttctacatattttatacaacttgttcctgttggacaacaaaataataaattgtggacatttcccatttttttttaccttaacgacaaaatattgcaaaaccgtggttcattcatttactcaacaaacattcatagagtacctaccatgtgctactactactttgtgctataaaaattaatgatggtggcttcagcagaaaaattagtcatcagggaatatttgaggttgtccagtaactgaggaaggaagggagagaagggtggagtgctggacggggaagaaggaagaaggaggataggagagaaaggatgaatggaaggaagtccttaacacgttttgttgtttttaattacactcatgttatctagtttaatattctttatataatcagccatttgccacttttattttttctgatgtgctataattttaacttgtcgtttttgtatttgtttcttttcagtataaaagaacgtgtggatcactttgctgagtacatccaagatttgaagaactgaaataaatcagctttaaacctgctttttaaaaatgtaagtgaactcacttctggccatggttcatttcagactctctaaaacctgcaatttcctctcagtgtgtgtgaatttttttccaggagtaaagttacttgactctagtgagtctactcattaagtctaggagtgtttgtatctgctcgcccttttaaaacctgtaaattctaagagtagtatgaataacataggtggctgtaggatttagacgcggtgtggcaggcagtgagcaaatcttcatttggcactgagaaggaagacacagacttggtagaacataaaataaaaagcacagccctcttctcgagtccttcatcactcttcacctcacagaccatttcactaccttatctacaccagcgagaattgctagttgacccattaatgacccagtaggcttagaatatgaggtattggtttctcacaggcatatttacccactttctccctatttctc

SEQ ID NO: 68958 - DNA, 1054 bp, Homo sapiens
ttccatcaaaaatcacaaatagcaattggttgtcatgtttctttcatctcttttatgaactctcttgtctccctgtcttttttgtgtttccttattttgtgtttcatgatgttaacatgttttaaaagtcaaagacagttgtgtggtaaaatatcgtatagtctagattcatctaactgttggtgtcctcataattagattcaaattaaacattgctagcaagtgtacattgcttctcttcagaaggtgcatgatattagctaggctgagtttaatcacttggctaagttggtgttgaccagacctttccattgtaaaggtgcctaatcctcttgataactaagaatgcacctgtggggtaatcttagagagcatgtgcatgtttttttccctgacagtgattcacccaatggttttagcatctattttatgattcatctattatgaatcaattattaagttgctggttgcaatatggtactaacttgatctctaaagtcattttactgaagaaaaattctcctttccatcccatgtcctgcttggggaaaatcttggcccaaaagacgcatgacagaaggatcgatgaaagtgaaacttgaaaacaactatccaaacacacattaactatgaagatgtttgaagggttttcttttcctttctgagtgggtatgcaggaaacctgtaccctagggtgagagctctttattttaaagatttgtacttaaaataatctttattgctgcaggtgaggaaaaactaaataaattgctatttattttcttttggactgagagaattcagtagcaatgagatgaattttctttcagtgccacaatctgaaaagctgtgatgtttaccataccatttgaaaatgtcttagaagtagttccttataaagcatattatattgaaatcaaatgggcattaaagccatggaattcctttgaaaggtggaataaagcggaaattgttttgtcttggtacttcttgatctagactaataatcctttgggggaatttatcctgaggctttttaccaattgtgctcatg

SEQ ID NO: 68959 - DNA, 1125 bp, Homo sapiens
tgcctatatagcgctgtagctgggtttttcaggccagctgcactttgaaaagttctggatgctgaaagtattggaaaggttgggtccttctgagggccaggagggaaggatctgttccaggcttctccccttggcttgtacatggctgtcttcttttgcattcacatcatcttgaattttgggcacatatttctgtgtccaaatttcccctttttataaggattccagtcatactggaattagggcccatccgaataatcttgtttaaattgattataaagaccctatatccaaataaggtcacatgctgaggtcctggggcttaggatttcaacatataaattttgaaaggacataattaaacacatcacatcatccgtagttgaaccgcaacacaaattagcctcagaaatcaagctgtatttattttgtgttttgtttttatttgctttttagctatacttattttgtaattgtctataaactgaaccagtttccataaagtagttgaattttatttctttttcccagatccgacccaccagagggccatggtattggttctgcagtcaacactgtgctctctctctctctctctctctctctctctctcatttgtttcatgagtcattaggccaaaaaatgttaggtaaatgaaagcaaatatgacagcagtaccttgaacaaggggaccacgtctttccccctcaagtccatgacgtgtaacatgtctaatattctagttctgaggattttaaatgtaattcgttgatctgtagtgtgctttcactggacaccttgctttagttaaaccattcttgcatatccttcattttccacattagccttgtttagttgtgcagttttgacattcatagctctccagtgctttggactgaatgtttattgcaagaacttgcagctgactttctatcaggtcattctgatgttgtccagggatgccgtcagaggtacaggttcttgaagcaccttttatgctatcttccttttctactctgggcctttcccagtttctgggaggtcaaggtatctgccaagcctctctctctgcagcacactggcatcagtcatacttgtatgctccatctgtactttattggtgtt

SEQ ID NO: 68960 - DNA, 1053 bp, Homo sapiens
cattattccctcttcctttttggaattactgatagaataatcttttaaagtctgataagaaacattgacaatctattctctgaagcttcctacctggaggctttatctgcatgataaaaccttggtctccacaacccctcatcttaacccagacatccctttctattgatagtaagtctttagataataacaactttttcaaccaattgccaatcagaaattcattgaatctacctataatctggaactaaccaacctccctcccccaaattgtgctccctttctggactgaaccaatgtagatcttacatgtatcaattgatgcctcacgtctccctaaaatgtataaaagcaagttgtagcctgaccaccttgggcacatgttctcaggatctcctgagggctgtgtcacaggctgttggtcactcatgtttggctcagaataaatctcttcaaaatattttacagaatctgcctcttttcattgccatagacttgatagagaaattttaagagtgggtctttagtccttaaaaagctcgatctagtagagacaacattccaaggacctggttaagtgaggctgcttgccagagatacactttttccttagccaagtataacatctattagagataaccagtggttccatatggtacttggtaacagaggctgagagagaatgggtgtggggagagacaagtgctataggagtacttgatgatgcggtaatcttccttgagtattctgccatgacattcagtttttatatacgagatccaggcacagccgtcactgggtatccacggggagttggtcccacgacctcccacagatatcaaaatccagagatgctcaagtccctgatataaaatggcatcgaatttgcctataacgtaagaatatcctcctgtatactttaaatcatcactagattacttataacacccaatacaatataaatgctaggtaaatctttgttgtgttgtttagggaataatgacaagaaaaagtctgtaaatgtttagtcacagacacatttttttttcaaat

SEQ ID NO: 68961 - DNA, 1080 bp, Homo sapiens
tggcctcccaaagtagtgggattacaggtgtgagtcactgtgcttggccttggatggtgaagttgtaattttctaaggggttttgtccacccaaagaactcaactataactagcagatttctgggtaagcaaagaatgggaagaaatggagctggatattctgagccttttattttggaccataggttcatataattggattattcatgatccttgattcatgacatattatcatcatagtcttagatgcagaggtccatgcatgtccaacttcattcattatttagttcttttttaaagtggaatttttatttctaatttctaacaaccaacttctctttcctaatttttcaaataccaaagttttatttggaaagtgatcctaggaaagacttagagaaataaagaagagaactgataaatcatgcattatcaaacaagttaccactctgagtagatcttaattgtctggataattctgggaaccaatgtagattacatgaatcagaatttgctctttctagggggaaagtgtgctggagtatttaaagctgataactttaaatattaaagggacattaattctctagcattttcagaccaccacatccaatggcagagggctccctgaaatcttggacagttaaaagttgggctggcatgcatggaattacagagggcaccaattacatctgcctcagttagaagctaaacggtattattaattcatctgtttcaaaggcattcccaattaaattagttctaaatgaattttatgctttcaacatttagccaacaatgagtggttccttcccagttaaaataaagaacttaaatgggattgacattgggattctttatgcctgacaagctttaaagaccattgcatagtttgatgagttttggcaaatgtataaacttgtgtaacctatatctcaatcaagatactgaccagaaattccactggtgtctcctttcagtcactcaccattttctgtaagtaattattgctctaccttctatcgtaggttacctgttcttgaatttcatataaaagtatcatacagtacatggtccttt

SEQ ID NO: 68962 - DNA, 1073 bp, Homo sapiens
agagttgaaggactagcccaacagctcctcaggcacctttgggtatattgagttgccccccctgactttgaacacatctatgatctgtgtcatcttcaaagagctcatggaatttgaattccctgggttttgtttttgtttttgttttggacggagtctcgctctgttgccgagacgggagtgcagtggcacaatcttggctcactgcaacctccacctcccggatccaagcgattctcctgcctcagcctcctgagtaactgggattacaggcacatgcccccacagccagctaattttgtatttttagtagagatggggtttcaccgtgttggccaggctggtcttgaactcctgacttcaagtgatctgcccgcctcagcctcccaaagtgctgggattacaggcgtgagccaccgtgcatgctacctctcccccctacccctggccaggttctttttcttattctccttgaagtatcaaatttttgataatttctatttcaaacattaactttgtttcctctcttatactatctccacgctgccccctaaaaagataacttctgtacatgctgtctttcataaatggttgaagtagctttaaccaaaaagtattgtacattcctaatctacacgaattttctccaaattgtataggcctccttaaatcaaatagcaacatataaataggaatgtgagggaccactgtcttcttggtacttctcagatttttttttctttataaccgtatgaatggtaggatcattcctttttttgttccatttagagaaataacgtatgcagtgggacccaaattctttttcactcattgcattattttgctctaaatacaggtaagtgtgttaacagaccaggtggaggctcagggagagaagattcgagatttggagttttgtcttgaagagcacagagagaaggtgaatgccacagaagaaatgctgcagcaggtatgtgcagaggccagaaccaagatgggatttccctgctgaactatgtgagatgctgcatttctatgttgtgtttgctctgatgcagcagtaagtttcttga

SEQ ID NO: 68963 - DNA, 1057 bp, Homo sapiens
agatggaatctctgtctgttgcccaggctggagtgcaatggtgcgatctccgctccctgtaacctccgcctcctgggttcaagtaattctcctgcctcagcctctcaagtagctggggttacaggcacccgccactatgcccggcaaatttttgtatttttagtagagacagggtttcaccatactgtccaggctggttctcaaattcctgacctcaagcgatctgcctgcctcggcctcccaaagtgctgggattacaggcatgagccactgtgcccagcctcaagtgaataattttttaaaagtgtgtagattcagtaattatacttcactatatcctctacttgataggtgctgctttgtgcgatcataaatgaggtaaattcacgtgcctgtttataataaaagacttcttgaatgtatctgttaaattataataggagcttctaagtaggacatccttagaaactcagaagttggatctgatggctgaaatatctaacttgaagttgaaactgacagctgtagagaaggacagattggattatgaagataagttcagagacacagaggtgagtgatacagtctctcctccctctctctctctctctgtcactctgtctttgtctctgacacacatacattcctagggcaaagttgaaattccctggaggtgtgcaaggaaggcagttaattactacgtaccatcatcctacttcattttaagaataatctttcattgcattgactttttatcactagatgctaatggcaatttttatttttagacttttgatatgaagtattaatctttttattaacctttagaaatacttttgactttacgatatttggagcatccgtccatccatactgtttttcttaattttgtaaataatgggcttaaatacatggtttcactagtagttattatttaggcacactgattatttactatgtaattggattttgaaaatctgtatagaaaacatgctaacattctatactcacaaaatcacagacagagcttttttgaggtcttttaatttggcattct

SEQ ID NO: 68964 - DNA, 1071 bp, Homo sapiens
aaattacaaattttttaaaatagccatgtatcattgagaaggttcaaaaggtaaatggctttactaaagaatgtggtatatttaaaatatgaaatagcattctatgaaatagaatagaaatagcactctgtgaaatagcatagagtcatttttaggatagaaatatctgacaaataatagatattacactacctttcttaatcaaaattatactcaccttttattttcataagcccatcactttagggcagacgcattggggatttaaaggaatgttttaaatggaaagatgccttcgttcttaaggaggtacatttatttccatttgtctcatctgattcatacaactttaaccctaggagctggtgacttcttaagatttccaagctgctattttataggtataggtaactgtgttaccactttcctaatgtactttcttgtttcttcttggacaggggctgattcaggagatcaatgatttgaggttaaaagttagtgaaatggacagtgagagacttcagtatgaaaaaaagcttaaatcaaccaaagtaagtttttctcacaggttaacattttcaaacaaatggcatcactattcatctatgcccaataatataaataagatgttttctacttaatgtatgataaagaaggtattttaaaagtaaatgaagatttccccccaagctggaaaccttgaatttaagcaccactgatctgaatttaaaaacaaggcttaactcatccgacagaacataacctgccctttctctgagttgtatctaacctcctttataaactgatactgttttctcggttatttagcttgtctttttctatctgtagttttctttcactcctctgtctctctaccagtctttaatggccaaactttctagcatgaaaatcaaggtgggtcagatgcagtatgaaaagcagcggatggaacaaaaatgggagtcactgaaggtgtagtagacgttgggtgatggggtccatggcctgttgctttctggcttgtgttgttttgctgtgatgatgtttttagtggcatgtgcattcattctg

SEQ ID NO: 68965 - DNA, 1057 bp, Homo sapiens
tatttgagacagggtcttgctatgttgcccaggctggtctcaaactcctgagctcaagcagtcctcccaccttggcctcccaaagtgctgggattacaggcatgagccaccacaccaggccctggagtgacttttcatctttaaaatatataagttttttattattcaagtaacatgcttttgtatttgaatatcaaattttaaggagaatcacattcagcttactttggcctttatgtcttgaaatctatcttaaggtagtattggaaatgaagtttatagatgaagcaaagtacttattatccttacgtatggaactacaaccagcttcttagcatgactactcatgtaaatactacaagccatcaggcacttaccgttcattcatgcctctatcttggttataactatcattttctctgcttttgtcattatatataccattcatggctttcacgcactgctttatagattcctgttttagaaacgttatgtttttattactatagcactgaaatttcatcttcagtgttctcatgaagattctcttgttgctttaagagaggatagctagttctcacacacccttgttttctttctagagtggcaactgttcaggtgaggtagaagatgtccatcttttcagatttttccaaaagagaatatgggtgttaaatgtgccctttttaaagaataaatgaaagaaatcattaacatctttaccttaaaatatttcagtctggagagtaaataacttcttatcactgtcacacatgtgaactgaactgacttctgatttgatgttattttcagacatcgaagtacaaaaaatgaaaaaagctgtggagtccttgatggcagcaaatgaagaaaaggtatccagatgaaatttaaatatacgtgtggatgttttttaacaccattttgaccattccatgcaatttcatgagctatgccattttaaaagaacatgcccagaacactgctaggagtgaggggcaggtgtgcacactcccaggtgggctgtatgcacaggaatagggaggagctgcactgg

SEQ ID NO: 68966 - DNA, 1050 bp, Homo sapiens
aacatttcatccagggcttaaggttgttaggatttattattactagctgggtacagtggcacacgtctataaccttagctactcaggaggctacggcaggagactgcttgagccgaggagttcaagaccattctgggcaacatagcaagacgccgtctcaaaaaaaagaaaaaaaaattactattaacttacttaatggtataccgtcttattcacaatattcagtgtcttattcagaaccaagttaaaaagtttccttcctccagaatgatttccttgattagtactccttctatatagatgtttatattctgaaatcattttatacagttctgaacactgattatgagattttgtcaatagaccgtttaattttcttatgtttatttaaattactctgtggcttgtgttttgttttgattgattgattgattttttgtaattacattacagttccatactaccatcttgcaagtttccatcccttcattattgccagcaactgtaagcatggaaacttctgaaaaatcaaagttgactcctaagccagagacttcatttgaagaaaagtatgtcatttattaacagtgcaatataaatgttcaaaaaagtagatcagccaaagacaaggatgtattgcatttatttacagacacaatttttacctagagaagcaagaaactgcaagatgtccactgggggatctgtaatcagttctgtattatggaaataaaaggtgtgaagcaggaaataataagagatcaggctggggaggtagggttgtcaggttagaaagagattttaaggaacttggccaagtgtggtggctcacgcctgtaatctcagcactttggaaggccaaggtgggcagatcacttgaggccaggagtttgagaccagcctggccaacatggcgaaatcccgtctttactgaaaatacaaaaattagctgagtatggtggcacacgcctgtaatcccagctactcagaggctgaggcacaggaatcacataagcccaggaagcggaggctgaagtgagccgagatcac

SEQ ID NO: 68967 - DNA, 1002 bp, Homo sapiens
aaattactgaataaatcaatgtagctataataattgggtgggggtgaaggtggggagctgtaagtttacaaagaaataatttctgatttgctattatctcatgccagggttttgcagatctcatgccggggttttgcaggtctctagccttgcttcatcagttttcatttgaagttcaatgcttttaattcatttttgcactgacatattttgagtccagtgggaaggcatcacagggaatgatgtgatgcttggaaagctgagatgggtttttttgcactttcagttttatgaactgacctaatatctgtgtttatccaagttaaagtctggattaaattaggaaagtctattttcagagcagtactcaaaaatgagatcttttctttctcactattatcttttactttatttggtagttgatacttctggcaatacacctaaatacagaagaaatgccttttgaaagtttgtaaatgtgcatatttatattattctgtttcgtagaggcaaatacattacttctctgtcactctctctaaactggtcacatatctctaccttcaagtttttagtaacaccagctctatataattgaatattaattatgtgaaagagaaagtctctggatgtttatagtgtctctttgccttcactaggatagcaaatgaattattatgggcagcattagggattcctctactatgctttaattagaactataaaatgaattgctttgccagactcagaaatgtgattcccttgtgaattgaaaagtgaaacttccattctttattttaattagaaggattagatataaatagtacgtgagtatttttaaagttcctagtacatgcagaggatgcagcactagtccatggaaaacactgctttattttcgaatattgacatcacaaggctagtcctaagtgcttttccagctcttctaacatgtgcagaacagttagaattattggcaggacagttaatcacccctgcttt

SEQ ID NO: 68968 - DNA, 1133 bp, Homo sapiens
tccatggatgacaaccccttcggcactcgaaaagtcagatcttcctttggccggggcttttttaaaatcaaaagtaacaagagaacagcaagtgcaccaaacttaggtacgtatgaccaaaatgcctttgccctaattcttccacaaggaggaaaagagcagtgtcttcccttcccttactctttcattcattgattcatttctctttctcagaaacgaaggtgaatgacttaggggaatttagcaaaaaatgcctccgtggatttaatttagtgttgtgaagatatatagactctcaccctgctctctcctgtggtataaacttagcggaaagacctaaaatcatgattccctttgacttcatcatggagtttcccatctgttgtgatagtggataaattaacattgacgttgagcctgtgtgtaacatcagaagcactgtgtgccgcatgcctctcctccacggtgtgtatttggcgaggaggagtctgatctgcatttcattttgtcatctctgtgttctctccattgggctgcgtgtgattgtgtgcgttgttgggatatctgaagatcgtaaacgaagtgccagtgcacccaccctaggtattgtacccctgcatgccagccttcaccagcactgtgctccaaaccaatctaatccctgctcttggcatctgtgatctctagaaagcgatctgacagcaatcagaaaatgtagttctctattccggagtgttctttccaccttctgctaaaaaggactctgtagaggctttgcttccaagcctaaatgctgttttaaccaatactagtaacactcactgtgtgaatagctttgagaggacctagacgtgtgcagcatccctcagagtgcagggcaggaatgtcctggcattgtacattgcagctctttcagccttgaagtgcatattaccacacactaactcccaggtccttgcagtccgttctccatgcttacatttcccccagcctccaaaaagaaatttttttggccatatagggaggtttatagaagacattgaatattatagttttaggcttacttctcttaggggaacattcttctgacgttttattactttgaagatggagataatatttagtgatgacag

SEQ ID NO: 68969 - DNA, 1031 bp, Homo sapiens
gggaaaaaagttctcaaaataaaaaagagaaatatggtagttttaagatgaggataagctaggcagcattttcaggggcacctgtagccatcgtggttgaaggatttgaattgggaaagttcctttgggtttttccaaaaggtgctgttaccttgtatagatatccacctatctattcacatggaccagcaaacgggacttctctctctatcgatataaatgtctagaatgaacactggatgcataaaataaactgatctgttcagacaactattttcaaatagtttttttttgcatctttcttagaagaactgttttgttaatgctaagaggtaaatgctgcttattataacctataatcacagctctgctttgtagaaaaatcaactttctgcaactcatagatcttgctgaaacactgttcttgtgattttagtacaacttttactttcttttataaagtataaaatctcacactgaagacaacagtagcccttgtgtttgctagtatgggattgtccactaagggacagctaaaagaactgaaatagttaatgcttggagatctgagagtggcaactgtggatgtgattcttttaaggtaaaatcaacaggcacttactttatgtcaaaagaaaaattaggcatatccagttcattcttctctcagtgcctaggatttaatagattggaatacatttcaaaaataaagaattgcttgaactgggtaactgatttgatgtaaatgccaaaggagaaggagtaaaaggaaaatgacatagagtctgagctagagtaacagggacagtattaattaatattaaccaaatatcaaataagaacatttaagagacgaggccaggcgtggtggctcacgcctgtaatctcagcactttgggaggccgaggtgggtggatcacgaggtcaggagttcaagaccagcctggccaagatggtgaaaccctgtctctactaaaaatacaaaaattagccaggtgtggtggcgggtgcctgtaatcccagctacctgg

SEQ ID NO: 68970 - DNA, 2694 bp, Homo sapiens
ctctaaaaataatagtaatgatgtaatcaaattattcttgccatattttgtttatcacggtgactattcagctatttggcgtgaataagaagaataaggttaatttcctgagattcataacaagggtcatttatcattgcatcatttatatgcctaggatgcccttttgtttttatccatatttaaacatccagctacttttctctctaccatggggtaaataattaaattatacatataggagggagggggcaacgcaaaaaaaaatcacatgttatcaggccttgattatatgaattttatcaaatcctttggatgtttttgtttgcttttcttttaaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcaggtaaatccaacactgtataactttttgcgagttcttccatcattcagacactaaatgggaactttgtatactgtgtctgatcaaggacattttcttcaaataactaaaaatacagataataatagtgaacacttagagatcacttatatcttccaggtaccatcctaagcacttaatgcatactatgtttatggtaaccttaagacatggagagcattgttattctcattttggagataaggaaactgaggcacagagagctaagtaacttgcccaaggtccccaacctgtctctttggctccaaagcctgtcatatttaccaatattttgccatctctgtattaaaacatgttaggaatggacaggttattctacctagccttttcagattaaagtcgtgggaccgcatatttcccctctaatcaacaatgctttgctactattagcaaaggcattagactagctgtgtcagtaaagtgtctcttctaatttttcacttccagttgcagtggtgaaaggagattatcaccagaagtgttctgttgctcttaccccattcagtgctatttgcattatttcttcttagacttttgttcctcctgctgcactttccctgaaattgtgaaaacacttatgtcatgttatggtttgttatttgcagatggaagattcagaagggacagtgagacagataggtgcattctctgaaggcatcaacaatctgacggtgagtttgtgaaatgaattgaaaatgttattctataaatgtcttttataacaaccccaaaggaccacatgtctcttggagaatgtgtagctctgagctcttggctctcagtgtgactccctgtctccttgttttccagcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctct

SEQ ID NO: 68971 - DNA, 3044 bp, Homo sapiens
cagctacttgggaggctgaggcaggagaatcacttgaactccggaggtagaggttgcagtgagccgagatcacaccactgcaatccaatctgggtgatacgccgagactccctctgtttccagtttttagtcttcattaagatgattttggtccctgagcttaccaaaaaaaaaaaaaaaaagattgtttcattgttatgttactaaataccttaaattgtgttagaataatgggatcatgattgatgttgaacaactaacttgacatgataaaattctctttaactactgtgttatcttttacgtacagcggaaagaacacccggaaatgaaaggccaccaagaagaaaggtaaaaagttcgtatactctactatcttaatggtttctggagttctaaaatgaggcagatattcattataaggcagaagggtgttaccagagaagacttcacaaggtcatgtttactgggtgattgccatagccctggcagaggttagtctttgttttttgtcagtacccagagaatagatgatctttgagaggttgacttactgaggaactcccaggaaacaggtgtataaaccagaatatggaacaatttctaatgctatcttaagtcctgcagcctgggacttatgcattaatataactagtttgtttatttatttattattatttatttgagatagagtttcccacttgttgcccagctggagtgcagtggtgcagtcttggctcactggtacctctgcctcccgggttcaagtggttctcctgcctcagcctcccaagtagctgggactacaggcacacacctccatgcctggctaattttttgtgtttttagtagagagaggttttcaccatgttggtcaggctggtcttgaattcctgacctcaggtgatccacccgcctcagtgctgggattacaggcgtgagctactgcacctggcctcccaaagtgctgggattacaggcatgagccacggcacctggccgtattctaactagttgagtctcaccctgtggacatttggattccttacttctatggaggaatctaaacgataaggtcagttggtgagcaatagtgtcagaacaaagacacattagttggaagttaaatggtatcaaattacaatcattaagagcagtcatttcctcaggactattacctgcttctaggatattgactacactggttttgatattgcgtaggcggggcatggctgaattttgccactataaaccctacttttgtatgtgggccatcccctcgtatttgatgccattaaaaataaatgttaatgtgattgactaagctatcaagtactagtttttctctgggcctaggagacatataatttttcattatatatttattcaatcagtttaaccctaattattttttccttttctttttacttccaagtacttaacgccccctcatgtactactgacttccatcaaagaagttcgaaaaattatttcaaaatgtattgttaattcaccctttcataagcaaaatgtaaaaattttgctaaaagtccagttaaagaaatttttagtgaagaaaatgtgatattaaaggggatccttgccagagggtttgaagaaacagtgcagagatatttaggtagatttagtgttgtttttaaaatttggacagcagcagcattgtgggaggtcagattttacatatgttgcaattttgcttctatttcttgtaattgtagctttttgctttaaaattaaaattctttaagaattaaagaatgtgtttatatttaaaatactaaacgattttatatttcttaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaaggtaagacaaattgctgattcattggctcagacttacatagaaataaatgctgatcttcccccctatttctgctctcttatgcttcaccgttcagtgtatagcagcttagtgtattttaatttaaatgttaaaaataatataataggtttattattatacaacaccagataataataggtgttgtattttgattatcaatggtaaagaatactcaaagaatcctaggcatttaataatgtaattagttggctgggcgcagtggctcacgcctgtaatcctggcactttgggaggccgaggtgggcagatcacttgaggtcaggagttcaagaccaatctggccaacatggtgaaaccccatctctactaaaaacacacaaaaaattagccagacgtggtggtgggcacctgtaatcccagctacttgggaggctgagaaaggagaattgcttgaacccaggaggcggaggttgcagtgagccgagatggcgccactgcactccagcctgggcgatagagtgagactctgtctcaggaaaaaaaaaaagagtaattagtcaatcttgtggcttcccttgtgacctttttctgttgtatctcttctttttggagatgggggtcagtatgttgcccaagctggtcttgaactcctgggctcaagagacatgcctgcctcagcatcccaaagtgctgggattacaggtgtgagccaccacacccagcctatcatatcttttctatattgcatctttccagtggaattaagaaaaatgaaataacctaatttgagattaagaattgggaggtgaaacttccagtttaaaaagaggaatttaaattttttctgtccataaaggtagaatattatttagtattattattatagtctaccaaatttaactttattgcttgaagcaaaataggttaaggcaaatgctttgtttgatagcatgtataattatttatcatgggtgttttaaagaaaatataaatgcttagtctgggaatgcatatcttagatggtttcttaaatacaatgaaagttatacaaaggac

SEQ ID NO: 68972 - DNA, 1011 bp, Homo sapiens
agagtggcattatattttatagtatttaaatgagtgtcttaatctttccttaattatccctttacacttgctgctggcctccggattcagattgcgtcttccgtataactcaaaggcttttcaagtacttcttctcagttttctttcaaagtaggtcagttcagattttatatctaacttgcaaatggaaaatctgaagcatgggaaagttaggtaatttaccaaaactttaataatcagtggcagaagttaaatacaaactaaggtcttccaaagtctcatctattgctctacctatcagatgagtaaaggctaataggagtctattatgtgttttccatttggctgtctttttttagacatataatttaggtaatttaattttaaaactgtaattatcatttgatgattgaaatgacttattcacatttttttttttaagtaaaagaaaaaagagtcagtgcaaacccaagagctcacaaaattccccaaactagtctctcttataaagtgcttggaagtgatgcatcttatagtgcaggatattggagtaagttcatgatgggaatgaaattcagcctcaacaatcttgctctgttcatattttttcaatgttacaatgatgttaattgcaaagatacttctttcccctcaaaacgaccgggtattgattttttaaacagtgttcaaggaatggagtgaactatgtttaatttgttaacatgtttagtcccagatatcagagagtctttgtaatccagagtgacattttgcagactctgattttaaagcctaaatgagagcaaaatattgttcctattataagaaaatcgttagcccaaggaaatgttattggcaaaatagttctcactgccccttagactgtcacctagaagagctcccacatctgcctgtgattatgaccagccttttctgcagttgtgcttttttggaggaagcatggatctgtgcagtctaatatgtttgacccaagaaaccagttacttttag

SEQ ID NO: 68973 - DNA, 1108 bp, Homo sapiens
acaaaaagtagccaggcatggtggtgggcgcctgtagtcccagctactcaggagcctgaggtgggagaatcacctgagactgcaaggtcgaggctgctgtgagctgtgattgtgccactgcactccagcctgggtgacagagtgagacccatctcaaaaaaaaaaaaaaaaaaaaagtgaaatcttgatgtattagggtttagagaatagctgcaaaaagttattttctgtatctgctggaaaacagcatatctttgtaagtacagattgtaaggcagacagattgtaattatgtggatagagtagcgagtggtaacagagcttgacagaccagtgttcacgtgacagagtgtgcagccctcaagcgcaggtgcaggtggctaacagtacagggttaaggggccaaagtgcacagacaaggtgttggccagggcctctccacattttgcaaacttctcttcccttaaaaaggaaggaaaaaaaaaaagaagaaagaaaggaagaaacaaacaaacatttgatatttctcagaattcagaactcatttttttttgttttgttttgtttcagaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtata

SEQ ID NO: 68974 - DNA, 1048 bp, Homo sapiens
tatgatctggtgtgattgaggccaggagtctgtaggttatgaaggacaatatggccttgagtacaaaaaggagagaaagaggcatgtcgtgccctgctggggcacccttatactacttatcattttaatcctagggctgacttatgaatgaactcaaaaggggctagactgagctgaattggtaagtagtagatgaaaagcagtacagataaaaaccaaaattttagatcatgtttagagcatatttcaagaaacataccagtacatttagagactcattcggagttaagaaaaactcagattcctaacaggattgaagaaggaaacattttgaaaacagtagaagctgagaagagatgatcatttgggaacatgtaaaggagcggtagcttagggtggtttatcctgtgtaataatacagtgcagatgaaagcaaagaggaggatgtgtaataaagaatttgaccttactcagaggtctggcctttgcccttggcttctgggaggtaatctatatcgtacctgataggactgtctttgtttagtggggtaactggccccaaaagatctcaggatgggaccaacatgccagaaaaacctaccatgtgatttagggtgggggctttcagtcacatgatattagtccacctggcagccgagatgactcagcagacaatcagcaatcatacctacataatggagtccagtaaaatctttgggccaggcgcagtggctcacgcctataatcccagcagtttgggaggccgaggcaggtggatcacaaggtcaggagattgagaccatcctggctaacacagtgaaaccccgtctctactaaaaatacaaaaaattagccaggcgtggtggcaggcgcctgtagtcccagctacttggaaggctgaggcaggagaaagccgtgaacccgggaggcagagcttgcagtgagccgagatcgcgccactggactccagcctgggtgacagagcgagactccgtttcaaaaaaaaaaaatctttgaacacggaggcttgagtaagcttcttgggtta

SEQ ID NO: 68975 - DNA, 1050 bp, Homo sapiens
atattgctctgactttgcatttctagcttaacagaaaacttactgcataatttattaaaatgatttgatcatttaagatgctcccaatcctaaataatgttattatcatattgggagccaaaaaaactcacaagatcaatgcccagtattgtgagactaataccccagactccctgtccaacctcatcttaccctgataatgttactgtgcttgaattgcctttctaatgcacatcattctttgagcatgatttttttggtctgttttaaaaaggcaagaaaataccagtctgaggcatatctatgacggctgggaaacaaaagcatccattggtgaaagattcaagagacagaggagagactgagagcctgttctttgtggctgacccactgaatctggcattgttgccggttgaggcatagaaaaatcgtaggtccaagtctctttgatacaggggacgcatcccagcaaaattccccagcctgatgcttaatactggatgttacactctaccatcccaaagaagctgctaaatgcttgatcactcactccacctcctgctccaaagcttatcgtgtctcactgcaccctcatagagaatggaagtgtgaagggttgatgtgaaaatggagttttatcagtaacgatttaaaggccaggtgaaacaaggtgaagagatgaatgttttttatagaatccaagaaaacaactgagtaagtcatagatccatttttatttccttcatttttttccagggaggccagaatctactagaacattttctatgtcttttattttttagttccttattcctagcattattataaagaaaataggccaggcacagtagtgctttgagagaccaaggcagcaggatcacttggggtggcaggatcccttggggccaggagtttgaggtctgtcttgggcaaggtagcaagaccctatctctatggaaaaaaaaaatgcatttttttttgctgggcatggaggctcatgcctgtaatcccagcactttgggaggccgaggtgggtggatcacgtgaggt

SEQ ID NO: 68976 - DNA, 1009 bp, Homo sapiens
gagaggtgaaagacaatggggtgatgtgggtgccttcccctcttacccttgtgcctgcccctgaaagaaagtgtggagtttagtgtatacacattgtctttggttgctggactaaggctgaacaagattaataacttgttgtattgaactgcttatcttcgatagctagtgtttggacagtgtgccattcccgtggaatcttggggacaggagtgagattcgagaagccatcctttcctcctctgtcctcaggcggaatggcccccaactgggagagcgaattttcttcagatgttcaggagagtctagtagttcatgccattgttacacttttcattgatcagaagaactaactctgtgggcctttgtgtctctctttcaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagaggtaagtgaagggaccaggtaggtggtctgcccatgtgtaggcgtcagcagtctgggaagggcaagagggtgtcagaggaagccccgacatatccgagtgtcatgttatgctttaatagtgtacacttacacatctggaaggaagagagttccatatggcagggatgattgggacaggagggatcttttgataactttgtgtgagcatgaaaatcgaatggggaagggagagctgtgaaaaaaaaatgttatctctttttttttgcttctggaaacccagctttttggtcagccgtcttgtgatttggctgggcctggtttgtgggggtcgctctctgaggttgggtagctctttggagaagattatctgggaactcccatccttatcccaaacatacaccaaacctgcccccatccaccattatggaatttag

SEQ ID NO: 68977 - DNA, 1084 bp, Homo sapiens
cagatgtaggacaggggctaatcacttagagttcttcagtttattagaggagtgactacaggttttctttacaaccatggcctctagtatacttaaaataagcgtccagttataaaaagcctatttgcacaactttttgggaatacttctattaactaaaatgaggtaagccattattttggacatagaaacagatctttgtatcttgtcaccaaataatcttacctctagtctacttacaactttgtaagggtttctaagctatgcccatttattcccaaatattaagcccttaaaaaaataaaacctctgaaccaaaatcttcccaggaatagtacttaatagattttaatgttaatttatattcattgtagaattgaatttccagtgacctgtaatttcattacatatattttaaaatctatttattttagatggtgttaacttttcgttgctgaagagcttaactttttaaaggctttgtcctatacatttagaagatgagtcagttgaattagtactggacaaacagttggagattagtttgcaaataagcatatcatatcaaatacaatattccagccaaccagttaattctcttcctggttacattcattgggtctatttgcctaatgttgacaattagattcttggaccaagtgagggtgtactctgatccacaaagctcttttataaaccaggtttgaggttgtgtgtgtgtgtgggggtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgctttgaaaatctcccttcaggcggaggttgcagtgagccgagattgtgccattgcactccagcctgggcgacagtgcaagactctgtctcc

SEQ ID NO: 68978 - DNA, 1908 bp, Homo sapiens
ctctaaatgctttatcattttttcctgagatgcttctgagggatgctgacctcccactatggggaaaagggttgcttggaggacctggggtggcagccccccgaccagaagcaccctattttatagatagcagtctgaatggtagagagtcctgtgtgtgggttgttagaaggttggttcttcctgttattctctctggctttcctttcaacccacttattttcagaggcctctccccttagcatcctttaaaaggttttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccatttttttttttttaacaccaagatcctaagtaattccaaatgccttagatatcaatgaaagctacacaccattgagatgggcaaaattctttctctacaaagggagtaatcaagtaaatacctgttctctttcaatggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatatataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaatgctaagaacagaatacagacataaataagtcacggcccatgaccttgaagagcttacggccttataaagaggttcactgtaattgtcttcaccagggcgtccttctcaaagatgcccacttttgtctggcacattggggctcggtggtctggtggtcccttcggtcttggccctgtccgtcctttgtttttgtgatttactaacaatcatcacgaaccagttttgtttttcttttaaatttgaacatcacatcttgtgttttagttttttgctctatgatttttttctcactgcttttcagtcttctctgtacttcatttttgtgaaaaagtgaaaatcacatataatctttatttaaaaatgctcaccaagcactgcagactttggagttagggattcagcagcttgttccagtgaaaaggaggagtgaagctggggaagttagtatctaagaggggcaagctgattgcatgtgcatttatacctatgcctttaaaacattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcacaccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaa

SEQ ID NO: 68979 - DNA, 1055 bp, Homo sapiens
acctgttccttgtgatttttaatcttccttgaaagtttatcaaattttcttattttctgtccaaacaatgagaacttaattgaaaaaggcatctctctttggattaactcttggtgtttatgtatatctgtttcttatttactaacgataaattaatattttagatttccagtattttaaggatttttggtctccttactgttcctccctgccctattcccatacccagtaagtttggtttagctcatttaaactgatgcatatttttaaaaagggcatatgttgctttttttaaaaaaaatcaagttttattgaggtatgatttataagtaaaaaagtaatttttattatattgctgtataaagtctgacaaatgcatataatggaaccactgccacaatccagacaaataatattcccatcattctaaagtttcctcccctcactcataggtcctagcaaccactgatctgttctctgtccctgtctatagctttgtcttttctggtatgttatgtaaatggaatcatacagtatgtagccttatgtttcaggtttctttcacttaatgctttgattcatccatgttgatgcatgtttgttgatgcttggttgttttttacagctgagtagtatttcattgtgtgaatatatcatagtatgtttattcgccatttgatgaacaatttttggcatttaggaatgaaggtactgtaaacattcatgtgctgttctttgtacattaaggtgcaagtctttgtgtagacatatgttttcatttcttttggttacacatctaggaatggaattcttgggccgtgtgcaagtgcatgtttaaccttaaaagaaattaccagctgggcgcagtggctcagacttgtaatcccagcactttgggaggccgaggtgggcagctcacgaggtcaggagattgagaccatcctggtcaacatggtgaaactccgtctctactaaaaatacaaaaattagctgggcgtggttgcgggtgcctgtaatcccagctactcaggaggctgaggcaggagaactgcttg

SEQ ID NO: 68980 - DNA, 1011 bp, Homo sapiens
tcttgtcaacctattaagataggtgcagttcatccacaaggactcagatatagaagtatggaatccctctcaggccatatttagttttctttaacacaagttttctatcatcttgggaaaatgtgagcaaactagttatttatgtgtttcccttggtgaacaagtccgttttttattaatgaggcactactagcagacctttgattgatgcataagcaaagatttactaactgccaaaactgagtctatgaaagttaaataatggagaactgaggtatgttgagaagcaaaattcagtttaatagaaatctttatttgagtcctgactatatttcaagtacctgtactaggcattgggggatacaggagtaagtgccactctgggtcttcaaagacctcacagtcaattatttaagagttttaataaacaaataagttatagtgagtttattgattgggaaggaatgggatcttgaaaattggaatggggatgcatggaaagaccctgatgaagctggggactttgaatccctaaattctgatgagtcttctttgccagttgaagagacccccacacacctagtgggaatggcctctttacccacctcccctctgcccctcctttccccccaggggaattaattctgcattgcccaagcaaactgtaatggctttccctgaggaagttggcatgcaagacaattctcaagacctctccccaccgactcctctttgtttctagacctataactacactcaagtcttagtaggcccctaaagatgaggcacaaagtgtgacccatgaagacatgtactacactctgaaataaatgcttaagttttctatttatacagacaaaagtccagagaacatgtgtgatcatgcatattaagggtataggataatgtcagaaggaacataaagctggatcagaccaaatctattgatatgggctcactaagcagagattctgcagcttggggaattataaaaggctctaacattttgtt

SEQ ID NO: 68981 - DNA, 1009 bp, Homo sapiens
aacaagctatccagatagatactttaatccaaattagctccttccaaacagcttatatagagggcaaactaaactgtcacaagctgaccctttagaaggaataatgggaattggaccagcagatgttgaaccaaataagttagatgtggttcactttgcatctggagctatttgcatacaaagccaacaggaaagttcaaacatttttctcaagacattggcagagagaaacctggaagacagatgccttttggatttcatggttcaatttttccattctccattctgtccaggaaaacctaggacaacagatcggtcattttattaatatcccattactctccttactaaccctgtttttccagtagaatctgtgttacatatctatgagagctcagaacctgagtccacaaatttttgtttgaggaaaaattgtctcaatatttttcttcagattaatctgtagtttgtacctagtaataatgaatgttaatcaaattcatttgtctgatttatatttgaggtaaaatttgaaggtgacttattacatagtcacatatgtgcattatggtaggcagtataggtaatgcttaaaaactttccgtctgtctttgtatttacattagacatttttgtcaggacataaaccagatttctgttgaagtctaataattttgtagtgcctttacacagattatttgaatagaaatttgtcacatatcttctttttgctacatcttgtattttctgtttaactcctaggttattaactcaccttcttttactctggagccagtttttaaaaatgacgcctaaaatgatagcttctataaagctgtgaattattactgtacatataaatactagtcttgatgtgggttttcagtaatttattgcagttcatgtttttattaatgcatatgataggaagtatacagtgatatttgctatgcttctgaagattaggtttattatagtgtggattagagtcaaatatccgtgttgtgga

SEQ ID NO: 68982 - DNA, 1038 bp, Homo sapiens
acttatactttgtatttactcaggttgagttttcatgtatttcctccctctttttaaaggttgggcatttgagcttcttaaacggtgtctctaattcttggtggtattctcctctgtatttgtggtacttcctctttgtggcaggcggagtgggagggtaccatgatttcttgagattctggaatcttccaacccctttttgtgcccattctctccttgtgattatctattccatatcccacccatcagcaatttctgtagtttctaagttcattcaaaccagggatgttttcagttctctctacttccttggtcactatctcagtcaaaagccaccatcatatctttcttagatgacttaagcacctttttttcctgcatccactctcagtgtctgctccccccaaccaaccctgccacccatgactccattattttaagtggcaccagagagggctgggacacagtgaatgatcagtaaatgttacctgtttgtgacatttgattttaaagtttagaaatgtgtaggatttatgttttcatttgttgtggattcctgaatatcaataaaacatgatttgattataattttggaggttgtaattttgacttatgatattcctctgaatattttgttgtaattcctttgttgggcactaaagatttgtacctgttattaggaatctcctgaataaattttacaaactaattgcagttataaaatcctccatgatttgggtattgctgttgtgcctaatcaaagttttttttagtcccaattctgatttttgtattaatttacatgattatattggcttgcagctagtatgcattaatttttttccttattaaagcattgctgaggtgataatcatttttaataatgatttaattaataaaaatgtttaataatgatttaataatttcattaataatgaaaatttcctacatttacattaaaacggaaaatcttctagatttgttttttttggagtgactgtgttaaaggctagttttattgtggacctcctcagatag

SEQ ID NO: 68983 - DNA, 1042 bp, Homo sapiens
ggtattcaagcaactatttcaattttagagtaaaaaccaaaaatatagcagttataaggtttattcattcaaatattttttaaagcaagaatttatgctagctgctgaaggtagtcccaatttctaaagtgctgtacacaattttgagtcacctgttaattttgcgagacagtggtgatcaatagaggtcattgataaatttcagagtttgatttacagtttaaaatataaacaaattctaggtctgtgtgtaaatttaagaactgttaacaaccagatatgtctatccttattcatacattttcaagcacaggaaaaagttaagtcttttagtgcattggtagcaaaataatgaatactttagatttcaaaattaagaggaaattttgtttcttacagcaaagatcgggttgttgtaaaagtttgaggtcttctcttgatttacttaaagggtgaaataatttcggaaccttttcaacaacttaatttccaaatgtggtttctagtgccctttggatgttttcattattggtatagtgtaaactttcctctcttgtgtatttttttttttatgtggtttagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggtatatttacatttgcctaagaaatgtttgaattgcaaatattagaaatttgatataatctcaaactctgattaaaaactcatcagaggaagaagatacttttctcccttggttgtaggtttaaagcagtcatgagcttatcacttagaaaagcctttgataagaaatatattttacatatgtacttttaaagatatgaacatcgtttactaggttttttctaactattgctttcttttttggtttatttttattt

SEQ ID NO: 68984 - DNA, 1019 bp, Homo sapiens
atatattatttgttaatatcatgcaattatattaattttaaatgaattaataattttattttttcttgaatttctaatatgtattaatacatatgatcaacataaacaaaatctctttgatatcctcaataattttaagattgtaaagggatctttagaccatatagtttgaaatctgctactccaccctaaggcctgatttctttgaagattagaaatgccatggaaattaagtaggaatatttgtataaaaaagaataatagattttattttgtagcagttatttactatgcataaaaacagcaatgttagaactaaacactataggatcaaagttttttatcttttaggttaaccaagtctgttactcaagaaattattatgcagtctttcaaatttgttctggtctttatttattttgaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggttagtaatattaactgttagtaaatatttacttttttctcatttttctcaaaatgaagtacccttactctatcttttatcttacttaaaacaaccttagtagatatttatgactttttaatttttaattttcattttgatgtttatattttgaattaatcatttttaatattttaatgtgctttcatctttctgatattgaaaacttagtaactgaccattttacccttttactttattttctaaaaggtcaaaacaaaatttatgtttagtcattgcaaatatattaacctttctgtgttgtttttccttttctcatacatagagacacatacgcacacatgcacacagactcaatcaatacaaaataatatatttgtgtagaaaacaatttgattcaattaatttataattcta

SEQ ID NO: 68985 - DNA, 1037 bp, Homo sapiens
gaagagtaagaagcaattttctttacttcaaaggttttgtggtcaaggcattgtcagaattttttaaatataaaagggctcttttaatccagttttgctgcaatattcttggatgtttgcatctccaactattaaaagataatatttagacaaaatgaactttccttatgttctgaccagttacacagttacttgaataaaccattatttcaatataagttatttaatatttcatggtcccttacttttctcttcttagaaatatagaagtttgactagctgatctctaatgactcttaaagtcctaaaattctgttaagactatgagtaacattttccttgacagttgataaaccccttgagagatttttaattcttgatataaatcagttgcatcatagtagttacattgtatggtatttataaattagtgtaggaaaatggcgctttcctgacatttcccatcttcctgcccctttctcatcctaattactcttgcttctatccaatctggaggaggctgtgtagttgtatgtgcaagaagtagctcattaacaattcagcatctgtggtctaaagcatctgcccttgtaacttttgatttgggtctcatatttgaaaatgcttttatgtaaccaacacatattaaaaagcatactatacccttacattcattattgcctgttttcggttgtacctcattttttgatgccaaagggaatttagccttctctacataagctatattgtaatttaaatcatcagaagtttaccttccaaatttgtataattatatccatttcaggtggcacaataaacaaatggaaaaatatttggatttagaaaaataaccagtactaaccatcttgccaaatgatgtttcaactaggtcacaaatttatccttcttcttaaattaaaagcttaggaaatttgatgtgaaagagaggttagtgaaggcaatgaagtaaacagattttaaaggttttatagttgtttaaggttaatataattatgattttaaaacttattcactat

SEQ ID NO: 68986 - DNA, 1033 bp, Homo sapiens
tttttcttatacttgttttattttaggttctgaatagtcttttactgtattacttattcttccttaaaaatgtaatacagttgttttaaaaagataaccacactacacatattatttttattaaatcttcatcttctatcataaaactatgtacgctaattcattgtagcagtatgagttcagattctggagctagacacttacatgttctaactatggttatgctactgatttcagacatagaactttttggtattttaatttcctaatctgtaaactaagaataatgatcataatttaggcagtgcttactttccatcctacttttgagacttcctttgaaaatcataagtgaacacagtgaaatgaaggaaggaattctcagttttaatatttataatttatacaacttttttatgaatagttatataccaatggccatgacaggtcattggcttttccaatataaggaaccttgtagagggagcatcaaatagtaaggtgaagttctacaaggcaaggaaatgccagtcaagctttctttgcttcctgggattttgtcccattgtttgatgattgctccaaatggtcagtttctcaaccaaatccagcacttatgattttttttcctgtctacgggacatgtgtagaaactcttcctgatactccctggaggcctcaatccttcgattgctgatcttaactaagcaagactcaaacatgtcttttcttaattatggttcaagactcctttaaaaatggaatccatattggtactttttagactaatccatgaactaatgaacttttggtactcctagctctaatgctatatttgagaaaaactactgcagaggacttttaagtctgcattagtgtagtgatcatcctctccaaacgttattcctgctttccctcatttctctatcatttaaccaacccaggcaaggttagacacttaatccatttaaatctaaacctctgctatcaccaaaagactatatttttggtaaagtttgtgtgtgtatatatg

SEQ ID NO: 68987 - DNA, 1052 bp, Homo sapiens
tctttgtctaaaatgaactctggtgcctactggctacatttggacccattagctattctcatgggggaaatgaaatccaatctatcttattttgtggttaagcagttacttttttggtttatgacttcatagcttaaagtaaaaaaaaaaaagtaatgatgtcctagcctttaaaaattttagaatagaatccaatttagtatattcaaatctcatactgctattgcactgtctcagtatttttgcttttcctccaagtatgatcaagcctgtcctgtatccttctgctgccagtgctctcagaaggatcagttccatgagggtgatagaaggtcttcaagatcttgatgttgtaactccagtcttaggcttcttgcatgtctcatgtctctggggatagctttttgtacctcatctggttaccaatttctagctctctttttccatttccttgtgtccactccacttaccttcttattaagcatggacttcaaacacttacttggatgcacttattaccaccatagcattccctgcttctttaagcactgggagaatatattctgtctattgcatctatgtttcttaacagcctccagtacagaatattactcaataaatatttgttgtattaaaaaatgtaagacgtgcttcttccagttgttaaaagatatttaaaatacctgttttttaacttgtgaaagagtccaatttgttttactctagcagattcaaagccagacgcagagagcttttggctactgtgttagtcacagttctccatagaggcaggaccaataagacagatggatagctagatacatagatagatagataggtagatagatagatagatagatagatagatagatagatagatagatagatgatagaagatttgttagggaaattggctcacatgattatggaggctgagaagtcccatataactttctgcaagctggagaaccggagaagccagtagtgtggctcagtccaagttgtaaagccggagaccagggaagccaatggtataactctcagtttgaggt

SEQ ID NO: 68988 - DNA, 1034 bp, Homo sapiens
aggtatgcaaataataatagcaacctttgattgggtggtttgccatgttccaggaacagtacaaagcactatctcatttaatcttccaacaacttatgataggggtattaatcccatttcgttgatgagtaaactgaggctcagaaagattagataatttgcccaagtatttgttgagcacttcctgaatgtttgatactatagagaaggatacaaatgaagcaaaatatggatccagtaaaactttttaaacttaacaaaaagtttaattaatatattttttaaatatctataattgaaattatgaaaggcagtttctagcctatggtttcattataccttaaactaatgatgtggagcattgacttctttcaaaactctctgagtattcatttaagaaatgaagtattgtatcagaggctctgttgatcatggctatcaagcaagtagacatacctcagatatttgaactcaagaaaaagcaaaatctcagacttaatataagaccatttgtatgaaccaaaactcatctctatggattgaacatagagcaaatgatcaacatagcttaatggtgatattaaatgtaatgattatattaagtgtaatggtgacattaaatgtatttcaagtagatgtgacattgctgcctctttatttatagctgcgaacagctgtgtactttcaaaataacaaatttttaatgagaaaaaagaaaagcaaaaaacatgcttggagagtttctttttatgcttactgttttgacacagttttgcgcataggtgatatatttatattctctccattattctgttttttattttaattttaacttaattttattttattttgagactgagtctcactttgttgccgggctggagtgcagccgggcatgatctctgctcactgcaagccccacctcccaggttcatgccattctcctgcctcagcctccggagtagctgggactacaggcacctgccaccatgcccagctaatttttgtatttttagtagagacagggtttcacc

SEQ ID NO: 68989 - DNA, 1050 bp, Homo sapiens
tcttactgcatttttgaggatattgagaccattctccttttactcatcttgattttaaatttttcttttgggtacccagaatggttccaaggttagtactgcttgagctcatttcagcttctgccatgcatctttccatatttactgagtttaaatgaatcatctcagagagaaaagaaaaactaaatatagaaaagtgggagtactttcacgtttaatacgcaagggcataaaatagaatgttaggaaacaatttggatttttttccctaaaatataggtgactatgggctagtttacaactttccttctctcactgaaataaaaatacatagttaaggaatagggacgaatacataacaggtgacatttgacagtttgggcatattccttgttactttctaatcttgagaatcacagtttgctgttttagaggtatctgagaggttccagataaaaagcgatggctaaatgctcttaaactttgagcgtgctggatgctctaaagtaggagaggaatttataacagaagcttacaatgaagaaccagacattccgagccatctgagatcttgcaatgagaaggcgccaggcgataaggaagagggcagtattaaagaggtagtgaatatttcggagcctagggaacagacagacataaccaaagttaaaactaccagatacccaaccacattatctgaagataaatatgtgttttcctggatatgactggcaagtatttatgaagtgctcagagtatttgatataacttggccaattggtttctgcgtctttcatttccacagcattcttgctgaatagtcagatttctaccatatttccctaatttctcttatacctctctccacttgaaactatttacaagcatgactagcataatcttgtaaatatactttggtcatgttaccacatcataaatcttcactggttcttgttcattagaaggtaaattctaaagttcttggcttgctattcaaggttcctccttcctgttttgcaagctacttttttatccttatcatctctgcac

SEQ ID NO: 68990 - DNA, 1685 bp, Homo sapiens
aaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatag

SEQ ID NO: 68991 - DNA, 2692 bp, Homo sapiens
cttggtggtagcttggaatagatcacctaccttttctgaggttttctaatcagtaaaaatagcaataataatacctaatttgcaagtgtgctataggattaaatatgaaaatgcctagaaggcatttaagacatttttaactgtacagtatgtaaaatcatatgttatagtactttgaattatgcaatacatgaaactagatttgtaatcagtaacatgtttatgatttttgtcctgagatcctggaattcgctaagattatttgtcgaattgtaatgatgaaaattgggagttaagtacaatagagaaaaaggaaacaattctattttcatcttcagtccttattcagtattagatggagctgggtagtttattatacttagaatcatatttttaaatgaatgaatagcttttctttcgaaattctttgttagtgcttcatttcaatctatttaaatttgtgttgttgacatcatttattttccaaaattgtattggtgtgggaaaaccttgaaaagattgtgtttaggcccggtgcagtggctcatgcctataatcccaacactttgggaggccaaggctggcggatcaacttgaggccagaagttccagatcagcctggccaacatggctaaaccccgtctctactgaaaatataaaaaattagccgggcatggtggtacatgcctgtaatcccagctaattgggaggctgaagcacaagaattgcttgagctgggaggtggaggttgcagtgagccaagattgcaccactgcactccagcctgggcaacagagtgagacgtctcaaaaaaaaaaagattgtgctgagatcgtgaattatgtggccttgtgactttgaaaagaaatccatttgttttaaaatctttcttgattatttttaaccatggaagtgaataatgcaaactgctttgttttcttccgtaatctattccattatagttatttattcttaaataacagtttaggaaataattaaaagcataaacttattgtttattacaggcatgttacatggaattggaaaatttatagttgaaataatttgctgtcgtttcagacttggatcctataaacctgtcaattctgtaagtggtgtagtatacatggtgctgatctctaaatcttagaatcattgttaagtctatgagccagtcatggtggctcacacctgtaatcccaagactttgggaggctaaggcgggaggatcgcttgagcccaggagtttgagaccagtcaaggcaacatagtgagagccccatttctacaaaagatagaaaaaattagctaggcaaggtggtgcaagcctgtagtcccagctacttgggagggcacagtgggaggatcacttgagcccaggaagttgaggttgtagtgagctatgatcgtacgtaccactgcactccagcctgggtgacagagcagaccctgcctcaaaaaagatagagatagagagatagagaaatagggggagagagagagagaaatagtagcttttggttactagaaaggattgcccaaaataaaaccttgtgtttagaggaaagagtataaggaataaaactaattctttggtctttttttccctccttttctccttaggttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtc

SEQ ID NO: 68992 - DNA, 1958 bp, Homo sapiens
gtagcggatctttttataactcaccctatgttgcccaaaatacaccaataatataatgattagattaaaaaacttggcatcttttttaaaaaaatgtgctttcttttccgtgtataagattctactataccatttgtgaatgacaccctagttacataacacctacatatctgcccctgtgagaatttaccttagtcttctaagactctatcttcaacagttagataagtcaataaccagagttcaaagaaaagtagttactttttaagaccaaattattggataactggtcttgtcaatatggcttaacattaatatggctataacatagggactagcccgttttttttttttattaacaatgtgacctgatcacaattctttaaagtctagactagttttccgtatgttttccacattttattctgacatcatatcttttaaaaacaaaaggatgcgaacatttgcacttctcaatgtttttttttttcccatagatgtagtttcacttatttccttcaggctttttatcagcaagaagcaatgtctgattttgataccacccatttgctatgaaaatataagaaggcgtcatcttcaaagcaacactccagttgggcttcttcatcgtttagctgcatgatttcttctacgacatttgtaacagacacaacgtatatagaatttcagtttgggtttttttatccttttttttcttttttaaaataagtatgttttctgcttatttgtgttttcttttctttgaatatattgcacaatattttattattaaaaaaaggttttatgtctcaggcaaaaagtttttctccttcaatcgggaggtgttaatgtgtattattttctaaaagaggtaagtggttgtctgtgtggccatcctcaaaaggaacctaaggagaaaaggagggaaaaaaagaccaaagaattagttttattccttatactctttcctctaaacacaaggttttattttgggcaatcctttctagtaaccaaaagctactatttctctctctctctccccctatttctctatctctctatctctatcttttttgaggcagggtctgctctgtcacccaggctggagtgcagtggtacgtacgatcatagctcactacaacctcaacttcctgggctcaagtgatcctcccactgtgccctcccaagtagctgggactacaggcttgcaccaccttgcctagctaattttttctatcttttgtagaaatggggctctcactatgttgccttgactggtctcaaactcctgggctcaagcgatcctcccgccttagcctcccaaagtcttgggattacaggtgtgagccaccatgactggctcatagacttaacaatgattctaagatttagagatcagcaccatgtatactacaccacttacagaattgacaggtttataggatccaagtctgaaacgacagcaaattatttcaactataaattttccaattccatgtaacatgcctgtaataaacaataagtttatgcttttaattatttcctaaactgttatttaagaataaataactataatggaatagattacggaagaaaacaaagcagtttgcattattcacttccatggttaaaaataatcaagaaagattttaaaacaaatggatttcttttcaaagtcacaaggccacataattcacgatctcagcacaatctttttttttttgagacgtctcactctgttgcccaggctggagtgcagtggtgcaatcttggctcactgcaacctccacctcccagctcaagcaattcttgtgcttcagcctcccaattagctgggattacaggcatgtaccaccatgcccggctaattttttatattttcagtagagacggggtttagccatgttggccaggctgatctggaacttctggcctcaagttgatccgccagccttggc

SEQ ID NO: 68993 - DNA, 1055 bp, Homo sapiens
aattgtggaatttttttttttgttcttatgagattaggtattggagtttttaggggtgaagtgtcatgtgtctatagcttttcacttggcttgggagaaagtacaagttcatataactgcatatatatgtataggtatgtgtgtatatacactcacacaaagaaactaggtaaagtttataccagaacatattgtgcttttcaacatttctttaaggagtagggagattccatttctcacctgtaagattggcaaacacctcaaggcaatacatacagttgagaagactttggggaaaataggcaaacatgcagtgctatggggatgcaaagtggcataatctttgaggaaggtagtttagcagtatctgcaaaaggacctatgcatttatcctttgactcagcaattgcacttcgagaaagctattccaaagatacggtgggcaaaaatataaaaatgtgtgtttcaggctattcgttgcattgttatctgtaatagtagaagattagaaacaacccagatggtacatctacacacactggaggaagatgcaattgttaaaaatcaaatgagaaggatttctatatactgataggaaaatatctccagggtatatttttaaaataacaaagccaaaaatacatatgtaatagaatcccagggcatttgactgttgaaggatgtgtttatactgatagggtgactaaaatagttttttaacttaaaaaagaatggagtaactggggttggtaaaatgcaggatagggggtgggagggagagggctgacattcattagtcctggaacccaaagtgaatcattattagtctttcattatgtatatgccctgatccctaaaacagtttctacccttataggtagtgacaatatatttataactcagcatgatattgagcattttagagctttaagatgtagtcactttattggaaacttgatcagttggcttataaggctgtattgtgctagtaatagggaaagagttttgtaatgccctacgtaaaactgttttaatttcccttggtagtagttaac

SEQ ID NO: 68994 - DNA, 1094 bp, Homo sapiens
ctgctttagaggacaaaacaagtaatggattccacagaaaattagtttggtcacatttagcaatagtgtattaaaaatatatctgatcagttttattatatggccacatggccatcattccaattctaacaataccgtcctgttaactatatgatgatttggaaaaggaaagatgtatatttttggctttcattatatattaatattttctagacgttaaattgtatataattattaaatttgagatatagcattttgtcagaatttattttatacatttaattcgcatatatttacatttatttttctcaaagtattgtggcttaaaatactgtattattatccttgaagattttaaacattttcatttgagaatagataaggatgtaaaccagtctgtaccaagtaattttgaataatataatttctctgctaagttgtttttattttttgccttttagcttacaatttttctcatagaatagatcatttgtcttttggagagcttgttccagcaattattaatcctttagatggaactgaaaaaattgctatagatcgtaagtatttaataattattgttggattttacatgtagaaaattttgcttataacctgaatattaatacatttttaatgtcttcctaactactgtgtaaagataatctttaagtggttggtgattgagatgtatgtgaagagaatttgtcctagtagtggatgaaatttgaatattcaaaaatgagccatagaacagaataaagaaattcaagttaaaagatgaaggaattaaaaggcagaaggagttcaatttaaacagtagaaatagatgaaaggttaatacattaacagggcataactgcacttttttgtattcaccaaagaataagaatgaaaaaaaggttcaacattatgagaagaattttcttctttgtataatataggttcaaagttttaaaatgcatatatatcatttcagaaacctctctggagaattttacaaacaccagaaacctagttattctggaatggtttggttattaacatagaaggagtacattatagcacagataacctttttaaaatgttctatt

SEQ ID NO: 68995 - DNA, 1207 bp, Homo sapiens
tcagaaggggagtaatataatacatgagaaatatatgaaatttaaattcgtgtccaaaaataaagttttattggcatatagccatgctcatttgtttatatatggctgcttttgtattacagtaccacagttgagtaattatggcagagaccatatatgactctctcattactttgtactttggtgtactatgaattgtagtgatgcagttataatttgacagcattaaaagtgctgtgtgtattcctgtcctgcaacattttatttatttattgtattactatgttaaaaaaaagaaatatggacttcaaatgttgcatttttaaagcacagtgtaccatggattatttgatcaaatttggctgcagaacatcctgcgtattaagcaatgacactatttaattgtgctaaaaagaatacagtatctgttgatggtgccagattgagcattcatcacaatattaccaacctataaaaaagcaatgatcagaaaaattagaaaattaaaaatggaatatccaaacactgtagaattttatcataaaacgtgaaaatgaagctgtaatctttaagtgcctcattgtttagcaagtaaggaaagccatccaagtattgataagtctgtgaagcaatgtttgactgccaaagctaaagaaatgactccagaaaaaataaatttgctttagacaatcagatgactagccttcttcaagaagagtgttctggtagatgaggacattgagagcagtatctaatagccagttaaaaaacaagccaggagattttgagtagttcctaaactcttgataagtggacagatgttactagaactgcttattgtttatttgaggaatcaatgctgaatttgaagtgattgcagaattagtatctatgaatcgcctgctttcaacaaaaactataggcaagaatatttttatagaagttgagagaacacaaattcagtacatcctaaagtggaatctggtatatgttacaaatgtattataactgatggtggtgtgtggagcagaaaaaggcttacttgaatgcatttcaaaccttgtgaaaatgtagtgtttaatgcctattgctttgcagaaaatatttgaattgattttgtattttaaactggtgtgtcagtggtaaacttcatttgctctcctgaacctaaatattgacatttccatggtttttttttgtcagatat

SEQ ID NO: 68996 - DNA, 1724 bp, Homo sapiens
ttacattagagttcgttcttggtgttgaacgtacattctgtgagttctgacaaatgtataaggacatgtatctaccatactgccatacagaatgatttcactgctgtaaaaattatctgtgctctgcctgtttattcttcccttcccactgtgtataacatttgtacttaccaagtttgaactttactacagatgatttggaatattagttatttgaagaaatagaattaaaagagataaaataggactacatctaatgacacaaagttattgctgaaaattgtaggagttaacatggctcaatggtagaagtattgtagagagaaaaatttttgtagtgaaaatcagttacttgtggtatgagtttatactgagtaatgtaccatttcaagtccatcaagtccattgtgtagccccttatttgtcctactctttgtatctacaatatttcattcagtgtctgacaaagataagaattttgttaattgtgcatgtatgcatgaaagatgaattgagatacttaagtgagtagaagccctactttggtggtcctgatggcacatccattactgatggaatcaaacaagcttatggagctcagctattagacctcttagccaccctgcctcatttgctttcaaggaaatgaccaaagaaaacttggtatgttattttagaatatgaaatcctgtaataataaatgtatgatttaactaagtcagctaaacattgtcatttttgaataagtgtcagctctctttgtgtacctttctgtagttctaaattattgcttcttatttaggatgctgcagctgattcagagtaggctacaagaagagcattcacttcaagatgtgatatttaaaagtgcttttaaaagtacatcaacagctcttccaccaaggtgagatctgtattttaaatgtgcaactgtttattatgaatttactttgacatagttaaaactaaagtgttggtttagttttctgaatcttatttttcttaggaagggaaaatagaatcattctgtactataaagacgccttttgctcttaaatttatagcctgtgattttgatcagaattatcacaaatatttatttgcatttaattttcttttttatgcgtggtatacccccacataaaattatattgagttttaagaaaaattagtttcatttactattttgaggatatataagctttggttagaaattttgttttatttcccgtttttgtattttaattaaagattagaggctgggcgcagtggctcacgtctgtaatcccagcacttttggaggccaaggtgggcggatcatttgaggtcaggagttcgagaccagcctgaccaacatggtgaaactccgtccctacgaaaaatacaaaaaaattagctgggtgtggtgggtgcatgtatgcagtcccagctacttgggaggctgaggcaggagaatagcttgaacccaggaggcggggttacagtgagccaagattgcaccactacactccagcctgggtagcagagcaagactgtgtctcaaaagaaaaaaaaaaaagattcgtggatatttggaaatgctataatcataaacataataaaaatatacaagattttacatttgcttaggaagaaaatgtcactgtctctttgaatttaggtggcatgcctttcctttacctcaatcatgtttctgccctccctccctctccctgctacagtac

SEQ ID NO: 68997 - DNA, 1077 bp, Homo sapiens
tacccgtttttttttccctagtccctaagtatattccaagagtctttctcttttaatttccagtttcaccacttgaatgtgggtgaacaaaagcactgaatattagctgtctctgggctcttagaatttttagtagaaagccatccacagatgaaatactttactttgatccagaaacattaaagtgagatttctcctttcatttagaatttttttcaatgctcgaaactagtaataagtgggagaagagattgtatttttactattaagatgatataaatttgccatcatagtagttttctgcatactttcatgtgtggaatataggctgggatatttattggcacagtgaaggcagaaatttttttcataaacacacataatatatacatacatatacacgtatgtatagtttgttgtcatcaaaccccttgatcactgccatgcttcaaaagttgatctctcgaattacaagacacaaaaaaagtgaagatttccatttctgctggcattgaatccaaagattcaatgtcaaagattcaatgtctttaaatgtctgaatctgaagatgggatctggcttcttgaagcatcctagattatcacgttctgattctaaacattattaaatagctcttgaatggcctagagatacccaaggtagatatcttcctaactaatgtgcataccaaaatgttctttacttctagaattttctaagagatttaaattttctctcagttggtgttctataatactttcctaaaatatttaggatcacaattaatctctctttaactgtaaatttcaaaccctggacagaacctttctggtttctactttttatgtcgagatttcagatttattttattccaaactatacagtataaatatgagttgttattttacataggcctgttatactaattttctagatagatgatgcataagtttttaatcttctgcttgcacatctagaaagtacttattttatcattatggtgggatggtaaagtattatgagattcacatttgctttctttttgtgagtacctatgtttataacttttttccaagt

SEQ ID NO: 68998 - DNA, 1050 bp, Homo sapiens
attttaagccctaggataccattttgtacatatgataaattgtcaacttgcatatattcctgtaaatgtcgataactgtaacaggaaagtatttgtgattagaaaatttctttatgctatttttcagtaaagatagcacattaaaattttaatttgacttatagaagttgaatgtaaaccatgaatacttgtttttaacaacacttaagtttatgtttcctgctcaaagaaaaaattttaaattatgatgtaaaagccaagagaatttgacaatgctagtgattatgttttctttcatttcagacagtatttgatctttcaccacagcagaaagagtggcagaggtaataagagaacaaagtattgtggtccatagaaatctaagtcatattttgtctattgtaaactatttatagattaacacatttctctagggatttctttggatgaattcttagcagaatttggtatataatataatccttacaatttcaaaaaccatcagatcttaagaaagtcatgcataatcttttctctggtaaactttgattcataagttttagtttttatttaaaatggtatcaactatttacattttttgattacaaaagtaatatatgatcattttaaaaattcaatttgaatagaaatgatataaagcaagattgtccagactgcggccccacaggaaggctttgaatgtagcttaacacaaatttgtaaacttcttttttttttgagacagagtctcactctgttgccaggctggagtacagtggcgcaatcttggctcactgcaacccccacctcacaggttgaagcgattctcctgcctcagcctcctgagtagctggcgcacactacaggcacacaccaccatgcccagctaattttttgtatttttagtagagatagggtttcaccatgttgactaggctggtcttgaactcctgaactgaagtgatccgcccatgttggcctcccagagggctgggattacaggcatgagccactgtgcccggccacaaatttgtaaactttctgaaaaag

SEQ ID NO: 68999 - DNA, 3733 bp, Homo sapiens
catttatatacaaattatatttatagacatggatgcatttttaataatgaagcaactgttttcaaatttgtgctataaggcatgcttactttcatcatttatcctatctgtgacactgttttatataagaaatacaaattttgtcaactctacttagtgagagatgcccttaaaattggagaaataaaatgctttcttagtaatgcaagtgtttatgttcatatttgtatatattaaaccttaacttttgagctgtattagaaaaaatgcataataaacattttgaataaaaaccttctatagtatgcattcaaatggaagttacattattaggctttttcttttgaaaatttaatctcacttaaattagtttcctattctttgctttttttattgttttaattctgtttttcttttgttgttggatttcccagtttctctaatagcatttacaactatggctttattaaccataatggaattctcagtatatcaagatacatggatgaagtatgaatacgaagtagacaaggatttttctaggtaatcattttttttcttcttggaatacctttagattcaaattgttttaaaaagagcataccttttaaaaaagaaaaagtctaaccttctagatttggtttgttttagttctgaagaaatagtcctgaaaaattctcattaattgcatgcattaagtgaaaccttttagaatcatttaaatagtggttgaattctaaaactgaggttctttgatttagcatgctttgtttcaaaaagttaggggaatatttttccttagatatgtatattgtggaaattgtttaatatttgaaactggttgaaatacctcactgatctgtgtgagctggaaaataagttgtctaaggatacattgtatacccttatgacttgatgtctataaattatacctaagctaaatctttatgtaaataagattacttttaaacttttgaaaatatagtaccttaattatacactttacatctattcgtttgtattatttggatttcttcaatggaatgaagataataggtttataatattaagattgcaccaaataggaagacacatttagttttcaattacaatccaggtttgccatttacataattttagggaatttactaaatctgcacctgtatatgcttcagtttccttttttgtaaagtacagacagcaattatagtatcttcctcaagaggtttatgagaattaaattagtcaacatttgtaaattgctgtgtaaccttgggcaggtcacaccactgacttcttttggacttcagtttcttcatctctaatgtactattcaggatagtattggttttcaaagaatttgttgttgttttcagcaccaatgcaatacttcatttttttccaaatgaagtcttatgtattacatagttcgccacataagcatggtgaggatatgcagaagtttgtctacttggcctactcctggttcctatctcctgagcctaaactcctgggttatttggaacacagtttgaactctagatgactttaagacttcatgaaggtctaaaaatctgtaattcctattttaaatcagatgaaaattattacacagaaaaaagttatcatagaaagcacaggactgaatttgatcatagccagtctattattcgcaatgcttcattctggtattcgaaaattgctttgatctaatcatttgaaaatgaaaggccatgaaaaattttaagcatcaggtgatttacttttggtagtttggttgcatttatcctgagttacatagacctagtttccagtatgccactttaatggtgatgtgatcttaagccaggtatttacactaccgtgaacaccagtggtttacttgaaaatctgtgaagccatccatttatagctccatgatatagaataaaggagataatatttgtagaacatctagcatcatgcttaatatatggtgtttgataaacagagaagaaagacaattcctaattcttgattttgagagttttacattcttaaaagaacattctatcaaaagtttatgtaaatagagattaagaggttaagactttttctgagttgcttagagttattgattatagagttgccattattaaaggatactgtgttcaaaaacctgtgaagtcagaaaggcttttggaataagggcaaaatagaacttgtaatttaaagagcctttgttttggccatgagaaatgcaattcaagttctaatcgacataatttattctgcttgaaatccaagtttttaataggtcagttgatttatatttctcatgttttgctaattaattggtaggtactaatgtttaatattttgtctttcagcaaattaagaattaatatagatattactgttgccatgaagtgtcaatgtaagtacaccttcaacttgctgaatccacatgtaggttatggttcaaacaattgccaagcaaaaataaaaatcactggttgtactttatttttcctttataatattttaaagttttactgtggtattatttaataatacaaattgttttactcctcagcttatattcttcaagtttcttttccataaagagaagagataaaactttcacattagtataattaaaagaaagttggaggaaatgtttgtgaatcagcattctagtttatgtacatcctttctgtctttttttgtttggagtactagcttttatacccatgtttcacaagcatatccttgtgtcactgtttcagtttaccaccttttatgtttactcttgcgtttaaaaatacagatccagttattttaagttaatggtgataggttacccttttcttttttcgtcactggactcacttggttatactaatagaagtggaaaaatgctaatatgccagatagtgaatgtttgaatcaatactgttttcaaaaataagaatgcttttgcatgaaaaatattttatgagttactgcttaaaaattacagaccaagaactcagagaaaatttttacatttttaaaagtatgaaataattttacccaattaattagaggttattttctgtgagattctatctcagaacgaccttgaatctctttcttttcaatatgtttttccttatgttggtggttttaagagataaaaaaatactttatttttaaacttgtagttagtggtaattctgaatatatgatattctgccttattttggatgtttaaatactgttaaattttagccttttccgaataaaatttcctatttgttgatttgtagcatagctttacgatttcttttaatctctaaaaatatttcttggaattaatattttgttcagcagccacttagtacttgtgattaggttcttgccgatatttgcaaagctcttcaattcagtgacgcttatcctttttaaatgagatcttgaattatctttttttttttattgggtaagaagttttttactgggtaagaaaaaacattattacattttggaataatctccacctaagctatataaggctactgttttagcttttggacaaatatatcggaaattattctacatagttggtgaggttttttttttttttttgcttggtgagttttctgttagttggcttaatttgtttatattggggatggtttgcctccaagcatagaatgtaaaacttctaattcttttttctatgcagatgttggagcggatgtattggatt

SEQ ID NO: 69000 - DNA, 1088 bp, Homo sapiens
gattgaattacttttcactttttttcttgctatataatgtgtttttgtatttaaattgccttccattagtagtttttgtcagggcatgaatggggaaaggagtagtgtggataaatactatgctttttatttttaaggggggatgagaatgttaagttgttttaaggacatttgtcagttatcctaaatttaaagaaacctttttatctctttaaaggattcatttattcattaatttatttattccttagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacaggtgagtatcagttaacattaaaagttctgtagtaagtacaacttctgcgtgatccagtcaacaacatatagaaatgtagccatgaggaagaatttatcaatgaattctgccgtaacttcgtaacttgtctgtcttcatgccactctgttggctgtaattcttattaatattctctatagcctccaacacagtgccatctgtgcctttggcagtgtttattaaaacattaatacattaaaccaatgtttctgctttgctgccctttcctaaatatgtgaccttgaggaagttattcaaatctatctgtcttagtttcttccatgaaatagggatcatactagtatttacctcctaggggttactatactattaatattttcataaaatgcttagacccagtgcctggtacagataaaagtatcagttaagtaaaataaataatgaaatatataagaaaaatgtgtgactataacaatattcagtataatttctttccctatgaaaaggtagtaaaataatgtatttcacttaaggttgacattttatttggtaaaatgggtaataagttgcttactatttctgatccacttgtgattaagttttgttaatgaaaatagtgcaagttcttgcaaaatctattttaagtattttgctttagtatataatagattttctttttgtcagatcttttact

SEQ ID NO: 69001 - DNA, 1017 bp, Homo sapiens
aatttagctttaaaagttcttttctacgttgtccatgactagaaaattttgtcacagaatagcaatgacttctggcaagcattgatgatctgaggtatttccaaacacatttttgaaaatggcttaccacactgagtagagaggcaaatagagtgggaatggagcaatgaaattgggtatctggtaggatttaaaggatttgagaacaccagtgaaaatgaagagcagatttatcttaggaaagagcttgaagggtagttcctacttggggaggtaaatgtgttttggattttagaggtggaacagttttaagggttgaccttgctcatgggtggctttccatagaattaagatggaggtcacaggaggagaagcgctgttaagcttacatggtaaaaaggttttattgtgaatgaatgctataggataaatgccatcagagcatgaattccaaaggatgataatggagtgggggagaagcatattgaatgatctgggtgctgaagtcattaagcaaattatgaatatattcagatgttagtggaatatagcaacaagtacggaagtgagaatcagtgtgtactgtggtttggagcatagtttcaagttctaccacctgctatgtagcctgggaaaattatttgacagttctgtgcctcatttcctcatcaaaaagtaggattaaaaatagtacctgctgcttcatagagtcatttacaagattaaatgaattaatgtttaaagagcttcaaataatacatagcacaaaacatgagagatggttgagaaatatggtaaaacatgatacttctgtaacctgtgagtctcagaaatgactaaggattggaatggaactgctgccaatagaaagtcaggttttataaagagagcagacagcaatttcttttagaaaagctagaagttattggataccttgtttatgccagacagtgacttttacagtaggttggcaagtatgcaaaatggaatgaatttcttggaggtaggttagtgctg

SEQ ID NO: 69002 - DNA, 1026 bp, Homo sapiens
aaacctggaagacaataaaaacgctgatcaaataataaaaagcgttacctatggcggaaaaggaagctcaaatgttcttgtcaggggaaaacgacacaaaaactgaaagagggaaacaaaacaattgcacaggtgatatgcattagggttgttagggataatttctgcgcccaaggctcttattagtaatgaaatacggtgtgaggagctgagattcgttctgcagtctcagtgttagtcggaaagtaacccctcccttcccatagaaacagaaccggactggcggcgcgattacacctaaaacaagttgcaacctcatttccctgtaggcacgcctcttttatcttaaccacgcctcttcattccctaagcacgtcgtaagcaaagggaatatcgcgagatctgtacattgtctcttttctgacgttttcagctgtgatagtcgcttttgttctcgcgatatttccgggtacgcgggagccccggcgacccgggcttctgtgaaacatggcggtaggctgggaccataacacaaggtaaaatactgaaacaccgctgggtgctgttccctcggttgttccagggctgtttagggcgtaaatgcaattgagggaactgggagcctgtcatgggcttggcttcctgtcttcattgatctctagagagccggtcggacggagaagccgctccacctcccacgggggcgttactggcaggaccctaggcaacgatgctactgggagcttccctttgccaggtccgggtgcttgtgtgctatcctgcaactcgaaggagttcaggtgcttcctcgatcgcacctgattctgaccctttgcttgtcacagtgcccggttcccaggtggtttctccagtccgcaggcgagtaggatcccaatcggtcgagtcccagtcctcccggatgtcagactccctacccccattcagacaaatgccacattcgtggcagcacgttgccctctgtctctttaagagtcttggccttgcccggaaggagtttcgcacagt

SEQ ID NO: 69003 - DNA, 1054 bp, Homo sapiens
gatttaaattttctgattcattgacctagaagtctaacaacggcataattatgacaactgcttataattactgtttaaaggctttaactgcttttttaaaaaatctgcgtatcctcacaacactcttagaagataataccagtatttacctgttttataaatacggaatttgagtcaaggggtagtgaagtgatttacccaaattcagaccgctgggagagtcagggaaatcttgatcacaatactaaactgtgcctcaaaggaaaaaaatcacattgttttatgtagtgaattaacctttactgaaatactaaatttcactaaattgaatatcccccaaaataaggactgatgaaaagtttccaatgaatcaattttattttcagactttcagagttagtctaattaaatcaatttaaagttctcactttcttgacatgcttaagaagtatagtgtagtgggtgaaatcatagacactggagacaggacttcctgggttagaattccagatcagcaacttactagcatgtaaccttgaccacattatttcatctctttgtgtctccatttgctcatctgtaaaatgggcatgataatatctcagagttgttacgaggattaagtaaattaatatacatctaaaatgcctttttttaatctttgccgtaaaggcatcagcaactcttccttctttgtgaatatgggctcttgcttggatggaggctggctgttgttcacttagttacatctgatccctcatctcctggataacctactttcagggtaacaactatcccatgagagttggatttcccagtgtagcaaaactgactaatttgatccttcttatttagaaaacaactcaccattttctaatctacccagtgaagagggaacttaatttcccctgaagattgaaactctcgggctgcagctaaagccgcattcttttcattaaaggccagggtttgatctaacagtagcacgacatctctgcaagcgaggtcaaaggtttgccctagaccctgtaggacatctatgtacctatcagga

SEQ ID NO: 69004 - DNA, 1044 bp, Homo sapiens
tgttttgaaataacttcaaacttatgaaagtgttgcaagaatagtaaaaaatttacatataccctttcatccagctccaatgatttgtaacattttgattcatttatcactccattgtgtatgcatatgtagatgtatatgtacctacatgtatatgtgtgcatatttagatatgtatgtttgtatatacctattattagtgtgtgttatttttttcctgaaccatgtgggaattagttgtatatatcattcccctttatctctaaatacctttgcaaatagtttctaagaaggacattctctaacataaccacagtgtatttattagactcaggaaaattaacattcataccaacaaaatttttatttcagtgtttggaacttcactcatccttttccttagatgtgcaataaatcaaatttgttatcttgctgtaaacacactgttctgatgaaatcagaggaaattctttctcttctgacttatttggtcaaccttttttaaaagccacaagccatttcactggatatatttagtgtttctgccactcactcacaaatgcatgcacaaaactaaataaagaaacaaacagcaaaaagtcaaaacctgaaaactggtgattcagccttctctatgagtcactaaattgatgctgagcatgtttgtcaggagtgcgttctgaatgcttctattcagggatgctttatttgataaggtaatgaagtctctgctaagccaaggtccatgtggttttgtaggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggtaaagaaggacattgtttagagttctttggattcataggttaaacatggggtgcacctaagtgattctccagtttgcgtgtttataagcctgggaaatcttaaatcttatccgtcagcatatcctatctcttggaaacttttcaca

SEQ ID NO: 69005 - DNA, 1050 bp, Homo sapiens
agaaaacaagctcctaagaagttaacagaggtccaaacaagttatccttgtttacctcctcttgcctgttacaccatagagccaagtggctgtatctcagcataggtcagtcatagaattcagtagattaaaataatgataagagctaactctgaaaagctttccagtttacagataagtttcttttaatattcattatttaatctttaaaacgatctattaggagatatattgccttcctcatccccattttaccggtgaggaaaccaaagttcagaggttttatgtgaccttggctcaggccatggcagagccaggattgaatccctacccttgaactccttttcctgttcactttccattacccacgtgcccaaatagctttccaatccaaacattacataatattagactgtttaatggcatgcaattgccttttgggagaaaggaccaccctgcatctctcttaaagaaacagcaaatttgatttccatcaccctgaagttatgttgctaagtaacagagagagatgacccagaaaatagcacttagataactgagctttatttctgcttaccttaatacatttctgagccatagcaatgggtcaaaggcaagaagaggataaaaacactttcaatttgatttgacttaatctgttttactatttattcactttaagatgtacacaatattgatttctccattgagttaacttttgagttattgagttaactttaaaaaattgtatccttctttataacctggaacttaatgctcattctgagaatccaagttatctctttagatgtgaacagtttatatttgataatccctgagaggaagcactatcattattcctgtttgattaataaggaaactaagatttggagaaaataagtaacatgccaaagtcctttagtaaggaaatagaagacacagaatggaacctagacctgctctagcccttctgcccctaaccaccgcactctactgcctccttgtggcccacctgaaaactgggctacagcctgcagcatcactgcccag

SEQ ID NO: 69006 - DNA, 1107 bp, Homo sapiens
ttttttaaattcaatacatagctttctaatgccttttacatttttgttcagaaccacaaaaataaagaaagttcatttctaactttttctatgtcatcataaattcctgtaatagttgcattctaatcaggaaaatatttattcaccaacatttttctaatttacttaattaccttatctcctcactagtgcttgcttaaagtgaatagaaatttttgcactggactgatatttttcaataaagtgccttctaaaaggtttttgcttttattttttaaacattttaatacacacttatgcagaatataacttacatttccaagtaaagttagaaattagtttattctcaattagagtaaagcaatccgggagcttcatgattcctcctcacttaattctgaaaggtaattgctgttgtgagagaagacgttttaatctcaggaactggtgtttgcaagaaggatcagactgttgattaaaaacaaatcaaacaaaaggctctgtgcaaaaaaaaaaaaaaaaagaagttcagaaccaaagaccagaaatctaaaatgtcagtttataaatcctctgattttaatcggccttcggtgctctgttcattagtacatctggcagtgcctcttggcaaagaaagtttggcatgggaaaaagcaatgtttaaattggcttagggaagacatcaagtatacaagtctacttttgtctctgagggggtataatttcttcattcatttccccttttaaaaatttactccctgtgcatttatgagtaaattttagagctcatgaaagtgaggaaatgatatcaccagcctgagccaactagagagtgtgggttggcagctctgcttttgagatcctgaacctgagccattttctgtcccaactcagtgttcacattattttcagacaagaggaaaaaaatgtaaatggcacctttccgtgtctacatttgagatgtgggttgtgctcatgtcacaagaggactgtccctaaacatctcgcagtgtgaccttgtgaccactggggccggaatcagggtccctttcaccaaggtgtgtggcagctgtaacaggctctgagaatcggctttaacttttc

SEQ ID NO: 69007 - DNA, 1040 bp, Homo sapiens
gtctcacctttgcctcttgccagccatgagatccctgagtaagtacctcctccgcctcatttgcaagacagggacaagtatggactcacagggctagtatgaaataaaaatggtaaggtgcttagcacagtgattagtgcctattaaatggattcagtacctgccatcactaatgaattgaaacttccctgggactgttaatgagagacaagggtgatgtctgaaatttttgctattagttgtagaaggaataaaaaactagggcctccaactaaattaatcatagagggaataaaaataaggtcctctaagtaaattgatgaagcttaaactcattgacctttgacactgaaacatcatgacctttttgcaggccaagtaacatttctgggcatcatttttttccctcattataaaactacatgagctgttttgattcctttcacctctaactttaatttgcagaatggttaagagaactgaaattattttctcctatggcttctttgtcgtcattttcaccgtttaatatatgataattgaagtaactgtttccttggaagtaacttgaattcagagtttaaaatttctggaaggaaaatttatcatagccttagaatggggtattgaaggtcagtctgagtttctgagtagatagaactgaaatatgcatcattgttttcttagaatagtgagctcctttccttcagaatctttatttgaatatcaaaggagacatcaaaggttgttcgactcctccatggaatgcctttgcctattaaggtttagacgaggcacttcatgggttcaaggaaagtacattaaagagagaacccataaacacttaagtttcctttattgttaagtgtcaaaagacacttaaaattcttttgttgtttttgttaagcttttgctttttttctgatgtgagctgtgtctttgctatattctgatcaactgagaaatcttttttcttgagtttcaaagagaagcagtaaatctgcatttctgttgaaaaagctctgattccaaaacatttt

SEQ ID NO: 69008 - DNA, 1051 bp, Homo sapiens
tggcccctcttgcctacccagactctttcatcttctctgtctcttcaggcctaggtctttcccgcagcttcccttccttttccagcccatgttgatttctttctttagtacttgatcacatgcacccctcctgggtagtgcagcaagtgtaaaaagggccctatggtgtagcattgagtgtgaactcaggaccagaatgcatacattcaaatcccagttctgctaatggctggctttgtggtcctgggcaagtgaattcacttttttacacctcagtttccccgtctataaaatgagcatagcaatagcacctgctttgtagttgtcgttgttgtatgcacttaaagaattagcgtgtttagaacagtgtctgtcgcacagtatgcactcaatacattttctctgtaatttacaagttaaatgtatgcatgtatgctttttctatattgcttctaagacttaactcggtgttcaacattttggttgtcaaattgaatattgctgtttcaatagtttgactttttttgtagtgataaagttgtagtagactttttgtttatttcttttatttatttatttatttatttatttatttatttaagatggagtctcactctgtcgcccaggctggagtgcagtggtgcaatcgctgctcactgcaacctccggaggcctcccaggttcaggtgattctcctgcctcagcctcctaagtagctgggattacaggcacatgccaccacacccagctaattttattttgtatttttagtagagatggggtttcaccatgctggtcaggctggtctcacacccctgacctcgtgatccgcccacctcagcctcccaaagtgctgggattacaggcgtaagccactgcgcctggctgactttttgataatttcttaaatggatcaggtatatcttggtatcctgaattcctatccttttttttctttttttttgagacagagtctcgtgctgtggcccaggctggaatgcagtggcacgatctcagctagctcactgaaacctccaccttctgggctcaa

SEQ ID NO: 69009 - DNA, 1002 bp, Homo sapiens
ttttgttttctgatatatagtgcaaaaataaacaaaaacagtatttaaaaatatattcttcatcttggcatttgactcttgttcaatatcctttcttggtgatttttctctcgttgtagaactagtctgaaaggatattctcttgacaaaacaatattttcttatactcctatgtttaggagaataagaaattacttcattttctcagaagaaaatcgagacgaaattttgttgggacttggcccttgattttagatgctcatttcaactgcaaagcttcaaactttgggaatctctcttgttgcagaggctctatctcctattatataaaaacaggttagcctaagggctcaagacggtacattctaggttgatatttgggtttgtgtgtgcttctggcatggaaaatatcttgtctttagaatgtatttaacaaacgcaagttttcccaaggacctgccagtcagcagttggtgttgactttgggtatcctgaagcactgtttggaaatgtgcattgtggctctgtcctgaagtgggctttatgggtaaaatactttaaaactgggagtcaatgggctttagagaattccattgtgtgcaatattggtttgtttttagattttcaaagggggctcagtggttaagagctagtgttttggatgatctctgaagtgacttcgacaaattatttgttcctctgacttttggtgtctattataagagacatttgctctgcgctgttcatgtgcatttatttaataaataaagtgcattaagttttgtggtagctttctttaatttatcattccctggctgtattcactcattcatttattaaaatcttgtgccaggcacagtaccagagtaaagcaaagtgaatcagagcacctcattatatattcattctgcaattctgtgcttttctgttttagctgttatcacattttctgtatgcatttgtgtgttgtatccttctggaggtcaaggcttgtcttgtttc

SEQ ID NO: 69010 - DNA, 1045 bp, Homo sapiens
taaatatataaaattataaatatataaatataaaaataatataaatataaaaattataacataaatataaaaatataaatataaatataaaaaattataagtataataaatataaatatatatacattatatacaatattttatatatattatatataaggatatatatattttatatatatatatccttctttaaaaatcatcttctaaaggttcaggtagatcatgacaaggacatttgtgatctaggttgatgacaaatactaggcatccgccttatttggtttctcagccacatgtttcctgagagatccctgaaataggagtgtggttccaatggctgcaaggaaagagcagcctgcagactaattggcatgcagctgggagcaagagcagccaaagtgacttacaaaagatctgctgtgtcctaacaggcctggagatttcctgcagaccccggcaaagtggttcaggctgtgtttggagtagctcagtctgaaagccagttagattgtggcagctgcttgattaaagaacgctgttcagtagaaaagagggaaacaaacgagaaaacagaaatagactctacgtactgattgtttgactagagacagatagagacccattaccagtgagtctaacagggtatagcagtatcagaacaacctaactttggctggtcatttcactttttggcaaggtgtttgcctcccatgtgctatggattttctctcggctttattttctctcaaatgatggtgagactcatgttctgcgattggaaagcactttaggcttttccctgttttcatctctatagttaaactcctatagcaacctcaagaaacctatcctacaggttagtgcacagtaaagagtaagacgaattattaaaagccttttaaaacacctgtaaatataaaggcattaaacaaattttaaacacattttggaaagcagaggcatatctagaaaagtgttgtcaagttgtgattggtgcattaccatctggcatcttgttcctacccaggaaagaaggccagag

SEQ ID NO: 69011 - DNA, 1019 bp, Homo sapiens
acagggatttaaaaaagttcctgcttcatattaacaaacactaacaaaaataccaacaatgtgagggccttttgaacaaatactgaatggcatttcccattctgattccttcccgttttataccctagctgaattagtactatgttgagagtgaagactttggaagctaacagctgttattattactgggtttcctggcttttattctaattaggaacagctgaagaaagagcaggtgaaatctttgttggcctcaggaaataattaaattgtcttagtgctcgtagccaccatcctcgctgcagatgacaatgctgtcatccggtgatccttctcagggatggttctaaatgtagattctctgcttgcttgcagtaaatctgacttttggagaaggaaaagcgggagagaagaatcaatagcatctcctggtctctaggcatgggtattattttgatgaaactttcaagcaggtgtggaaagatgaccttgcaaagcccaaactcagaattttaagtgacacatattcctaataagacatttagcttaacctgtttgcctcctaagaaatgtggctgttttccaggaaattcatcttttaaaaaagcacaagcatgaatattcacctgtggtgtagttctttggcagctggtgggaattaggctgcacgcagtggtttgatctgtcagaaaagccacaaagctcaccttcctgtgtttattttttaaatctcactttgtcaggtaaaatattttcagagtccttgagtttgttaaatgaaaatgagtagatttggatccacatctatatgctgcttgtttcaactgcacccttctgcaaaggctcagagtcacttgtgtggcttacttccccccatcccttgttctcgttggcatgtccgctatatgtaatcagcaggctcttgctgaaccccatagtaagcacttctgattcagggttgaggaaaagttttaatgagaagaggaaattatatttatccctttagaagggcatctgct

SEQ ID NO: 69012 - DNA, 1025 bp, Homo sapiens
tgtgatgatggggagagggaaaggaaggaaacaaggatttccaagtttctggcttaaccaggtgggtggatggtggcattagttactaagtggaaaaattaggggagtaatagattttctgggggttggggagagaataaaatcataataatgcatgaaattcccaaggaaaagggaagaggaataaagggttaaaacactgagaaaatctggacatttttgttgagggccatggagggaaagaaggtgaaacaattggggaaatcgtgaattttttaaatggaggctaaaggagtacagagatcactggagatgtttaaggtgggacagaagctaggctgccatgtgactatgaacttggttagggcaggttcatgccagggtgtctcatagatgtgttgccagctcctgtcacagtgtctggccgataacagctgcttaaatatttgtgacatggatcagttgatgagtggatgataagaaagtgttggaaattaagcatagatggaacattttcaataaatttgccaatgaagaaatggggaaaaggttgttagtgggaggaatgttcatttttcttttcagacgtgtgtgtgtgtgtgtatccttagataacctgtagagaggagagatgaatgatgctggagcagaaagggtaggaagaaatatgaattcctctggtatgctgctaattgtttaataactggctctccaaagaacgggactcctgatttgtagtgtttgctaatgtaaatactcccactgtggctgattgcaagctacgagtgtgacttcactgaccatggagttgtgagagctgtcatagtccgccatgatgccatgtttctaccagacggatgcaatagacataaataacctcaaaagcatagataatagcaaagtgaagcaaaaagccaactcaagagtagtgagctttgaatatgtactaccttgtttaaaatatgacatatttaattttaagtttatttacttgaatttttaataatggctgttttttaagtaag

SEQ ID NO: 69013 - DNA, 1048 bp, Homo sapiens
cggctcgctgcaagctctgcctcccgggttcacaccattctcctgactcagcctcctgagtagctgggactataggcacctgccaccacgcccggctaattttttgtatttttagtagatacggggtttcactgtgttagccaggatggtctcgatctcctgacctcgtgatccacccgcctcagcctcccaaagtgctgggattacaggcttgagccaccgtgcccggccagcaatactttctttaagatgttctgagtacagacatttttcataactgtctgccaaattgctgctgctgagtattcaaccagaaaaatgaaaaagaaatgtagtgataattaaattaacaatttctcatagacctttagcatgtgaataaatgtgttagaaattcgcatcaggtgctgtgaagatccaaatgccatcctatcctccacctgctgtcattggctccagcagcgtgtctaccataaagagttgcttaaaacaacagtctgtgaataccttagatttcaaaagcatcattttaaccaaactctgtgaattgaaagtagttttcctgaaaagaaatattaaaatccattccctcacattgtaagttttagaagtaaaatatgacagtaaacagtttttccaaagtgcaatgactaactttttaactttcccccacttttttgccacttaaaatgagcaaagacatcatttttttttttggcctaaaatattttactcccatttctggatttctgagctggatttcaattccaagtcctaaaaggtatcccaaatgaccatgtgtttcaagagctaatcttctctttaacaacttcgacctcgagaatagcctcataactctggcttaatggaaagtgttctcagtaactggccttccctttctctaatgattctaagttttgttaacttaaaaaaaatcactcaattataagtttggaaaagagagaaggagactttactttttataaagggttttagcctacaaggtggccatcctgcaggctgggaagcatgcctcaggccaagacca

SEQ ID NO: 69014 - DNA, 1033 bp, Homo sapiens
atgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgct

SEQ ID NO: 69015 - DNA, 1092 bp, Homo sapiens
gcatttttgtttaatggttttaagcatattgacagttttttaaagtgggaaattttggatcatttgaaccttaagacagtagtttaagttgaatattagaatatacttgatggttgaaataggacatttacacgaaaaatgtaacccgtcatagattttaacttattttaaaatatttgataccaacatatgttgaaaaattcaaaagatgtgaaaagaaaattcagtgaaattttaccttctcactcaactccccagctatctaattctcctctctggaagcagctatttttttccttttttttaaaccaggttttcgggtccttctagagatttttctattaacatataagcaaaaagtgaatgtgtatatttttcttttacgaaaatgatagcatgctatacacagtttttatttgccatttttaacttaatatatcttgatgatccttccatgtcaatcaataaagttatatatttttaatggttgcttaatattcccttgtatgatgtgtcaaatttatttcaccagtcccggtttagtggatataatttaactgtctcttgtttaaatgggcatttgattgctagtaatcacaaacattgctgaaatgaatgaatggccttttatgtgtcattttgcacacataatatgtgtgaagggtaaatcccttgaagtggaattgctggtttgcatcgtcatttgtatgggtaagtttgaaggatgttgccaacttgtccttcattgtgtataccatttacactccagaaatcaatatacaacagggtctttcttcccagccccataattgtgatcatttccagtcttaataggtgaaaattgttaatgttgcacttggaatttgtactcttaccatgtattataacgaacatctttttataaacacaggcaaagattataaaaaaagaaacacatttgttttctattgtatttcaatttttaaaaattcactaattttatgtaaggggaatttgatctttgtgataccatttgaaaatatttcactcatttttttttacttccccatgccccatgcaaaattctttaattttttagtcagatgatttcat

SEQ ID NO: 69016 - DNA, 1054 bp, Homo sapiens
agtcaatgacagattgcatatacgatggtgcactcctaagattataataccgtatttttactgtaccttttgtatgtttagatacaaataattccattgtgtcatgattgcctaagtattcactacattagcaaactgtataggtttgtggccttggagcaataggctatgccatctagatttgcctaagtacattcaatgatgttcaagcaaggatgaaattgcctaacgacacatttctcaaaatatatccatgttaagcgatgcatgactgtaactgaaatattgataaaaaaattattctgatattactatagttcattagactttaatcacatttaggataatttctttcatctagaatattctgaaattttataatatgtgctttctaaagttttaatttctgggctttgaatcaggaagctcatttccttcagtttggggcaatttattgttttacttttttgataaatttctccttactatttttttttctgtttgtatttcctgatatggagaatcacatctggactgtgtctcttaatttttttaaaaacttttcctcctgttttccatgtctgttttttttttttgtttgtttcattttctaagtgattcctcgacttctcaatcttctattgcatttttctttttactattacttgatttcacttgtcctagattgtgattttacttgcttagtgacaaccagaagttaaatattagctctctggatataatagttaatgtaaatagctatatttaaaacatgacaagttctgttattttaagaagagagatgattcagtcagcaaagtgcagacttcaaagtttgagcaatgcagacttcagatgtgtgacactgccattttgctaacttttgtaaagcggggacgtaacagtactactaattgcggaatactttaatgttattttcataggctgagatatttggcaaagttcttcaaagtgatgaatatgaagaagttgaagacaaaacagtaatggctatgggaattttacataccattgatactatcttaacagttgt

SEQ ID NO: 69017 - DNA, 1024 bp, Homo sapiens
atctttaatttatcacattagttcttgtatctattaaaattttagtttgtcttaaaatgtgcagtattatttctcttgtccatatcgtgagacaaagtattttgacatttagcttacatacataaatgcacagaacttaatgactagttcagtgaattttgacatacacttgtgttatcacccagataaaaatgtagaaccctttcatcatctcagagtgtcctgaaggaaccatggtgttttgtattttgtcctctacttatttaggccttttgaagacaggaggtaaatgtgaacagcagcattgtttagttgaaatttactttgcttatttaattcctgcctagcaatctataaagaattttcatttgtatagcaatctaacttcacatttaatatgacttaacctatatcaagatttatcttgcctttgttattcacataaatccttttattatgcagaactttaatctgggtaattttgtcctgttaggagactctgcacattgatgaggatgatagaccagaactggtatggtggaagtgtaagaagtgggcactgcatattgtagctcggctctttgaacggtaattatctgtttattacattgatgatcatacagccagtatctcagtatcagatatgattatctgtctttagagccaccgagagccaagagtcactctgtttaaagtagcttaattttaatcattggctttgagatcataatgaagtgggtggtcttctctggatcttttctattcttctgtgaaaaacttggaaaaataacattgttcagcccattggtaatatctaagaattatgcaagaagttgcatggtcactcaactccgtaataatgtcaaatttaattttaaaagcatttattgaaaaaaatctatgtcagttgtaacattttaatttccaatattcaccctttaggagctcttggtttagcaagtgaaagcttctgtctgaaactttacagtatggcccatagtctaagtacaggttatcttgattt

SEQ ID NO: 69018 - DNA, 1056 bp, Homo sapiens
aaagcagaaccagggtaggtaaacctacctgctctaaaacctgattactcgcaactatctgttctgtagcattcctgcctatagattagttatgattacaagagaagaagaaggaaaagaagaaggaaaagaagaaggaaaagaagaagggagtccctcttctattgggaaatcatattgatggtagtttctttgcatttgactcaaagctaacagaggatttagggttcattttccttggtttaaaatactgcctaaaaaaaaaaaatctgaatgctataagggataccaacatgggaatccggaaagaaatgagaagatagagatggaatatgtttgaaatataaaaatatttaacatcaaatccttgaaagatttgggtaaattatttaggtctgattggaggaagaataattgttttcagtcttaactgtttgatgaatgaattaaactctattacatgctttctagttgaatttgtcgtgagaagaggatggttttgttgagctcaaaaaccatgatagtttggatccatccttggctttttattgacttagatacttaaactatttcaaaatattttactttaataaagatttatatttttattaaagcttccccttttaaacttttaatagggatagtctgaggcagatatttttttttttcccccagagcagcctttttgcagggaaagagaagagggaaggaggcaaatgtgagaagagaagaaactagaatactaggaaaatatgttctctcacttgttttgaaataatattcagaggccagacttcctttttctattggcagaaacagctagaaattgggaagtaagacaaaggctaatgaaataatttttctaaagcctctacctctaattggtttgctaagacgacagaatcttcatatttttctcagtctatacttgctaaaaacctggaaaacctcaacatttttaaccattttggtaatctgttatgtactaatacattaatattctcctctgggaagtagaaatttagaaggcattaggagccactattacaatgctga

SEQ ID NO: 69019 - DNA, 1549 bp, Homo sapiens
taagggagatactagaccactagataggctatggaaaccaattgcaaattgaattaaaagggtgggtgttttttaaaaatctgcttgacactagagcatatttaactttatatattcactatgctgatttcgaatatttttcatgtgatgattcacgatggtggtttttgtaataatgggtacttcttactgtagtgtcactgcattaatagattcaaataagcacaaattaagacaccgtgacttgagacaatagcagaatagttataacactttttaaaatgtgaaggaactattaaaagtttgtataagggagaagaaaaatcactgaagagtaactttggcacaggaaagcaatcttttccttctgaaaaaatagctagtattcaatttgcctttgccttagtgtgagcagtgtttttgtatggcacttaaaacattacaagtgtatgacttggaaataaaaaaagcattcatcatcatgggacttagttccatatcaatatatctctgaatggctagtggctagtagttctaaaaattggttcttttatgtagtctccattttcttgagaccttctacattaggtgctttgtagaatgacctctgagaaattaagaattatgggaggaagatgaagtaaaaagtgttcagacctgagttttagactttgctaagttatctggccttttgggggccacattttcttaatcttaaaaaaggatcagttagacaagattatcttggacctttctggctttagaagagtatgtaaaaacctattaccagaaaaatctagaaaagtataatctagctatatattgcttttgttttggaatttactataaaatgtatctttgtctgtttcagtagccgactaatgttaaatattgtgttcaaagctaactgcttcattatgagaaactcactgttgctaataaaacagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggt

SEQ ID NO: 69020 - DNA, 1020 bp, Homo sapiens
cttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtgagtatgaaacatgaatgatgattgcagttcattattcctgttaaaagccattgtttctcttacataattattggatactatgtgaaaagtttgccttttgtaaaatttatttgggttggtagaattatatttggccaatggcagtacttgtttgtggcagaagaataggaaatccacagcctctagaattttaaatgggtgttttatcagagcattattcct

SEQ ID NO: 69021 - DNA, 1756 bp, Homo sapiens
tcctaaaaggtccaaaaaggactgatacacataaatgtgaaagagtaaaatgttgaaatgaatatggacatcaatgattggtacttcgctactcatcatggtgatattagcggttctagacatatcctggatttgggagtcagatatttgacccccttggctctggttacctgagacaaaccagtttattactcagtgacttctttagctcaaaaaggagacagactaaactggtagtttgacagtcatgagatttatcatctaatctcagctatttgggtttagactttgtagatacgtattgctaatatgggatggtagagaattgttacccttaattagccatttgttttaacagctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgaggtaagctaatgaaaagattttcctgaaatgaaacacttgacactttagctttttaggggtgtgtgtatgtgagagagagagtgtgtgtgtgtgtgtgtgtgtgtgtgtgtgtgtgtgttagagagggggagagagaacttaagaaagtattaatttgattcaatatggaaaccttggctggcccagagtctgacagggttgacagattgtctggaaggaaagtgaatgtgaatggtctcattaacatgcttctttattgtaatactgatttttaaaaaaatgaggtctgagcatcaaattttaatcctgtacaagtataatattatatctatttctaaaacttttaaagtaattttctcagagttgccttcttactcctgctatacttaagtagaggtaaataatatttaacttggctggtgtcattaaactttcaaagtaacaattatttggtgttcttattatgctgtgaataactagtgataaatacatttgatagtttaaaatacaaaacctgcaaactggggctgtctgattttttttccctcacagtgatccattgctctttttgttttgatggagtaaatcagctaggggacagatgctgtgctcttgctttgttagatgcaggctattccagctttgtatttgttagccctactaaagtagagtcagatttcaacggttaccagaaatcagtctctgatcagaaagaagcctaatagaactcttaattgcctatatatagccatgtattttttaattctcatgctgatagtctactccatcgtcatcatctatacattgcctccttcacttttgtgggttcagggaatgtagcttcactttaatatatgaaatataagcaaaacataatttgttaaataagctgctttctttaaagtcaaatgcggctcttaatatttcaatttcactgttcttttatgtagggcatacacctgaactaatgatactgcattggcagctttaaactctttttggtctattctttaatgggtttatttggtaaaatccatattttagttgttttaaggaaaaattcttacatttgaaatccttaagcaggcatttagtcatcttgtatacatttcaatttttttatttccaaagagcaaaaagacaaaattaacatttgaat

SEQ ID NO: 69022 - DNA, 1621 bp, Homo sapiens
catataagttaaaacacataataaagcaagcaccagatcccaactctcaactcaaatagtatgtttccaacagtgttgaggctcctttctcatgtggtaccttctccttcctgtaaccatgaccctgaagttttcccttgcttttaagaccattttttttttttgctgccctgttagagttgtgttttttttgtaccttatagaaagtggtatcatgctatatattctgcagtttgcttttttcactcattatatttagtatttttatatcaatacaagtgcctgtatttggttctctctacttagttttagtgtctgaatagatggatgcttgaagttttggggtttttttttgtcactgaagaattttactttgaggaatcttttaggtgttactgagaatcaggagtaagattttttttcagggtacatatctatcattaggctgtaggacatgctcatgattaacttcataggtaaaaattctgaactgttttccaaaattattgtaccaatttatactaatactgttattattacataggagttcctattgttctgtacctttataaagacttaatatcagtctgttttttccaacactattgaggtataatatacttaacacaaagtaaacccattctaagcgtacatttgtttatagtaaatttgtagagttatcgaactggtagcacagtctaattttagagtattcctatcatccccccaaagttctcttttgtgctctgatttactttctatctttaaaaatttgtcttttctggacatttcacataaaatagtcttctgcatctggcttcttttacttagcatatttttgaggtttatccatgttatagcatgtatcagtatttcattggtttttattgctgactagtattccattgtgtgggtgtaccacattttgtttatccacttaccagttgctggatatttggattgttttcattttgggccattatgctgctgtatacatttatatacaagtctttatgtggacatgttttcatttcttttgggtagataccttggagtgtaatactttactattttaattactgaggctttataatatgtatttatccagttgcacaggttctccaccttgttctgtttcagattggtcctttctcttccgtatagatttgagttaaagtcccatgaaatgcccccctcttttctgtcaatgttgtttatctgggaaatctttaaaaaaaagttttgctcctttaaatttcctgtaggacattgcatattgtttgttataatatttatttttgtctgttacaggtaattattctaaatctttccactgtattataaatgtcttgaagttgcttgttcatctctctgatactcaccgtgctatttgtgtaatatgtttgagtagtgaatgaatattaacagagaaatcctattggctcagtgctattaaaaccaacaggcctttctgatcttagactttataggggtaaaattaggactcatatttctaatataaaaattgaatttctggcattagaattgaatttttaaatgcaacttaataaaactggtattaatactctttctcctttttcattaggcaagtacttttttt

SEQ ID NO: 69023 - DNA, 1209 bp, Homo sapiens
ggcgcggtgggcgggcctgggcgcgagcggctgagtcggctgggtctctggcgccgcagaggccgcgggcgaggaccgggaggggagagggaggagacaggaggaggagacgcgagtgcggggtggcgccggtccacctccgcagcgctcctgcctcccccaggctttggaaggcgggcccgggctgcggcagcggcggcctcggctgcctggggaggtgaagtcgggctgcggcggcctcggtcggcgcggcggagggaggcggctgacccggcgagggtgggcaggtctgggcggccggcgccgctgcgaggtggaggggcggcttggcatccccggggcggggcggggctcccgagggccgcggtcggtgcgttttccgcaggtcagcctcccccggggccttgcagaagcggcttctgcgtacccggggcggctgtgggaagggtgggggtcggtgcctgcagggctctccgtggccgctcgggagaggtgctcttcgctcaggctcccccggagacttgagggggtgcgcgctggcgtgcatggggcctgttctgtccttggtttggggatgctcctaaggggggagaaagggatacctcgggtgcttggaggtcgagagacggatacgtaagtgcgcaagggccactgattagggcacgggaagggctcgctagaatgagctcttaaactggttgggtgtaagcggttttgggctagtctaaaccaaacaactgagaataaacgcggggttcctgcaggttgagagagtacctgtctgcaaatgtccagtagtgatggattgccttgtaggccccagagcaatcggggaagttagcattcttgttcaagaagctgctggttcacttagagctataaaagaatgttgtgagtttggattttcttccaaacgttcaggattgaggttagggctggtggtgagggatcatgtaaagaggtttgagtggctcagccttaggtcccggtgtggaaagcttattcttttggtgtcatcacgtggccgtgggaattatttagaatgtgatctgccctcatgagaagaaaggagctctgaagccgttgcagttcttcctccctatgtggaaaatcgaatttctggaaacatcctccgtattgggagattttgcctatgtaaaggctatccttattggctagcggcactaattactttaaaagtaggatgga

SEQ ID NO: 69024 - DNA, 1037 bp, Homo sapiens
agttgtataagcaggaggaataggaagtatgtctattccatcttcttcacttctttaaaaaacacgttagtctgaatatcttcaaatatcagtagtgcatagaaaatgaattattttttactttttcttttttaccaactctttcacagtgtcttatgctgaggtttagttgcaattacatgtaatgaaattgaaaattttattttttctcttaatctttattgcagattctgatgctcacagtaccacctcaagtgcctccccagctcaatctccttgttacagtaaccagtcagatgacggctcagatacagagatggcttctggttctaacagaacaccagttttttcctttttagatctcacttactggaaaaggtaaaagaaacaaagtatctctctaaccagcaaaccatcttaattatgggcagtatttttctacttccttagcaattaaatggcatttggcaaacagttggtaacacacgattgcagtggattaagcaggaattgagcagggaagtgggatttttgtatgttcttcctattaaaatttatttaaaataaaaatcacatcaaggtacctacattgcctattgctagataagtggagtagaaagacaatatgcagtggagagaatcagtaaaactaagagttggtccttcaaaaagacgtgaccaaaaatatactagagataaagtggatcaggaaaaggagataatacacataagcaattttaggaaagagaaaagagacttaggtatagataaagcagacatttaaaaaataataggatattatagacaacttgatgccaataaatttgaacatacaggtgaagcaggtacagtactagaaaaaagacatgttgctaaagctgtctcaagaaaaagtgaaaaacggagataatctcataataaattgattcaggccaggtgtgatggctcacacctgtaatcctagcattttgagaggccaaggtgaggggattgtttgagcctaggaggttaggtttgcagtaagctatttttgcacc

SEQ ID NO: 69025 - DNA, 1700 bp, Homo sapiens
taatttatctttgccttgttttccttctgtctaaaattggagtaacaaaagtagctctattttttgctttgtactaaatataaaaagtatatgaaagcttttcgtaaactgcaaaacattatcctgtagaaatggagttgtttttaggtttgattcttaacctagctgggtcatccagtaatgattatcccatatacaaatctatttaaatttttttccaatagactcccactattacccacttcacaggaaagaatatctttaaaaaccccagtagataaatattatttattcccttatgtcatgtgatgattaaaggtgcacatggagcttcatcctcttttcagtataaaactgtggttctcaaataggcacggatctgaaccaaagggatacactggtgtcattttaaaaatattattaaatattcagtattttcttccaggtggtagatgcaagggctggacccagtctaaagactacattgaaaccaaagaaagtgaaaactctatctgggaacaggataaaaagcaaccagatcagtaaactgcagaaggaatttaaacgtcatagtaagtttgatattacaacattagtacttaataattgttttgttatttttggctgggggtggtgtatggcatgtgtggatcattttttcctttattgctttttataaagagcactggaaggcaacgttgacttggtagagatgttatcttatttctgtgaaatgttggcactttttctgattttgatgtctcaagagagtatttctactagctaaccacttcagattgtactgagaccaccctgatgtctttattgacatcttaattttctagaaggtgcatttctagctcatttacttgatttttatccataaggaaattgagtcctgcagatgtgcaagaaggtacgtaaaggggacaatctgagaccaaagtccagattttctggaaagtaactttagaaatcataacgcacatattgaaattcagccaacctcagggcttgctttcaggtttaaggggcagtgtgtgttgtgtgatagaatgagaaaggaatgtctaattaattaatgtcaggtcacatgctattattggaagttttggggggttgctgtaatggcacatctgtattttggaattgagattttagattttgaaaaggaaatacactgcatataatgttattgtctaataaatatctctattacccttggggtttgaaggagcattattgaaccaaacacattagtatttttacagcaaaaagtagcagtattcacatttagtggaataaatagatggtacataggctagtcaggtttgtctgcttatagtcatagtttaggtcatgccagattttgtggccaaataggttaggaatatactttctgtttccagagctttctcagaattgcggctaggggttgtggatctctattggagctctcagtacttttaaaaaatctatagggccctgttagagagaacattatcaatcaagacatggttatcatgcttgttttagaataatggaaaaagacatctaagtttagtgacggtaaagtgaggagtgcaggagaactcaacattttttgagcattttggtatactaagcactttacatatgtaatctcagttatttccatcttagagctcagaataggaggcacaaagaggtgatttaaactt

SEQ ID NO: 69026 - DNA, 1058 bp, Homo sapiens
ttttcttttcagttatcatatgggtttgttgttggattgagaaaaaaaaatctgcctcatttgagcaggcctctctagatcttttcttatgactgtgtagagggtacttcctcatttttcttcctctcaaagacatcaaattcccaagcatttaactaaaattattatcaactaaaaatgttttttttaaaacagttcttagaggtaactgtttagacttaattattgaaatgcatgaaggccttctgccttgcccccatcccactcttttgcctgcctctctcaccaacaaaaacatggcagaggaacagtttattaacaatagcctgtttgaaagggaagcttcagtttttagctaattatttgctaataaaagttttaaaaaaattttcttttaaaagttgtaaaacctctgtctatatttcaaaacccctcaataccaaaaaaatacacataaaaagcctggatatttggttctgaatcattttcattaatacttgctatattatactaaccagaattggaatggaatgggatcagacgagataatccaaagacaaatacagccatatgtcacacaaggacgtttcggtcaaccacagactgcatatatgatggtggtcccaaaagattatgataccatatttttttgtaccttttctatatttagatgcacagattcttaccattgtattacagttgcccacggcattcagtaccgtcacacgctgtataagtttgttgccttggaacagtaggctatcccatatagcctaggggtgttgtaggctattgccatcttggtttatgtgaggacactgatgtctgcacaaggatgcccaatgatgcatttctcagaatgtgtccccattgttaagcaacacatgactgtactgaagctttaggtttactcatctaagtttatttctaaaacaactttaaaaagatagtgttctgtggtaataactcctaaaactatggacacgaaagtgatattaataattttcttggccgggcacggtggctcacgcctgtaatcccagcactttgggaggccg

SEQ ID NO: 69027 - DNA, 1954 bp, Homo sapiens
acgtcagggcaaagccatgaggaggaacaagccccggcagcgcggcgtgcgggaggcgcggcctgcgggaggcgccgggccgggctggcgcggggcccgttgttccggcgcaggtgagggaggtggcggcgagcgacgcggttcacctcccgctgccctcgccctcgccccggcgagcggcccccgcaggaactttcctcccgacgcgagatgtcttatttaccaacaaatccaccagggagcattcttacttgctggctcggcgtctctctcggcagtcaccggagtgcccgagggggaagcacgatttacggaaggtggggacccgagggccctgggaggagcggggaggcattttactgctttcagagaaacgggtgagggcggcgagcacctcctccccagccgagctgtggcccgcaagtccaggggacccagccccgacgacgcccgataaaccaccgtggggaagttccggggctccctgttgccctactaagggaagtgaggactgtgggcgaattgtgcgtgcggccagtttctttgtgtgtttctagggggtggggggagcggggaagggcaaggtttgttttggtgtagggggagttggtttcttgaggtggtagggcggtgcagtttgttctggtaactatgaccctagtcagtttctttgtttttattttcttcctgtaaccttccattacttcaggcactcggaagattaggatttactcttgagttaaacagggaccctatccgagacagttttaccccagcaattctttctcccccttcttaagttgtcctaaggagggttaagaaaagcttttctttttcttttaataatttaaaaatgaatttgaccttgttattcagagtacgctgaaagcacctgtttttgaactggaatttgccagacttgaaaagccttttaaaattttatgtcgcaaaattgaacacatttagttgcccaatctaaaagtctgggagtttgtttctggtggagtttcggagaaaaccctcatggcatttaaagtatttatataatgattttgggaagggggatcttttttaggcgaaaggtatgcgtgactcagtgtttggtggttattcagtgccttaggatgaccttgaagaagcaaatgtttagggagttgggccttttggaaacattgtaaggaggctggggagctggctggggaggaagctgctcaggaagatgacacagggtaacggctagcttcttcccagatcccgtgaactgtggttgaccttctggttacctctcctagatttttcttttcaagctaaccttttctttttttgtatgtggccccaggcatagctcaaaaattatgctggtttgacacatggatgcttctttggtatttggggtttgcctgtagtctagacatccgatacccaccaccatatctgttgcttctttcctgatttctcctgcatttgaatcatgtgtaaggcctagaatctaagtgatcattactaggaaataatacccttgaatgcccctgcccccacacacctaaaaatcgatactagttgaaatccattttttttcattattttgttattaataaacctatttttcccaagttttggttgaccaaattacaataccaaaaggcaacctatattagtacatttctgtagtaaatagaaagagcatgtcaggaaaatgaaaaactttggacctatttttcccaagttttggttgaccaaattacaataccaaaaggcaacctatattagtacatttctgtattaaatagaaagagcatgtcaagaaaatgaaaaactttggatttaataactttggctttcctttcgcagctatttctctgggtcctgtatttaaaatgcatatgaggtgctttgcaaatacgctgagattgtttgagttgtttttcttaattagtatttcatagctaagtta

SEQ ID NO: 69028 - DNA, 1012 bp, Homo sapiens
cttcggaccgcgcccaagagcctctggtgtccggggtgctttcggagcccgaagttttgctcccggtgcgttcacctgtagcgtaggtgtgggcgacaccgcgagggcttcccgtttatgggcggccgtccgcgctgtaagatggccagggaagccaacttggctggagatggaggcggcggcgttgtgtacgccgcgggagtcagtgaactccgcagggcactgctttttgtgctctacgtgacagaccacgtgcttcgggctgcgaccctggtccttgtccgaatgtccagccccgcgtgagccgtgggatgcggccgccgtcgggcaggtccggccggcaggacaatgtggtttgctgatgatggcgtcttgccagtttaaaaagcagagtgaaagtcgccaactctccgcccgtgcggggcggatactccgggcgtttctcatcaaggacactgcaaaactttgattaaatgggcctgctcccgaggggagggtcggggggccaggctccggactcttcggggcgcggggtccggacccctacccagggtgatcgtccagtgtccggcccctgcgaaacgctccgacatccctgatgctgcacgtaggcagcgcccggctggacagaaaacaaagggctgcatgtgcccgtgcgggcccccggcgctcggggccgccgcctgggcgtagggccgtgcaggtcggaggccctcgaagttcgggcgagtttcgggaggggcttttgtccctcagccccctcgtggggaaactttggcggcgctacttgtgcgaggtgccatgctggtgcgtagggaggcggcgtgcttccccgctccgggcgtgcgggcgggcgaccgagggaggcggcagtgcccggcgcttcagccctggcgtcgggggttgcgacggccgagggttccggggagcttggcccggactgctcggccggtttctcgtggcccgggagcctgtgtctgggaggtctgtgggttcgcctttgaagtcgaac

SEQ ID NO: 69029 - DNA, 1084 bp, Homo sapiens
tgtgtcaccagtcatttctgacacattaaataaagtctgtcatatcggcttctaagttcaaggttttaattcaccttggaggaccaaaaagcattttgcagctagattcgctgctgggtgctattctgtctcccatgcttttcatttctcagaaccagttcatcgagactaaagactaatgccagtgctgttggcttgtctggagaaaacaaagccattaatggtagttaccatattaattgcagaaagtgcttctttaagtttctgttggcaagaagttaccagtctaacaaagtaagtgaagtgcgtccaggccaggcggggtttttaatcttcttgcttcaggtttttgttattgcagttgccaaaacgccaagcttataatttacaagtcgtatccacatgtcccttagaaagaaactcaaacctaaaaatagaaatgaaactcaggaaaacaccaacccagataaataaatcttatgtcaaatggagaaagcttgtaaatctgtgctcgcggttacattaattgcttacatttcgattgattgaagcaagtgccttaaccagtcagcgtgtccctgcccaaaggaagacggcaatcctctcatgtttcagaaaaatttctcacatcatttcttgctcttttttctttttcttctcttttcttcttctttttttttttttttgagatggagtctcgctctcgttgctcaggctggagtgcagtggcatgatctcggctcactgcaacctccatttcccaggttcaagagattctccttcctcagcctcctcagtagctgggattacaggcatgcaccaccacacccagccaatttttgtatttttagtaggagcagggtttcgccatgttggccaggctggtctcaaactcctgacctcaggcgatccgcccgcctcggcctcccaaagtgctgggattacaggcatgagcccccaacccagccacttctcagtttcttagattcagtagctagggcctgcatattaaactcacagaagataccttaacaggagaaaaataaaaaagagttcacactcacatgtgcaaggtgtatacaga

SEQ ID NO: 69030 - DNA, 1033 bp, Homo sapiens
tttctattcttttaggacgctagaattaagtaattctaaattatgggttttgagaatattctttgtattaaaaaatattcataatatttactttgagcaagtcaaggcattactattatatgtcaatataatcaaggactaactcggttaagatttgacttattgttatgtatgtaagtatctaaagtgtattgatactgtgcctttttgacctcagtttttaaaaattctgattgtggtgatgacagcacatatctggaaagatactaaaaaccgtttggttgtatgttttaaatgggtgcatagtatggtattttaattatattttaacaaagctgctatatattttttaaataattgattttaaaatgtgtgtgtcagtcttttgtgttgaatggttaatgctttctattttaaagataaggaacacatttttaaataatttgattgtttcagtcgctgggtaagtcggagtgccactgcacagcgcaggaaagaacgccttcgccagcattctgagcatgttgggctggacaacgacttgagggaggtatgtggtctaccttcctggggtgcctcacagcaagcgccatgaactaggcttattccttccagcagatgtcattgtgtagattcttaatgttctttaaaaaaaaaactgtttagttatagtttaaaatattaatccttttgtacggacatatagcagaaaacacccttttttccatttttgtaatttcaagacatctataataaggctctaaaacaagtctttctgtgtattacatcaagtaaagatcaagttgaggataaatttttagttactatgtctcctataggagaaaaattgtctgcatgagaagcctagacatttctaagtttcaagcataattataaggagtagtgtgatgtacttgcctatgctttgttcttggcttgctggcaccagttttttttcttgaatctctaaatctactttatatttttgaaagtgttttaaaactatttttaaattaagatccttacactttta

SEQ ID NO: 69031 - DNA, 1038 bp, Homo sapiens
tgattctcttgttcttagtaaagccccttgcatgtaacatcacacagtaaaagtttttcccttgtatatactccttttaagaataattttatatacatgtgtatgaggaatttataatatatttctaatttaaggctattgcgaatattaaatctggataaaacctgtctttttgaatcctgttatgttaaaaaaacaacatttatttctggcttgaagttatttgtgtactgcattctgatttttttttttctttctttcacagttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaaggtaggttttccttggattttacattttccaaaaacaagtacttttgctcccaactactgtgtttccatggggtatattattagaaccgaataatgatcacagtctt

SEQ ID NO: 69032 - DNA, 1060 bp, Homo sapiens
tcctgagtagctgggattacacgtgcatgccaccatgcttggctaagttttgtatttttagtagagacaggatttcagcacgttcgccaggctggtctcgaactcctgacctcaagtgatccacctgcctcagcctcccaaagtgctaggattacaggcatgagccacagtgcccggcccatttctgaattcttaacagtgatatcagaatttctacatagttagttcttcccctaatatccttccaaatcatatttgccaagacagctgtgtatatatagcaatgatctttcctgttaccccttttttaagcagtctaataagcagtggtggtggtggttttgcttttcttttgttagatttgttactgttttgtggctttttttgtttttgtaaaattatttctttctggaggtggtttccttcttgttgattctttgtgtgtcaagaaggtgcaatgttccttagttaacagaacaattatattgagaatggcactttcatgacctttctgatatatctcctgtcccattaataacttgatacatgaatgaagataatgttattttaactatacacaggcaggactgaattaaaaggtaagtgttgcaaggagttttatgataggttatgtcttgtttcttctgcttctgcagtgtttcatattttatttacatttgtggataataaaagcaagtatttctggtgttagagggtaggtgaaggagagggtttcttgatggctatcatgaagttacgctgttgctgtgtcagtacactatcagcagcttagactataactgggaggaattttgttttttctctaaagtgaaatgaaaagtaacctaaaaaatcaatctatctttcttttcttttcctttctttcctctctttctttcccttccctcccctcccctctcctccccgccccctccccctgcccttgcccctgcccctgcccctacccctccccttgcccctccctgccccctccactgcccctccccctccccttgccccccctgccccctccccttgcccctccctgccccctccgctg

SEQ ID NO: 69033 - DNA, 1185 bp, Homo sapiens
tgggtgtgttgcagcttcccaaggtggtttaccgtacctattggctttctttaatcctacttttttggtaaatattcccttcattaaatgctgttcagtcaccccactttagtgaatcatctatttccggctaagatcctgaaaaaagttattaaccattaacacaggttaatggtgaaattagaccattactctggttggtggaattatgatgaaattacagagaaaacaacaaatgcctgttttttttttttaaacaagtaataccatgataggtgcactacacctaataatagtgagggctaccattaattaattattagtgagttagttgtatattgtgctttatagatcacctcctttaatcctttaaataactgtataataattaacatcacctccagttagacatgaggaaacattaaacattttttattgtcaattaatatattgtcattgttttcttttatagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttaca

SEQ ID NO: 69034 - DNA, 1049 bp, Homo sapiens
gtttgccaaagggtctgaactaacatgtttgagatttatgtctattaatacaagtagatatttttcattttagctgttttctataaagcattgattttcccgttctccactttttttactattacaagtaatactgcaaagggcatatttataaattgtttccttgtgcacatgtagaagagattctctgtagatcaacaattggaattgctgagttctggggcatactcatcttcagctttaatagctattacacattactttataaaatggttgggcatttaactttttaagctgctccttccaaattacttcagacttatattggtcttttctatatactttttttttgcaagtagatatctggttctttttgtatcagaatgtttctcaaaattgttcatactgttattatagatctttgttttcatttgactttattttctttatttttgcataggagattcatatgggacattgtgtaaatctgactgatggggctgtcgaagctgtccttacttactgtcctcaaatacgtatattactcttccatggatgccccttgataacaggttagtgcaatagattgcttgggttcaaattctggcttcatcttttactgtgtgaccttgagtacattacttaacccatttcattattcagtttcctcatctgtaaaacaggcataatgagagtacctacctcatagacttagtcatgattatctgacaattctttattttattttattttattttaattttttgggagacggagtcttgctctgtcacccaagctggagtgcaatggtgcaatctcagctcactgcaacctccacctcctgggttaaagcaattctcctgcctcagcctcctgagtagctgggactacaggtgcacgccaccatgccaggctaattttttttgtatttttagcagagacgggatttccccgtgttgcccaggctggtctctaactcctgagctcaggcaatccgcctgccttggcctcccaaagtgctaggattacagacgttagctgccgcgccc

SEQ ID NO: 69035 - DNA, 1201 bp, Homo sapiens
ggtccaggctaacagaaggagcatggtggtagaaaataaattcacttttgagaacagagtcaaagtggagcgagagagaacacataggcatagctataaatttctaaccgcaagcatgaagatcatgactgaaaccatttgggcagtttaacttttggtttgcctccaaagtccactagaaaagtaatttgattacttgaaaatttttgttttaaccaaaaggagaatcgcctactatttcactatctaattgggttctgaatgacttttgcctatttcctaaaaggaattcaacctgtggacaataaagccttgccattaattgcagatactacagactgtgtagagaattcctgaaacattccaaaagagttctgaataatgacagtatcactggaaaatcagtatttcctcacaggtggactactttgaaaagggctaacactgaactggtgattgctaaaatgaaaatcagtcacatttctcatgtatacatatacacacatatagctcattgatatataattatattttcccccaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtaaatgacatataggctacaaacatatagactatgtgtttaccaaatgtattttcatgactaatgagaacatatcataaggagttcattttgtttttgttgaaactattgaccacttcatgctttttgtggttaagtaattgagatatatattggcatattcctctcaattaagtagcaagggtgaaaggtatatatggctaaaacacatgtttgatgaatgggaggcattaagactatatctaaataatgaatacattttggaaaattctacttccgttgtctggattcatggactgtgtttctttttccctttgcttaggtatctgacagtggtgtgattgcacttgttagtggaccttgtgcgaagaaattagaggtaattttaaaacaattataaagatggtggtgattaaatttttatattcttagaaattatgtt

SEQ ID NO: 69036 - DNA, 1050 bp, Homo sapiens
aaaatataaaaaggactgtttgaaactcctattatttttaagtacagaacttgaagcttcacagatattacagaacaagaaacattaaaattctcaattagataaaaataatgaaatttatcaggaagttcaagttctgtgtgataaccttggtgtacccaagtaaacaacttctgacattctggttatgctaaaccaagtggaatcaaaggtgaaagacaggcaggacgcagtggctcatgcctataatcccagcactttgtgaggcagagatgggaggatctcttgagcccaggagttggagaccaatttgggtgacatagcaagatcccatcttatttcaaatttttaaaaattgttaatttttttattaaaattaaagaaaaccactctgctgaaaattaatttaaatttgaaacaggcagaacaactggaaagagtcaatgatgctctttcctgtgaacatgagtgcctctagcgaatgttatgaaacaattagatgcggcaatacagtccgttgcacggtgtgatacagccaaggtaagaaaagatgacacagcaagaatttaccagcctcagtgttatgctttgtcacccaagacagcgattataatggtgcatctacttgctgctcatgataatctatccaagatcattaggacaagcagtggagccagccagatgatggcatgtgccattaataaggtgctgatgggaagggtgcctgacaggggaggctggccaaatgaaattgaaccaccaccctctgaaatgcccccttggcaaaagagacaagaaggcagtggcggaaggggtggttggggtggtggttgtggaggtagaggtggtagtagaagaggctgtgggggtggaggtggaagagttggctggggtagaggaggatgggaaagtggtgggggagagggaggaggtgggatggaggtggtaaaggaggtttctaaggcagaggagatgatggtgggaggggagattatggtggaaaagattatgtagatccatatggaggaggtggtgatggtggtggatata

SEQ ID NO: 69037 - DNA, 1089 bp, Homo sapiens
atactgtcttaacataaggatgtgtatgagcttgaggcgcattttcatttagtggcgggcgggtgcatttcagtaggcgggccgcagagcttgtttggggattgcatttttctgctaaatgtgttagctttaatcatgtttcagtcactgttaatgtgcatgcatgttaaggttttaggttttttcccctgtgcagtcggatttttttctgtttaatattaatccaataaagacaagtgcagagataaagtattattgttttgcagtgatactacaatagcggacctagaggagcgcacataaattctaacttaagtgaatggtattttcaggccagacctagtttctatttctgttacttaggacacttaataagaattcagtaaacttagcatgctttcagtgcagccataaaagaaaacagttttgcacagcagtgtcatatctagtaaacacattagcatgtgctcttttattataaaatgtttcttgctgtccctaggaccaaagaagtaaacactgtgtggagagggactgacgtgtttggagggaaatgggaatgtacacgataattaaagagtaaagttgtgctcaacggtaagtgtatcacctctaagaaacccgccctgatttaaccaggcggttattcacactcaactatggagtaattcacctattaccgaataaaattactagctcagtgaatcaacatcggttttaaattaaactgtgggtcacaatggaattgacagcaaagcttgagaagaaatgttgttggcatagtactgaaaaatcagttgttaatcttagcaaaataaggaaagaggtctttggtaagggaattgtggtggaagttacctgggcagaggtctgcttctgtctgtgctgtgtttatttgattgtttttattatattttattactgttggtggcacataggggaatgtggcgcagagcaccactctgggaggatgcttcccgtgcagccaaagtgatcatgtccagggctttcatctgtaaccacaaagtgtgttaggaagtctcacctaatgattaagaccatggtccctgtaaccacactgctttggtt

SEQ ID NO: 69038 - DNA, 1051 bp, Homo sapiens
aatttactgagttcattaaggtaaccttgaatagccctggggagtttagactttgcgaatgaacaatgagaatgtttttaaccatatgtttgaacttccctttttttttaaattctcatttttattgtcatgttagcttttttaaaaaatgcagttagcatggattacttagaagaaagtctgttaaaaataagtaaaaacagaaggtgattggcatttaaatgtaacaaaaagctagctgtcattgtgtggaatgaatttctgttaaacacgttagaaatttcattgacacttgccttatttattgttgtatcctctattgctcctcttcttcccaaattaaagatgaggctgctctgaagattcagtaattaggatggacagtcagctactaattttcttagatattctatctaggcaaaacagcattttaataaaatatctttatttcttacagattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaacatctcagagttctttcagctatcctggaagtaaccaagaagcatgcatgtatcccggtaattcaaatccaatttcacagccactgctgaatatccaaaattatcctcaacaaatttctgtttctgatatgcataatgggacagttgtggcctcacacacttcagtagaaagaataacatatgcaaatgttaatggacccaaacaactaactcacaatttgcagatgtcttcaggagttacccaaaacgtatggttgaactcaccaatgaggaatcctgtgcattctcatataggggcaactgtatctcatcaaactgattttggagctaacgtacccaatatgccggcactacagagtcaactgataacatcagatacctattctatgcaaatgcagatgatcccttctaat

SEQ ID NO: 69039 - DNA, 1020 bp, Homo sapiens
agctttttaccagattctaccattcaaaaacaaaactttataccacatacatcattgcaagttaaaaatagtcagcttctaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacagcaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagactcatctcatgatgtgaaagttctcacttcaaagacatcagctgttgagatgacccaggcagtattgaatactcagctttcatcagaaaatgttaccaaagttgagcaaaattcaccagcagtttgtgaaacaatttct

SEQ ID NO: 69040 - DNA, 3708 bp, Homo sapiens
ataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccccagtgtcagtgtaattccatcaagaactcatcttcagaggaagagaaacaaaaagagcagtgttctcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacccgacagaagaaacatgtaacacagaactcacgtccactaaaaacaaaaacagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacatatgagaccaagtaaacttgccgtgcaggttgaaagttgtgggaaatcaaatgagaaacacagcagcggcgtgcagacctctaaagaatcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagacaggaaaataaacataagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaaggtccagtatgattttcttggtggtgtctacaatattgtaaagagtcgtaggtcaatatttgggctagcacctctcatgctgtcttgggctgctgggaaagactttaatgtgttatgccactacctagtatttgttttgcctggtaaaccaatgtttcattgggcaatatttgttttgtgttcattgccaccttattgtaaattgtagaaaattggtcgtcatgacgagctatatgtaaaacttgccagatagaaatatttcagttagtaccaagaaggctgtactgtgaaaaacattccacattccttgtgggaatgtcagaaaagtgtcaagtagctagtaatgtaagagtcttggttttgttaattctcctttggacttgtaatttgaaagccctgtgaacttgaaattttgttctgaatg

SEQ ID NO: 69041 - DNA, 1820 bp, Homo sapiens
tctttgctctgcttttctgactatatttgttggggttcataaaacaatagcataaacaggatatgttttcctggaaaagaagatagggatatattcattttgtaaaaaattggtgatttcaataggttctttcatttggatccttggaatttgaggtggggatataatgggaacattggaagtgggtgggggcaatgtagttttctatctcatgtgtcctttaatatctggagatgtattaacctcttcagttcatgtgaggggaacataattacatagtaaagataaactcattttttaattgaggtaagcatttcaaatagaaatcatttttccagtcctttttttagagttgtgttacatgtggttatatctagggcctttcaaaatctattttcagcttacatgattttcctttgttatagtactaaaggagatgattagcaatatctagagttctgaaaatgaatatttaaatagtttcaggaataaaaagtacaaaagaagactggttaaaatttgttgctacaaagaaaaggacacagaaagacagccaagagagaggtaaagtcatctttttaaatcttcattcacttatctccctatctggtatatggaaattggattatggttatgatatgattgtaaagtatgattttatccatgttcttttttttttttcagtcattcagtgtttgtgtttgagtggtaggaggacatttttgtgttgtcgtgctgtggaatgaaaggctgagctttattttattttaataggaaaataagtcttatcacaatgagttagctaagaggtttgcatattttacctgtataggaccagacagcaaatactttaggttttctgggtcataaggtgtctgtcctgactactcagctctgactctgtttcagggaaatggctgcagataatatgtagatgagtatcagctgtgttctgattaactatttatttatttatttatttatttatttattttgagacagagtctcactctgtcacccaggctggagtgcagtggcgtcatcttggctcactgcaacctctgcctcccaggttcaagcgattttctccctcagcttcccaagtagctgggactgcagttgcataccaccacgcccagctaatttttgtatttttagtagaggcagggtttcaccgtgttggccaggccggtcccaaactcctgacatcaggtaatccacctgcctcggcctcccaaagtgctgggattacagacatgagacaccgtgcctggcctctaattaaactttatctaccaaaataggcagcaggctggacttagtttgccagaccctggattcaattatttacatgttaatttgattaatcttcaatacaatttaggcaaggatatttccattttatagatgagaggttacatcatttgacttaagtttcattgctagtgactgaatagggacttgaatctggtcccctcttttcaaagtccattaagtgtggttgaggtatagtcagccctccgtatctgcgtgttccgtatctgtggattcaagcaactgtggatccaaaatatttgggaaaaaaattaatacaaccataaaaatagaaacttaaaagacaatatagtataacaactgtttacatagcatttacattgtattaggtattaaaagtaatctagaaattatttaaggtatgtgtggggggtatgctttaggttatatacaatatactatgccattttacataaggaacttaagcatccccagattttggtatctatttgggtggatgctgcagaagtgtcctggaatcagtc

SEQ ID NO: 69042 - DNA, 1037 bp, Homo sapiens
cccccaaaagaaaggcaagatgtcacgtgtatataacttacaattctataagtgaagagctatggttctgaaacttttgcttaactccttgccttaattttttatccctccaatatatattttccctctgaattttgattatatattgatcacagctaacattgagaaataaagtaagtaaagtttttatttcccttagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaatttgaaaccttcacagctcagtttctttttggtttcctacctttaaaaggacgcattttggaaagtgctttcaaaagctgaaatgcgaggtggcttatgcctgtaatc

SEQ ID NO: 69043 - DNA, 1045 bp, Homo sapiens
tcctgagcttcggccctcgacgtagcaaaagagcccgggcgcccacgccgctctcggggtcttctactgccaccgggacaaagccctgggaggagctcccgcccccgcgagccggacagggcggaggctcccccgccgcgcgcgccccaccgcttcccagtcccagacccgtcgcctgcgcctcctcctggcgcgcctcacggtgcagcgggcggcggcccgcgcgcccggcgggaggcgcctcgggatgtttccgtctggtccttccctccgccccccgcgctgactccatccgctccccgccccctgctcggagccgccgccacgcgggaagggagggagccggccccgagactgcatcattccgcaccggctgctgcagggccagagggagcaggtggagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagc

SEQ ID NO: 69044 - DNA, 1620 bp, Homo sapiens
tgggtgatgtataatgtctctttagttttttggtatttggcctcttttaaagcctgtcggatgtatgggagaaaacaatgaacgtgctttgatttcctatcagtcactcttaagaacatacatattgtttaagtaactcggtcttttttatctgattcttgaggcactatgggtagcaaataaccacttacaaatttaaatgtaatatacactccttttctgtgtgtcaagtccttatttttaggtgcatattgacatttaaatgttaattattgtttggcatataatatcaaaaatctattatttattttatgctgttacagttaaaagatgtgatttatgacatactgaatcaacttgccttccaatttagtgtgtaatatggtaagcatttatacttttagatatgtcttatttttatttggatgcctgtctaccaaaaaataaatgtactacctatgattaaaaatcccaactaggaatctaatttttgtgtgtcaggctgtaaatttctggttcctattttacttaccatgtacctgtctggtcttaacaacagctggacttgtttatattttccaacttagattaggctgacatgtttaaatgcagtgatgctaaaccttgtgaagtgaggaagcaggatgatgactgtcattctcagagatgttttgatattgtctatacctatcaacactgctttgccaagatagggaagtgcaaaccagaaagtggtaagccatcaccttcttgataaaggagatggacttaatttaatgaaatgtacctcttactgactttgctgcttgatttaaacaatccttctagggatatttctgtcattgcacttaccttgcatagcaaaccttaatgcaattgtgttttgcctttgctacaccatgagctttgcatcccaagtctttaacacaaaagctagcacacagtgggcatgaaatattttatgaaagaatcagtttgtactagaagaaggcacacttttatcaagggttcactagtcaatattgattagtgttagataaatactaagaaaattaggatgtataggaagtgacagatgttaataaaactacctgtattagtttcaccagcagtaatgagaaaaatgtgaaaaaaacgttttgtaggaataatgtaactgtggtttcttaatacagaataatgcaaataccaactaaaattttttctataaatattttaatatatattttgttctatatagcaggaggttaataaaaatttaccagcattatttttactaaacgattcttgttcatatatttattttcagttgcatttagcataagtgaaattcgagattcctaaaaaactggtttatacagttatataaaaatgtattttaggtaataaaattattatagttgattatttgatagtgaggcctattatttttattctttaaacatagaatatactttagttggaaatataacttaaatgagttaaattgatttcaagtaacatttcttgtatgaaaagtaaatccaaaataattgtgcaaactgaggtgttccaacacctcagttttgaaaaatattttgtgagtgttttgatttttcaaaagaaagttttgctcatcag

SEQ ID NO: 69045 - DNA, 1071 bp, Homo sapiens
cacgtcgctcagtaaatacttgctgattgactttcaaattcagattacttttacgctagcatacggtgggcacaaagggtttttttgtttatttgtttgtttgagacggagtctcgctctgtcgccaggctggagcgcagtggtgcaatctcggctcactgcaacctcctcttcctgggttcgagcgattcctcgtgccttagcctcccaagtagctgggactacagacaagcgccaccacgcccagctgatttttgtatttttagtaaagacggggtttcaccatgttggccaggatgctcaaacccctgacctcgcgatccgcccgcctcggcctcccaaagcgctgagattacaggcgtgagccaccgctcctggcctgggcacagagttaaaaaaaaaatactggtaacagaaaacttgttggcgtgtttcagttttcagagtcttctataaggtcttataccagccgagaagcagcagaaccatctgtccgtgtaccgaggacggatctcagcagctctctgttcagtggctcctgcctttgtagtggattcccttgctgtgctgtaattaagtcagccggcaggagttcctgttttgagggggcctctcccggctggagaagtaccactgcctttgtgttacctgccatgttattgtggagtggataatttttttttcctgcatgggtcttggtttaacagcaggatcctctgggcttcttccaagaagcaccacatttccctgaaaataaatggcagatgaattatttcttgagattatgaaaatctgttagatgaaagcttgcctttttctcatgttcaaaacaatgctaaatgcttataattatactcccaatgaattacttctttcactggcttcctttgctctggcaaaggtggattttttttccatggcagagaaattttataaaaaatgtaatattttagaaaatgcctaaatgtcaagaatacaacatcttgtttgttgttgttgttgttgttttgtttgttttttgatacggagtctcgctctgtcgcccaggctggagtgcagtggcgcaatctc

SEQ ID NO: 69046 - DNA, 1002 bp, Homo sapiens
atggcccacttcagtagcaaagacagtgcactgtgctcaccacgccatttcatcttttccctgggttgataggaagatggccttctcaacccctttgcatctgtgtggggccaggagactaaacaccgccagttgattatgaggaggaatgacgtgtggcacttccagacctagctcacaaacgtggcaaaatccactctcccccaactccttgagcctgtctctccaaattgctgcatagaggcaatgtttccaggagaacctcacctggccagaaacatctgccttgaacatggttagaacaaatgaaacttttttgtattaaaacacttgagattctgtggctcttcgttactgtgttaccctatcctgaccttgctttgtggtttatttaatgatgcacatttactagagtggtgtacattcaatagtgaggtggccacatacaacatacccctaaaacattgctgaaagtacacagccatttctactataaaaatataagtatatgagtgaagaactgatttttgaattttgctttaattaatttaaatttaagtggtcacatgtgggtagtggccaccgtattggaccacagaaccttaagcagtaggaagctttttgctacgtgatgtattataaatctttccactgtctcagcaatctaaacataaaaccaacatgtctaaatttcacactttctagatgatgaagagtcataaaatgaacagaaagtctttatatggtgtttcagggggacagttgtgacattggagtgctggtcaaagttctttattattttttatttgtttccaaatatggagtgcagaaaaccaaatggtggaatggacatttttgccaaagtataattgtggtctttaatgatgtaaaataaaataccatattcatttctgaatttttttcatcgtgaagtgtgtgagatgtgacttgacaactttgcaaatgtcgtgcctctgcttaaatctctgcattatatttatg

SEQ ID NO: 69047 - DNA, 1116 bp, Homo sapiens
attacaatggtgtatgtcttttattctatgttttgggcccacagagcacaggtgacaaaatttgagttctaacatattccaatttgattattcctattgaagctgtgcttctttactaaataattggtaaaaaaattttttttgtataaagtttcattttggctccctccttgtcctaaaatcgcatactttcagcaatctgcattaaatatttattaaactactgtcattctcttagctcctgatactgactctggctcgcagcgggcttctagggcaatttaaccacattatgaattcacaacacattttgacattaaagaaaaacttccctgtgtccaaagcgcatacctatgtttatataaaatgtaaccaaatcaatttcactttccttttataaaagaacataataggcacagcatgaagcaatctgtatgatggattttcctgatatgaaaattgtaagcagtgtgattttctgctttagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaaggtaacagtattttcttcctatgactgggtgtggtaggtggggtaaaggctttaaaattcacagccctgcctttgtgcatgttgagtgtattcggtgagtagtctaggatggctaagtgtgaagaaaatctgtggaagtccactctgacgtatctaaaagcaagccttctgtgctgttttccagagccccctactgaacactctggatccagaaattctattacataaaaatattttttaagtaagctaatattaataggttgtttctagaatttatgcaccccaaagagagtctccctccaaataaaaagctttcaataaggaaaaaaaccccacttcctagaatagctaaatattatcacctctgaaatagagttctgtgaaggaagtacatgaaagtatataaaagtgccttacctttagtactgtgcgagaagatactgtcataatgaagattaataatcatcacatcagctaa

SEQ ID NO: 69048 - DNA, 1617 bp, Homo sapiens
ttggcatggtggcacactcctgtaattccagcaactcggcaggctgaggcatgagaatcgcttgaacctgggaggcagaggttacagtgagccaagatcacgccactgcactccagcctgggcgatacagcgagactcagtctcaaaaaacaaataaacaaaacaacaacaacaaaataataataaattttttaaaaatgtcccatatatctcattgtatggatgaacatatattccagttttctgctattgtgggttatctacattctattgctagacctttaaaccagtcttctaaatttctaaatttcggtcaaatttattacttttcagcttaactcccaaattcagtttcaccaagattttcctctgaccacttctctgttttggttccagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaaggtatgcatgcagcgatcttcatagtacggtgcagtggccagattttagttaactgcaaaaataaatgtgctcttgttgtggaggatggaggaggggaagcaaaagaaaaaatgggagctggcatataaatggtcttgctaatgtgggtctttccagatcaaaacctttttgataattgtgtttatgtagtcctttctaaccccctgcccaatccctcctcttgattaatcgtaatataattttcaagtgtctgttaatatttttgctactctttgtatgtgtaaatatgcctctcccttacctccaacctgagaattggtagataaaggtggatattaagaatgaagctgtgttctacctgggttataattttaaaagtcattgtacctttggaaatggtgctgtttatcagcttctctttaacggggcaaggatatgaatatgttctcttagggaaacttttgtccatatgaccaaaactgatgacagactgaaaggggatgtctatatctagataaaatgggatggaatacgcacagtccttttcttgaaagcaggtttttgtgctttttcatttggcatgggaatattgcccagagaaaccacttgtaaggtttttaggggcttgattttgtgagtcctggctgttgagttacttaccctgtattttcggttaatggtaacatttttattttaggagctttcattaaagactcaaataatatattttctatttgcggttcaagctgactaactgtaataaatcttttttccagtatccagaacagtttccaaatagggttgtatcctgatgtggaaactaaaaaaaaaaaaagcaaaaagattgatttacatatttaaaaaattaaatgccagtataaataatgttgtcactggtgaggc

SEQ ID NO: 69049 - DNA, 1421 bp, Homo sapiens
ttcgcactttgccacagtcaccactcctccttattacttatacccagcctgctatcctcatttctattctctcctggcccctcctgtagtctttgagtttgccaccgttgaaatagaattttttttttcattttaccttaattcctttttgcaaacctcagcctttggatctctaatactttccttatctgattcatgaagtcagcctactgattgggattaaaagatgtggtgtagaaactgatagtgcatttcacgttctaaaggtgtttgaggaaattggtagtgataatgagttggaatggtgtaatagccaaaatatacacctaagaagaaaaaaagtaaaaactgcttggtgtttttaatttcataactgatttcctattgttttagacctccttggaaggtaccttgaagtattctgtgaatcaccaaagtggtaatgatttatcaggatacctaactcggataaaacccacaagtcttctttttagtgttccaaatggatttagtagcactatctactggaacttagaaaagaaattggtatgattaataaataactcctattgctgtttaattaaaaagataacatctcaataaggttaaaaattaataatcaatgttaacaacaataactgttttcatttttgtatgactggtttttgtttacatgaatatatactttatattgttatcattacattgtttaagccatgaacattatatcacaagcttttccatgttgctatctagtcttgtttttatttgttaaagttattgtatcatagattttgtttcagatgctgttatcacattaatcactacttctcttcttgtccactgaggtagtttttcattatttgttatattatagagcactgctgggaataccctcatgcattcagcttctcatctattacatttttctcaagagtgagatcactcagttaaaagttgaacatccttatgttttttgctccattctgatgttgctgtcaagaagggtatatcaatgtactaaaagcccataaaacactttccctttttcccacattgggaatctttctgctactttatccacactgtgcacatcttacaactctaaagtcagttagcatacatgaatgagagtaccatatattgtcttaaactctttagttttgaataaccagaaaataccattgaccttagaaatgattactatttatgagattcgaggccggctgcagtggttcacacctgtaatcccagcactttgggaggccaaggcaggtgaatcacttgggctcaggagttttagaccagccttggcaacatggtgaaaacccgtctctacaaaaattagccaggtgtggtagtgggcacctgtagtcccagctactcaggaggctaaagtgggatcccttgagacagggagg

SEQ ID NO: 69050 - DNA, 1041 bp, Homo sapiens
ggcaggggcagcctgagctccggctgtgagcatagctcaactgatgtgtagttagaatgttcatggaaggcccaggcttgctacttcccattcctttattttaaatgatgtagtgagccaggcgtggtggctcatgcctgtaatccccgcactttgggaggccgaggtgggtggatcacttgagcccaggagttcaagaccagcctgggcaacatggtgaaaccctgtctctacaaaaaaaacaaaaattagccaggcatgatggtgtgtgcctgtagtttcaggggaggctgaggtgggagaattgcttgagcccaggaggtgggggctgcagtgagctgtgattgcaccactgcactctagcctgggtgacagtgcctacataaataaataaaaagaaagaaagaaatgatgtagtgaaaatatagttacatagcacttatacctagactacttaaagtgacctagtaattaaacttatatagctcatcaaccagcaaagattcctagtgcaccacactcgttatagagcagggaagcatcgctgccaccctcagggattcctcttgcatatctctgtgttctgtcctccacacacccatctctttagtcatctattgattttattcaattttcctggcagtttccccagtgtattttacctgaaaggtatgagaggaaaaaggaaaagcacaactcaaaatggttgactattccattctttgttttcttcaaaaagtgtaaagtcataaagatgccatagaaccactaaattcattgtcctttgtcacctctcagccaataatagtcattgatatactctccataccacaaatttaaagttttttgtgaactgtacatgcaatagccaagtttattttaactttagtcattactggatcccagagattttctttctcttttttggcatatagattatttatgtcacttcagtatgcccagtccacagatgagatcttctgagggactgcttctggagccggccctcttgtgtgattgaattagtcagtgatggttctc

SEQ ID NO: 69051 - DNA, 1376 bp, Homo sapiens
gatcacgtcacttcactccagcctgggcaacagagcgagactccatctcaaaaaaaaaaaaaaaagaaagaaagataagaaaaaaaggaagaacttggatacttggcctgaggagaactcagaggacagagatagttttcatgggaacacgtggagcatccggaggttgtttatggtcatgagggaaagagatgtggtgtggaaaatacgatcttgtgaaaaagtagggatgcattagttctcaagtcaggaaaatgaggaggtggagtcaagcgatgctacaggagactgtttgccacaaagagttgctgctgtgcctgccccagagcacttgggcccaaagaagccacctctgcagcctcactactcatcgtggctgggtttggtctccacagatgggctttcactcacatggtgctcaccagtgcccactgctgccatctgggccaggtgtggagccaaaacatagaagtgttccttgtctcctacatgagctgttccttcccatcccaaacagccaccagtgggctcctggactccctaaggcattgacttttagaaaattgggtagtttggctgggcgcagtggctcacgcctataatcccagcactttgggaggccgaggcaggcagatcacctgaggtcaggagtttgagaccagcctggccaacatggcgataccccatctctactaaaattataaaaattggccgggcatggtggtgcatgcctgtaatcccagctacttgggaggctgaggcaggagaattgcttgaacccgcgaggcggaggttgcagtgagctgagatcatgccattgcactccagcctgggcaacaagagcgaaactctgtctcaaagaaaaaaaaagaaaattggttagttttctaaattgcattgaaaattttataaataatagaagcccgagagaaagccacacagcaaaactttctctctctgccaatgaaatgtattattttcagccacctctttttaaaaacaatattatcttcattcctgtacccttcattttgctttgtatttttgagagcgctggttgccttaaaatcagtatctcaaatctctggcaaagttccttctgtttctttgactctatgaccctgatattttctagaggtagctggtgtcaatttgagaagcatccagaggagtgaatagaaaagaggccttagcattaaaaagactaaatttaaatccttgttccgccacttcctaactgtgtgaccttgggcaagttaatacacatgctgagcttggattaatcagtggaggcttgtaggacacctactgtgatggcaaattctgtgtttgtttctagcaggagagattttaaaaagaagttaaagaaaaaaata

SEQ ID NO: 69052 - DNA, 1059 bp, Homo sapiens
agcaaccaggacgttttgtgttctttatatgagtgctattttccacagtgtcatttattatgcaacgtggagtaaagagttgaaatcttcaccaaaataagggttcaggttaaagtacagaaacagaaacaaaacgattcgacatgaagttcccaaccatagcagcctaaccttctgctcttttctacctgcatggccttgctgttcctaaacattgtcttcatttcactggcgttgtatctgcctagtaccagtattagtgagactgtggattttatcagagttcaatgaaagaaagcttacccctgccctcactttgtgttttttatttttccccctttctcaagcaccacgtatttggacctgagaagtggcatagctgctaagttgacttttaataaaaaactgtttgtgcctgagggaaatatatgcctttttaaaaagtacctcagaacatgttcgtagatcgtctcatcggttttgtttggtgggactgggagttcagcaggaagtattgtctgtgtgtgatgacggggcagtattgccagtcggcaatgttgtatttgcattctttatccctaactctgaatctaggactccatgaaaagccgggtcacccacaaaacatttcttccaatacaaagtgtattattacgtctattataaactagtttcatttcagttatttatcttcatagagtgggaaagtctttttctgaaatactaattctatgaaaataataattttagtgaatctttgccaagaagttatagaaacttggaaataaatttctcattttcagcacaaaattaagtgatagtccctaagcagtaagagagaataccatgtatttacactgtggcatcatttagtatagtttacactgagccatatttatttataggcatttaaagtgaatcagtatgtgtagtgttgataaaaatcagtatctgtaaagataacatcaggaattcaaaaggaaattgaaaaggggcagaactagtgagaaccaaaaagaatgaactccagtaagactaattgaagacatacttggagag

SEQ ID NO: 69053 - DNA, 1114 bp, Homo sapiens
gcagtgctttaaggcatgcatgcaggcaccgtggtaaaggaagggcaagacaaggaagatcagcttctatttcaagggcttcctttgtttttctatttcaacagccccttaaaatgtgtgttgcatattgtgagcagtagaaggagatttgggtcctaacaaatggatgactgacatttttctgtgtggctaagaggttggtagctcaaacaagggacttctatgtcctttgtaaggcagcattgtatccccttccccaaaactgtgccctaaaatataaatgtgaaaaaacaaaaagagtgctgtctatagtctggatacttcttttgtgtaagttttttttgtttttttatcattgaaaccatagggccagtgctctgtgagtctaactgggtctgccatttttacttgatagaggaaaggttgcaaggaaagccttggctcatgcaggttcagtctttctgattgtgctgtgctgctgtcatcttggacatttgtgccagtggctgcccagagagttagaaaaggttattgctaataggccctaattgtttcattttctttttaaaatgataatgtaaaattagataacctcatattagtcaaggactcatgttcttacttcaagaacaggtttttaggccagacagttgtgagttcttggtgttaattgtagttgactttaaaatcttaccctcttttgtgcttactggtgtttgtacatcattattattactttttaaaagtttttttcttaaggtacaaaattagtttagctacatactagctctaagaagcatcttttaataatagtagatatatgtctgcctgaaaatttccttagcataatctaaaaattttcaagccaatgtaatagtattgggataatttttttcacccataaatgtcagtctttcataagcaatataaggtttgggaggaaaataggtaatttgaaagcctcatgtatgattatgtgttcatgttgctttaattaccattatcttagaatccagaaaaaggctgtgagtgaatgggtctgaagtgtgtggcatccgtgtacttgggatgtagttacccagagcattggggtaggctagataaatccgtacac

SEQ ID NO: 69054 - DNA, 1004 bp, Homo sapiens
gactatctgtctaggaacatgactactgcctacattctaggagatgccttctatggagcagtgttctatgaagggtggtgtgccctacagggtgcaaaagatgaacacttggagagcaggaagcaggtactagaccttggagttcaagaccagcctgaccaacacggagaaaccccgtctctactaaaaatacaaaattagccgatactggtggcacatgccggtaatcacagctacttgggaggctgaggcaggacaatcgcttgaacccggtagtcggaggttgtggtgagccaacatagcgccatttcactccagtctgggcaacaagagtgaaactccatctcaaaaaacaacaacaaaaaaccagccctggcattcctaatatttttgtcctttttctagcatttttttccatctatgtgtcagatacatctatctatatggtatatgtatggaattctgaggagagaacagagactggacaatgcaagctcacttgtctgtttttgtgtccatggcattttaagcatggctggttaagtggactgagatgatgttattttagatagtggaattctggcaatacttggtaataagtgaccacaaacatcataagctatttaatggcacgatatttaaacaagttgtgagactaaagatactacatctttttctttacaaaagaaaaaaaaaacaagggccaggcacggcagctcacgcctgtaatcccagcacattgggaggccgaggcaggcagatcacctgatgttgggaggtcgacaccagcctgaccaacatggagaaactctgtctctactaaaaatacaaaaattagccgggtgtggtggcacatgcccgtaatcccagctactcgggaggctgaggcaggagaatcgcttgaaccagggaggcagaggttgcagtgagcccaagatcatgccattgcattccagcctgggcaacaaaagcaaaactccgtctcaggaaaaaaaaaaaaaaaa

SEQ ID NO: 69055 - DNA, 1038 bp, Homo sapiens
agctggctccgttcccaggttctagtagctgcgggagggttaagcagcccagtccatgcctgcccctgctccctccatcactcaggcagaagcctgaattcttttgcaggcgttccaccactcttgcataaagtttggaggtcttgtgatctctccaaaatttaccatcatactctaaatatgaaattaaaaaaaaaaaaagaaatgcagcaaaagggaagtgttttctcaccccaagcagtgaagttttaggttctctttttcctgaaatagcttctgtccattctcatttatcttcaaacagttagagatgattggagagacagtattccctcctggaaggcagctcttaattagagaggaaaatatttctagaacaggaagatgaagcttgagaggtgaatgttgataaacatagagaacttgttggctcttgttttctgctttaatggacagcaccctttagagagtggccactacaacaatatggactttataagttcctttttaggtttttaaactgagaagacagtaatatagcacttcctgcctacactactggataattttgttaaatcatctaagaaaaattgtaaatatgcatatttagtgcacatgttattttataacagttttttttttttaatgacctgaaaaaacttctctttctaaagcttacgctttcaggcaaactcctttcacatgaaagaaatgaaatatgatagagtatgatgaatgactcaataggaaatattatgcagttctttggaagaatgataacttggtgttcctttaataaacatccaaatgtacatgtaacctaaactgcaaactaggattaagatttaaatttaatcagttcttcttagatactagaatagacttgaggaggtcaagagtagataggagactcctggaataatccagggaaaagttgaagtcatttatttcaaaaataaaaaggtattttcttagatgttttgtggaccatccctgcccacttcctgagccaccttctgataacctttactgtaggca

SEQ ID NO: 69056 - DNA, 2124 bp, Homo sapiens
agctactcgggaggctgaggcaggagaatggtgtgaacccgggaggcgtagcttgcagtgagccaagattgcgccactgcactccagcctgggtgacagagtgagactccgtctcaaaaaaaaaaaaaaaaaatctgtacaaatatttccacaggaatattgttatatgttgggagtaagtttcattctcctattaagactactgttatgtcaagcagtaataaggactttaaagaaaaataaaatcagatgtggagttagtgatggagagtgctgttatgatagatgaatctaggaaagcctctttggagatgtgatacctgaacagaaccccgaatgataagaagaaataccagtgttttaggagagattgtcctaagcagagaacagcagctgcaaagaccccaagacacatacacttggttattaagaatgggagcagcaaggagtatggcaagaacacagtgagttaaggaagaatgaaatctaatgaggccatgcactttgggaactagagtatgtagaatctcataggctgtcactgggacttgagttttcccttgagtgtgtgaggaagccctcagagtttgtgactgacttgtagaggttctagtggaggggatcagagtggaaacaaagagaccagttaaaaaggtatggcagcatgaataaaaaagttttgagagtattcattatgccttccaaataaaaaactctttggttcataatttgttcataaattaaggactggctacactgtactatttaaaaatgttaagaaacatcaataagtaaaaatgttaggaagagatgataaatacgtaagtattatatctaactaagtctttactaactagtcacattattaaacagtgcaaggatcaagaaaagttaagcgttgaaaaataaataaataagttataaataaaataaacagcccaaggaaatgttccagtccccataggtagactcggggtcatcttctttatttaaatctttatttaaatgtggatagcatcccaagagacttgggtctacactaagaatattcaaatccatgtttctgaaaccatcagagatagaaaaaaaaagtagcgaatatcccttttcaactggaataaacttgtcttaattctagaacttttccataccaatgttttcatgcttcctttgtattttatcttttagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggtagagcatgagactagctcatgagcagggaaaaccctgcctattcgattgttgtcttaaaactctttatttattgcacccctgaaatgtatgaatcagatcacccacactggcagttaaacgattttcaagctctggctgctgattagcatttcccctatgctctaagcagatatttcactttttcttttcatgtagtttctgttaatatctctgttgtaatttcaggagtcagaacagtgtggaaactttaatataggaaatccacaaatgtattgtttttacatagaaagaaaatgttccttgttgctctagatgttggtgctgtatccctaatacttacgggccaagcaagaagaaattgtataatctttgttgttcagaagtttctaatagaataaataggcctgtaagatgaacttgccact

SEQ ID NO: 69057 - DNA, 1060 bp, Homo sapiens
cgtatgttgtcagcaaacttactttttgcttatccttgtgttggctttgtcagggttagggacctaacatgtagaaggtggtctgtgtggagagagcatagcttttgctaataactgctggcatcccccttggattttgcaaaatctgaccaggatatccacaattgccaagttcagctaaagcatgctttgcagtcagcaaagattattctgataagcttcctatttaagatcctgtaggattgtggaggacctcaggggtgacttcattgcatagcagtaatacacagttatatctgttagttaacatactccctgattcatgaaagatgtattattttatcatggcacaagttctgccaggttgctgtctttaaagatattgtcagaattagaatcagaacataggatatgagtgagtcaaaacgatacatcagcactatcagaataaaaccaaggtcttgaaaagaataggctactgctactaataacaacatgcatgtatttcaaatgaattttgctgaatgacagaaacaagactaagaaggcacatgcatttacatgacattatagaaaggaaagatcactaggtaccaggatctggtggtaggagcatagagggggttgattacaaaggggcacaaaaatagttgaggcatgatgaaatattccatatcttgattatggtagtggttatatcagaggtcctcagcccgtaggccacggactggtaccagctggtctgtggcctgttagggatgtggccttttgagtggtggggcaggcgagcaagtaagtgaagcttcatctgtatttacaggcttgctccccatcactcacgttaccatctgagctccacctcctgtcagatcagcagcagcattagattctcataggaacttgaaccctattgtgaactgcacatgcgagggatctaagttgcatgctccttatgagaatctaatgaccgatgatctgtcgctgtctcccatcactcccagatgggactgtctagttgcaggaaaacaagatcaggtctcccactgattcaacattatgg

SEQ ID NO: 69058 - DNA, 1001 bp, Homo sapiens
tcaagtgattctcctgcctcagcctcccaagtagctgggattttgggcatgcaccaccacgcctggctaattttttgtatctttagtacagacggggtttcaccatgttggccaggctggtctcgaactcctgactttgtgacctgcccacctcggcctcccaaagtgctgggattacaggcgtgagccactgcacctggccccattttgatgcaatatctgtgtgttcactgaagaatgaagtagagtcatcagttgaaagttaaggggaaggaggaggagatggggagattcaagaaagaggactaagtgtgaagattttctctgggcagagaaaagtgagcctagtagagaaacaaaggtggacttgggcacctgttagaaatttacagttataaatttaaagggacactcgtcagcttaatggcaatgatttttctctaacaagatatagcaactcaggccagcgaaggcagatagcacggtttatccagagtagtataatgagaaaaacactggaagagaagggaagtatttacatcagagagttaataatgaataagagaagtctcaattggataaaaagagcaggaaagctaggaaacaggctgatggttaatgagaaagtggcggggtcagtggacagaagaatttcggtaagttcagagatgtatggtagcggacatcttgggggcaatgaattagaaataagagagatgttggtgaaaaaaatgggatatgtgaacctggcatgccagatatggttcaccctctgatggtgacacagtcccgggggtgaccatgagattgaacagctaaggtagactgcacagcgctggcagcagagacataaggcggtagagttgggcttgtcatgtaaatgttgaagtccacagacattgtggtagagcagagaactatgatccgttagtgagaaattcctgagtgaatgggtgtggggcagatgataaggagatgctaactcagtaggggagatgggt

SEQ ID NO: 69059 - DNA, 1059 bp, Homo sapiens
gagcattttttgagctattccttgaatatgtgcttttttgtcttgaagaaatggtgtatcaattgattctgtcaccgtcaggttagaatgagcacttccatttaagaaatcctttcatgtcttcttctctttcacatgtaggacctggaacagtttgaaagatatacctccatgttgccaaaatagatccatggtgaaaaatacagggacagttgaggctattgtattaacttatttaatttagtttataaatctctagctgcataaatgatgtctgttcttttaaaacaaaagaaaaaggacaaattgttggtgttcagatttccgatttataaagaaaagataacttgtttttgtagaaatactcctaagaatgtcttaagtatatagcaattatgtatatatagtattaaatatatatattatacatgcttttaggttcacattcatctctaatttattttttaaatataaagcatggtttatcgtggaattgagcaatgttctaaactgaagaaatgttttggtgatttatgttttgctgattggcatttgagggtattgatatttttataataagcggtaatttatgtggcatgggatatatttgtgaattccaacagtacttttaaagtaccattttttgtttctgtgcctatttaaaacagtgcctctcttagaaggtgctattaatataagatgagggttcagttaatgcttcagtcttgattattctaagattaaagtgcattttggtcactgggacagtcaaagtcatacaggttattttaccgtttacaatcctataattattgcagtagttaacatcagcatgtacaaacattttcaccaaaacccaaactttatgagacacctgaccttttacagaactaggatatgtggaaaccacatttatcgtaatgtttttcttttccgtaagataatcgagcatggttaaataaggtctctatataatgaacacttaagataactgtatgggccttttcctttgtcggaatgaaacaaaatccacatgtgataacctatgtttggggtggg

SEQ ID NO: 69060 - DNA, 1568 bp, Homo sapiens
tattttaagcttaaattttgcttttgctgaaagcctaccatttggcgtgttaagtatgaaatatagtgcagacttttatcttggttttaagtggggctcaataaaaaacaccagccacttttgtaataatggcatcacagtgtcatcatgtatgcaagcaataaaactctttagggtatggttttatactgaaaatttaatatgaaggccccttcccacaagaatatagataattattaactttctagatgtgatacggtaattcgaattgcagagtataaggaagggaaatgggaaggggcatcattccttggattttaaataactatcaagaacatttttactttaacaaagaaaatggatagaaaaagcacattttgttttccctgaagtttaatttgacatcaggtttgtgtacttatcttcactaggtgacttaacttaccccaatttttttaaaaattattaaactttttacagaaactaaccttttaaatgtaccctttccccatatatatatacgcacacgtttggattttttttttttaagaacacttgttctagttataaatatataaagaaaacgataaagtttgtggtactgcagggttgttaaagattctttgatgccttctaaaaacttttgtcaaaaatacttttgagttcacaattctgttttacttttccttgtccttactttttggaaacagggtggttgcttttatttgttttctggttatattcaaagccttaagttcttaatctgagcatattgtctgtgataaatttctgatgatctttctggactagatacaacctgagtagcaagcaccaaccggagcaagtaaacttctagggaacaagcgtcttgggttttataggtatctttgctataatgcagaatagattaatgaagatttcctatatcatatgatatttgtgttagtgggtctaagattaagcacatgatatttataagctaaaattaactcaaaagtcaagaatgtcttaatgttttcattcttaaattttgtattctccaagaatgtattagtatatgaactgtggccaaccagttcctattcttcagactgtattgacatctgtagtggatcatgttgcttcttcattcttaccaattttattagaatcaaacttcttgttatttgcatactattatctactatagattctcagctttagaaaatgactatgatacataaagaccactaggtcaacttaaaaaaccctttctgtgaatttatacatgtatgtatatatgtaaaaacactgttgatttgcaattctgtctttccatagaaatgaactttttctatcgaaattgtttaacttaaatattttaacataaattatttacatggatctttatgtataattcatccttatatataccccttaatcacgtagtcatgagaagataactttgctttctttacagaaagggcagagaggaataagataagaaactgaaacaagcaagaatgaagagagatgtgggggagagactgctggtctccagaccacagcaatgtgttttaagataagat

SEQ ID NO: 69061 - DNA, 1777 bp, Homo sapiens
gagactccgtctcaaaaaaaaaaaaaaaataaataaataaaaaataaataaaaggaagtgacactggataattaagagacacaccattgcgcctttaacacatattcacacccagcactgtcacatccatcgtgccttgaggacaggcataaatttacggccttcctcctgcgctcccggcctgctcctagcctttgactagagcctgcgcagcatcccagtcccaggctagggcccaccggtgccgcgcagcctcctggaagctgtggggagtagcgttcctccgctccagaactacaactcccagcaggccttgctcctctccacctccctcgcagcgcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcaggtgagagcagcaggcggcgttcgctcgggccagaccccggccgcaggcctggtcggtgctgcggcagtgcccactcccgcgccagcgcccactcccgcgccagcctttggggcctgtgggaggagggccttgctgggggccccagggctctccgggctctgccgcacccgccctcccggggcagcgttgcatcaaggcggagaatccggggcccggccaggggcggagccggcgcggcgggcctggctagcccggcgggtcccggggacaggagagggaaggatggggccggcgggcggaactggagtccgctgggaccgggcgcggcctcgtccgcgtgccgctgcctccaagggcacctgggggacgcgcggggcactcgggtctcgctgggctcggtgggctggctgttcccatcactgttggctttcgtgagacgggtgttttatttccctccttgccttgcccagggactgcggagttagttttggaatcgctctgttgaggctgagagacgctacggtgcgtgagcgccagtgttttcctgcagtataattccaccaggtttcgagaacgccgaagcagcattttaaaaaaagaaaaacaaaacgtgtatctagagttctgcgggtgttgggaaggaatatccgatttttctgcgtaggctgtgctttttgtcttccacagttttgtgatcgtgacctaaattgggcatcagtttctctggtcttctcatagctaactcatttttttttgaatgcagaaatgttggcaaaataactgttatttctagagtgacagaggagaagtataattttccttttctctgctacttcgattagagttcagagaaacggattttagaaattagtatattgatattaagtgctttcatttcttaatagtatcttttctattgagaaggagcggtttccccatcattttccaggaggtacatagtatagggtataagtgctatcagaaggaacttactgttcaaagtattagtggctatccaaacactggaaactatagacaccctgtactcgtttgtttgtttgtttgtttttttggcttttaaatagttgaagcaatagaaattgttttagaaacacatttccttggtctgcgataggattgggaaagattctgctcaatcttgcctacgtattcta

SEQ ID NO: 69062 - DNA, 2581 bp, Homo sapiens
attttatatataccaatattgtgtaggttttgaaacctggttggtggagtatcaaaacaggtgggataattatgggaaaacagggctgttattttctggttttggcttaaaaacaaatagatcatgtaataggaaataaaattatctttcatttaaaaagtctgtggccgggcatggtggcttacacctgtaatcccagcactgggaggctgaggcaggtggatcacctgaggtcgggagttcgagaccagcctaatcaacatggagaaaccccgtctctactaaaaatacaaaaaattagccaggcgtggtggcacacgcctgtaatcccagctacttgggaggttgaggcaggagaatcgcttgaacccgggaggcggaggttgcagtgagccgagatcgtgccattgcactccagcctagccaacaagagcgaaactccgtctcaaaaaaaaaaaaaaatagtctctgcactaatttttcctttaaaataattctgtatgctggtttgttaatatagtttattgaattaacaaaaaatgtgttaagaaactcattttgctcttgtatatattctgttttcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggtaaatttcagatttgagataattattttacagctcttcatttttgatctattcttaaaaagatatgaattgattagataattagaaattagtgactgtagcatagttagaagtcctgtgagaagtagtatgcatctttcttaatgtaaaaaaaagagtagtttttgttttgttttgtttttgagacggaggtcttactctgtcgcccaggctggagtgcagtggtatgatcttggctcactgcaacctccacctactgggttcaagcaattctcctgcctcagcctgccaagtagctgggattacaggcgccccccaccatgcccagctaatttttgtatttttagaagagacagggtttcactttgttggccaggctggtctcgaactcctgacctcaagccatccgcccgccttggcctcccaaagtgctgatcacaaggcgggtggatcacgaggtcagaagttcgagaccagcctggccaatatggtgaaaccccgtctctgctaaaaatacaaaaattagccagatttggtggcacttgcctgtagtcccagctactcaggaggctgaggcagaagaatcacttgaacccaggaggcagaggttgcagtgagctgagatcacgccactgcactccagcctaggcgacagagtgagactccgtctcaaaaaaaaaaaaaaaaaaaaagaagaaaataggcattgtcctttataaccgttcttttttgattaaattgaaaatatattagggaatgctgtgtctatcagcagattttaagttgcttaccaaatatgtatcctatgttaattatacttatattaatgaggtttgaaatgttgaatgagagtaacgtatttaatcttcctatttagttcagtatttggctcagactttcttatttatagaactctgtaacatagctctaattattaaattacttttgcagcagagtaccatatctgtttcttatctgcagagatctgttttcaatgcagttttattctacttcttattctgatttaagatgggatgatagttttgacaaaattgaacttattttaatttctgtgtctgattttttcatttactgtaggagctgttggtggtgatgacttgaattttttttttaatggggaaaaaaaacctcatgagcatctgctatgactctagaatgttagtcactgaagcaaattagtgtagttgtagatgttgcaagtaatatttttagatagactgccagtggctatgtgggagccttttaattacattaggtagcttctgggtatgttattcatcactttgcatttctctaatacttattgaagttctgaaccttgaatttaatcatgttggattaatctggggttcaccttcaaatatatagaataacacttataaaatttcatccccactgatttcatcaaatttaccaaacatctgaaactaagaccttaagacactatatgatattaggtctttctctctctctcttttttttttttttaactttccattttcttctgtcaccttgagagggcccatgatatcctgtctctcagaaactatttgaattgtgggcagtgtttccttagataaaattgtgcttgttagaaaagggtgtacatttcagctatcgtagtgtcagctctttggtatctctttgtttttatgtccactatgttttgttgatgtctcctcttagtggttggtcagtaaatctgcctacctactgtttttttccaagcttagtgctgattttgtatatatatttgcttaaaatgacaactcaactaccccaaacacaatatagattatataaatttgagtactagatttcacgtgt

SEQ ID NO: 69063 - DNA, 1115 bp, Homo sapiens
aaaattgtgctatatatgatacttctgaacagtgtcagtagaaatttgaaaaaaaatgtgaaaaaaaaatttattttggggagaaaagttgttgaactaaagcaaaagttttttgttttctttttaaaaaatgcaaacataggccgggcgcggtggctcacgcctgtaatcctagcactttgggaggccgaggcgggtggatcacctgaggtcaggagttcgagaccagcctggccaacgtggtgaaaccccatctctactaaaaatacaaaaataagctaggtgtggtggcgggtgcctgtaatcccagctaatcgggaggctgaggcaggagaatcgcttgaacccgggaggcggaggttgtagtgagccgagatcgagccattgcactccagcctgggcaacagagcaagactccgtcttaaaaaaaaaaaaaaaatgcaaacatacatgtttcgtagaataatgcttaaaatcttggtataatttgaaattttacccccatttcattaagtaacctatttgtaaaagcaatcagttgccccccaaaaagcagtaaaattacacattagaattaaaggaaaaagataggattaatttttctgcatagggtgctgtgatacacgtagtagtctccctttggactgagtccacgaaggtcaagagttaactttctgcagtgttctattaaatccaatgtatgtttcaaataaaatacccttatatagtccagtcttagctaatggggcaaatacttgcatatacttaccaacttttaaggttttgaaagatgtatttagtatattttgtagatttttaaaaatcaggcaatttatcttttcctgtagtaggttatcagatatctcaggcaaagtttttttttttttttttttttttaaggcagagtcttgctctgttgcccaggctggtgtgcagtggcacaatgatctcagctcactgaaacctcctgggttcaagcaattctcctgcctcagcctcctgagtagctgggattacaggcgtgtgccactacgcccagctaatttttgtatttttagtagagacggggttttgccatgttggccaggctggtcttgaactcctgacctcaggtg

SEQ ID NO: 69064 - DNA, 3305 bp, Homo sapiens
tttttgaatagtgaattaattgtgcttcatttgtgtcagaattagaaataatggtcacataacttttttattaattttaaaaatttaatttttattttttagactagtcaagtgcagtagtaaggcgggaaagagtagaacaaggagttccatctgtaactgactgaacagtcaattgagataactaccttcagacaagccagatataactaattatattggaaaggttgtttcctaaaaatgttaaaaataagttatggcaagcaatatgctttgtttctatgacttaaaaatattatatacatccctctaattctagttgtattttgcactgcgcagtgggattcttaatttttcttcttagccactaactttactttcgtcagtaaattttgaataattgaatgctatgtgcatttgaaatgtgatcaggtttctgcacatttgaatttttaataaggtttaaaattttagggataagcactaaacttattctgtgctgtttctctttaactacagaccctgctacatggaaaaactcaagacacctttctaaaggtttcctttatccatttgcttttgaccctttttttctcttatgcctgcatgtgtgcttatgtactattacaggctgtgtgtatttttttttcttccatttttatttgcccatccacattgattgcaggttttagtggttcttgttattttttttggcattgcatcaaaatgcaagcttttttggtggtgaatgtaatttattttatttttatttttgaagacatgcttgtgaagccaagcctttttaaatataataagataaattagaaacagctctttggtatgtagtacttgcattttgtgagttctgttcacctagattactccagtcctccaatgagacttcttggaagaaggtactaagctacaagtaggtgagcattttatctgcaaaaaggatccggttttatttacctttattccaccaaaggaccgactcactcttctgtttgtctgaatatcttatgatcatttttatttagacctcaggaggctgatatgcattattcaatacacttattaagatattttaaccttctctaaatttgacaaaagcaaaacagctgtgtttggaggagataaagttagattatctttccacaattaaacagttctagtttttctgggaaaaacagactatatcttgctctccaagttttagactacttcacacagtgcaacagtgaatctattttccttctttcagcaagtacaagaggaacagacctatgactggaaactaatggagagtggcaactccttacgctgcatataccagggttcttgtttttccttttcttccattttatttctttcctgcctccagttccaagggaaaacagtcttgaccctgggggaaaatcaccttgaaagtgtgtgtaaattacaaagcagctagctctataataatgagagagctctttaaaggaacagcaagttgtggctctacaggtaaccaacaggaaaccaaatttttaaaaagaactgaagaattagctgtttcattgacacattgtaaaatttttccttgagtcatatgtgtacatctgttacatatgttttttgcactactcagtgggattcttaatttttcttcttagctactaactttattttcgtcagaaaactgcttttatatgtaagattttcaaaactaaagaatattccttttactgtaatataactacacaaaaaaatatgaagagaaataaacaattttatttgcaaaatctagatttcaactagtgggaagacctgtgagcagctctgcctgaagttggtcatgtttttgaaatacaccatacaatttttaaaatataatttagcagaaaatacaattttagaaaaatataatttagcagaccttaaaatacttgttaacttgtacttaatggcaaaattaaatacaagttaagaagtgttttattatgttgcctttttgaattcctaaagataaaaagtagtttccatagtttccaataaatgagtttttcttttttccaggggtggaagcagaagaatggggtaaatttcttcacaccaaaaataaggtaatcacacatgcatataatgaagaaataatgttgaaaaaaatatattgtatgaatacttgataatttagtttctaatcattggcaattacgttattttaaagtaactataactattccttataaaataaatcttagtaacatttctaaccacaattgtttattggaaaacacttgaaattgaggccgattttctctgtgatttggtgattcttaattgttgtgggatcaggaagctttgaaaagttcgtaatggccaggcatagtggctaatgcaagtaatcccagtacttagggaggctaaagtgggtgggtcacttgagcccaggagttcgagtccagcctaggcaatatagggggaccctgtctctataaaaactaaaaaaaattagccccgcgtggtggcatgcacctgtagtcctagctacttggaaggctgagtcgggaggatggcttgaggatgtgaggttgaggctgcagtgagccgtgattgtgccactgtactccagtctgggtgacagagtcagaccctctctcaaagaaaaaaaaaaagccaaacagaaaaaaactcataaaaaaactataaatccttagctcagaaaatatgtatacattagaattttatttattttctgaagcaaatacatagacatccttgaagtatatggactccccctccagcttaagaacttttgatcttattttgaatattatgcttttttatttcaaaaatttttagctttacacggattttgatgaaattcgacaagaaattgaaaatgaaacagaaagaatttcaggaaataataaggtaggcatctttttagagctagaaggcataagcatcagtaaatatataattgaggtattctgtacataatatgtgaagggcattgtaaattcctactcttgatcttagccaaaaggccgagaagcgatggacattgtaaattcataatggactttgaaacaaatggagtattttcacagatatatagaactttgcttaaaatcccttttctttcttaaagctttcatataaatcaaatattttatttagatgtttattgttgttcctgtcatgtacatgccacattattatataattctacttagtattgctacaataagttatctttttctgatggattgattgtactctaactcaggaagcattgtttcacttatatatatatc

SEQ ID NO: 69065 - DNA, 1927 bp, Homo sapiens
gttctgccttattttcccacagcccttaccaccatctgtatactatatatatgtttttgtttattatatgcgtgttattactaaaacataagttctacgaaggcagaaagtttggtctttttaaaattcactactgtaacataatctgacatgacctgaaatcacgttcagaaaagtgcctaaaatagagtaggctgccagtaaacacttggtaattgaatgaatgagtgaatgaatttgtatctagccaatcaacattgaccagttcttaacatgggactgtattaaatcaacttttgatatttgcaagagttacactttgagacttgacacattaccagattcataaataccattgtagtatattagtaatgtctttatttttattttaactatttttaaatggatatacctatattctatcgattaaatgtgggtaaaaaagctgagttgatttttaattattagttccttgctcatctctgtttggtttaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtaaggacagatgttaatttaatgagatgcttattttacaatggtaaatctacccttgagaaaggaatttttctctttaaaaacagtatctctggttttgaatacaaatttaaaagataatgctttcctatttttgtttataaaaatagaaattctgatggaaaataaggttattaagttgctatacagactaggcgaaaatattttacaactttatttgtaatggttacctaataatttaaaaataatacggtggctttgcaaaaaggatttcttgttttgtgacctaggtatttgaatagttgacttttaagaataaataacatagccaggtgtggtcacatgtgcctgccgtcccagctactcagaaggctgagatgggagcattgcgtgaggccaggagttcaaagtcagcccgggcaacatagactctgtctgttaaaaaaaaccaaaacacagtaggtaatcattgtagattattatggtacagtagagaattatggtatctacattctgcagaggtagataatatttagacatgctcaaggcacaggggatttttagaaatgaaggtaaaatcctttcatgaagcattttagccccaaggattagttcatactgtgggtcactgatgcttgactaatgatgtagtgcacatctcatagtatatataaaatgctagcttgtaagagagtggttactattgttgctaacaaatgtatgcatggcctcatatagaaaccatttttttcaccttactattcagagggtctgaaggttgtgtcatgtttttctttccctgctttgaagaataatttcaaataaaaatttgataggaaatagtgctaagactgccaatctgccaataaaaattcccataagcagggtcactttaacaattttttttttttttttttttgagatggagtcttgctctatctcccaggctggagtgcagtggcgcgatctcggttcactgcaagctctgcctcccgggttcacgccattctcctgcctcagcctcctgagtagctgggactacaggcgcctgccaccacgcctggctaattttttgtatttttagtagagacggggtttcaccgtgttagccaggatggtctcgatctcctgacctcgtgatccgcccgcctcggcctcccagagtgctgggattacaggtgtgagccaccgtgcttggccccaatattttatatttcaagtttttaagaaactcttttttaccacttgagtaaataatgttcatttcag

SEQ ID NO: 69066 - DNA, 1050 bp, Homo sapiens
agtatatatatatattttagatggagtcctgctctgtcacccaggccgaagtgcaatggcacgatctcagctcactgcaacctctgcctctcgggttcaagcaattctcctgcttcagcctcccgagcagctgggattacaggcgtctgccactgtgcctggctaatttttgtatttttagtagagatggggttttaccatgttagtcaggctggtctcaaactcctgatctcaggtgatccacccgccttggccttccaaactgctagaattacaggtgtgagccaccgtgcccggcaaaaatgttttaaaaaattatacacaatgtttaacattatttttaaaaaagcactggtaagtaaggcattaccaaaatgatgacagaggtaatactaagtgggattgtagatgagggttttcctttattaacactaaatagttgtatttaatggatcattttctttcttttctttgcccttttttctttttgcatttaccaggtcgcagaaccctagctgtaatcactaaacttgatctcatggatgcgggtactgatgccatggatgtattgatgggaagggttattccagtcaaacttggaataattggagtagttaacaggttagcagttagaatgggataagaattgggataagcattcttagaatgggataagcattctcacttcagagcaagtctgaatttctaaaatctgtttgaaatgtgatgctgtactatattttttctcccttttattatgatcttggtattgctaaagaatccgttgccctaaagggagaaaagagagagaatttttttttttttttgaaatagggtctctctctgttgcctaggctggaatgcagtggcgtgattgtggctcattgtagcatcaacctctgggctcaagtgatcctttcacttcagcctttcaagtagctgagactataggtgtgtatcaccacacctggctaattttaaatttttttgtagtgacaaggtcttgccatgttgcccaggcttgtctcgacttcctgggctcaagcaatc

SEQ ID NO: 69067 - DNA, 1178 bp, Homo sapiens
aggctgttctggtgaccagctcccatcctgaagctatctagggacccccagccaccagtcatctcattagcatgcagagacactctaaacacccttaatgctcttggagagtccaaggattttaggagctgactgccaggaaatgaagacaaagaccaaatatatatttcacagtatcacatttgccaggacaaattatttgataggttttccccattgtaaaaatttgacttgtttagggctttagaatacacaattttacttttaaatccttcctttctaaccttttttaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctgtaagtaagaaatttttctgtagatttggttacctagattgctaggtcacttttccttttgtgaagatgacttcagctcagattatctgattaagatttattttctataaaacaaaaatataactttgtagagataataggatgatgtctggttgtgtgaaaatatgctttgtaaatgatataaagcaaagtaaaattgtcacatatttttaaatattttaatattttataagtatttacttatttttataagtatttaataagtattaaatattttaataagtatttaaaaataatttagcttttaaagtgtttgtttctttagtacacacagtataattgctcacaaaaattagaaaatgcagataagtaaaaataaaacataaaaacaaaattacatgttggtgtgcacctgtagtcccagctactcagaaggctgaggtaggagaattccttgagctcaggagttcaagtccagcctgggcaacatattgaaattccatccttttttttttttaattgaatccaaattttattaaggatttcaagttacatacttcagatttctagaatggaatggaataattttggaactggaaaaatggcataaacactgatatcccttgaaacttcaattttataaagaaaattcttctgcaaaccacatccccattatat

SEQ ID NO: 69068 - DNA, 1470 bp, Homo sapiens
atggctgcttatgtgcttaatggtagagttgagtagttgcagcagagactgtatggcctgaaaagcctaaaatactatgtgaccctttatggaaaaagtttgccaacctctacttcagattgtgaatcaatggaaataaatataaggcactgtttcctgtcctcaaggaaaactagggcagagaaaaggtgcttagcaattcttagttaactgttgatttatgtcagaacatttattatatttacatatatataatttaatgattccttttcccctttaaaaaaattagagaaactagttcataatgagctgagttagaacacatggtaatgggaatgaatgaaattgtttatctgaggctttctcagaaaataagatgagcttaaagcttctagaaagacttctaacttgtatcttctttccctttttgcaatgccagaaaccatatacttcattgcctttcagatgcggtggtgctagaatttgttatattttccatgagacttttgggcgaaccttagaatctgttgatccacttggtggccttaacactattgacattttgactgccattagaaatgctactgtgagtatgtttagctttttagactgtaaaaaaaaatgaggttaaagtttttcttacccatatactgtgtctttttaaatttaattatacagtttattttgctctcatatttgaaattaaaaagcatttttcatgaaaagtaccaaaaatgtgactttcttaacccttgggaagaactgaaattacatatataataagagttctaagttttattttctcagggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggtaacggagagaaatgtaacaggtttcacatgaactagaaaaggacatgaagtggtggtttcactgggtggaaggaaatgtataagatgggatacaaggtaaaatctgtagttcccttacctgaaagtgatttgaaataggattcttaaatgtagtctccaaattgaattcagtatttctgtgatcattaagtaaaagaaaatgactgttagcctggcatggtggcttctacatgtagtctcagctacttgggaggctaaggtgggaggatggcttagtgagactatgacttaaaaaaaaaacaaaaaacaaacacgtttttctttcatctaccatttgtaggaattgttacgatttcctaaacttcatgatgccatagttgaagtggtgacttgtcttcttcgtaaaaggttgcctgttacaaatgaaatggtgagctactatagcatagatcattgtaattactattagtaaaagtttaaatttttgcttggctgctttttaata

SEQ ID NO: 69069 - DNA, 1172 bp, Homo sapiens
actacctcaggtccttagatgtatcctttacccaaataagttaacatctttaacttatgccttgttacgaacttattttcttattgttgaaaatgaactaaaaaagtgacagggaatagtggatgatctgaagttttaatagcaaagttgcataaagtgttggaatttagatttgcattaggtagatgactatttttccctaagagtaaaatacttgtagttactttaatgttatttttccctcttagaaatgcagttttagatgctgaaatgtaaataattttaaagctagagtaaattattgtttggcataagatttatcagttggaatataattatcaagtaatttaggcataagtttcctgtactttttcggtattgtctgtttcataagttttatatataaatttctcaaagtaaaatatggttgatgtatttttgtatatcgcctaacttactttttttctaggtccataacttagtggcaattgaactggcttatatcaacacaaaacatccagactttgctgatgcttgtgggctaatgaacaataatatagaggtaaatataattcttaaatgctttttcacaggtagaaaaatctgttgtaactcagttatatcaaacttatttagcatggagtaactataaaatagacatgtgccacattagtgcctgctgcatgtcaggaaatatgctgaggggattacattgttttcttaattctcaaaaccacctgcaggcattattactttctgcttatgaaattgaaattcagaaagaatctgaaaattcattgatttggtgtgactggctctattttggtaacttatagtttatacaggggaagtgtgtacaacaaagtatttaaaattcttttcatttggctttgaaagctgtgaaggaaacactcaagaattaaccaacttagcataaatttggaaaagcagagtgcttttttcaccactactggggtggctgcatttcatggatcttttctttccttttgattttaatgtaacaaattgaataagatctcagatggagccaaggctggtggacagagcaatttatccagaagccattttttttctctgccgcttttctccaaaaatagtacatttttctgctactccctaattcagtaagacctgagtcccctgctatacca

SEQ ID NO: 69070 - DNA, 1761 bp, Homo sapiens
tttagtaggcatatatctcaatacttggataatcacttttgttttgcttgtgtttcttaggaacaaaggagaaacaggctagccagagaattaccttcagctgtatcacgagacaaggtaaaaaaatgtttttaatgcatattcccaatacctaaagatagattgatgagctcagaatattactcagtcctaggagtaattttttcttcttttcctccctttaacactccattggaactaactgagtaaaggcatacaagtttaaaatgggttttgagtgatttaaagataatagtattttgaattcactgacataaatgcttaaaagtagatttaagcatttatttaagcatttaagcatcaagctttttaaaaaaattcagtcagtgactttatcaactttgcacatagctgaaatgactcaagattttattataataagagggtttcttggaaaaaacagtatgcacagaacagaggttttaattactagtaataattaaaatagttgtaatactaaagtgtgtataaaaatcttttaccttgaattctttgccagaaaagaatcttattaaataccaaaaataaaaatgaagcttttggatttggatttttcttatgtattcatctgaaggaaacttttaacaaaggtgacaatggtgaaggaaataaggcagaataaacaatctcccatgattattttcatctttcatgttattttacgatttcattacagaagggaaaaattcatttatagaatgttcctgaatgcatttttgcatccttgattttttttcccccctggattttttgcctttagtcttctaaagttccaagtgctttggcacctgcctcccaggagccctcccccgctgcttctgctgaggctgatggcaaggtctgttctgattcttaatctaagcctgcatgccttgttctctggtacaacataatcttctggaaacaatacactgaatagaagaatattaatatgggatactgtgctaaggtcagatcactttagtctaatatatattttaaaattatataacaatgcaatgcatagtttatattgttgacatgcttttgcttgcaatatagaagatgcacacagaaaaagtaatttaaagaggaaattatcctgcactttttgaatttcaacccattggtatttaaattttgcttgttaaattgcatgttttaacatatcttttaacagttaattcaggacagcagaagagaaactaaaaatgtgagtctcttgcttcagaatggaaatgttggtacctttggttctcactgaaacactgtctataccaccattaaagaacctgtttgtgtagtggtatctatctcttgtctgtgttatgttcttaatgttccttttatctaacctgtggaagatggcattaaacgttgttttaattagtaacaataataggctttctcactgttttgttaccttcaagaatagttttaaatttagtattttggtaggaaattcagagatttcctagatttcagagatggaattgtatttttggacatttcctttcctctttaaagatcttgagatctgttcagtactaatagatctaatgcttctttcttatgcttccagttagtttgcacttgttaccctatatatagcttcacatatgcttcagaagcttaagcaaattaaaaaaacaaatggggactgtgagagtttgagactgttttcaattcttgataaccattttagaggaaaattaaataatg

SEQ ID NO: 69071 - DNA, 1965 bp, Homo sapiens
tggtatgtcattcatgtatagttaacaaacatttaaaaatctaattactcatttttaagttaatgtgtaacataaatatactacttatatttaaatgtagttcaccttaactgacatactaaagacagattttagcaaatattttgattcagaatgatacctcaaactaccatttttctaactgccataatcctctattaaacttatataatccatttttagattgtaagatcttaaagaatacctaaaaaaaaccctcttaaatgttgatgaattgtttttccattataaagtcatttttgacttttagaagtcaagactaatacattttctagaaaacaaggtacaaaagcacttgtgattaatggtagcactagatttctttcagcaaatccttaagagtacagaggttgaggggacttctgttgtttgtcacattccgcatttgaaacaactcacagtgactgtcagcctaagaatagcaaatgtagtcttgctttttgttaaagagttcttacttataccttatggcatttttgttgactattagaaatgtaaattgagaaacatataaactcttaagttcagagacgtaagttcatggaacttttagagtttaacagtgttaatgattacttaagaaattaaactgaatagcagttctttgtgcttttaacgagtagttttgtttttaagggcagcatatacttttcctacaatttagtgtttgaagggtgggagaagaggaacgattttgaaaagttagcgaatgataaagaaaaaaggaattaaatagaacataagttggttgatgccttgcaaacaacttagagcagaacttctttattatttagataggtcagggttccagttatacatgctacctagtgtctccttctgacctcattatctgtctgaataaacttcagatgggtactggatgtatattgactactgtcaaataaaatgaactttgttttagttaaggtcagatatgatgtggttggtatgttttggaacatgttttttcaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtggtaagccatgacaatttggtttaggtaataaggtaggtgaccaagttagtaggaaaacgattagacagaaagaactaaaagtctcaaaaacttacataactttcagatgttaaagctgccattttagtgtcacaaaagtaatattttttccccctcatccctatttagccagttcctgttgcacgaaaactatctgctcgggaacagcgagattgtgaggttattgaacgactcattaaatcatattttctcattgtcagaaagaatattcaagacaggttagtattacttaatataaatgacggactttaatacttctggatgattctgtgatctgttttgaaaaatacatgtatttttacaattttaggtttttattctaaatcatcaagtggattttctgatagtccttgggtaacttgtagcaagacccattttgttaacatagaatgactaggacctcatgtatcagctagaaaaagctattaaaaatgagagattcttttgttctatctggctgccacattttgagtcatttaagaaaatctttttcctaaattttaatttagtagtttcattaattattttggctagtaacactgacttgcctttttaatttaacttggttttccaaagtatcaaaacgaatgtcttttactaggaaatatgtgtattttttctcgttcagaatgttttttcatgtgtctagtccctactgcatcttctccttcatgttgcctggtatgtcatttcatg

SEQ ID NO: 69072 - DNA, 4536 bp, Homo sapiens
aagtgattctcgtatctcagcctcccgagtagctgggatcacaggcatgtgccaccacactcagctaattttttatttttagtgcagacggtgtttcaccatgttggccaggctgctgtcaaactcctggcctcaagcagtccacccgcgtcagcctcccagagtgctgggattacaggcatgagccactgcgcctggccgagaactgcttttcttaatgtttaattacagttaagcaaaaatctaaagggcgattatgccattaatgaaatatccaaagtagtagtgttcttacttaactttatttcatgaggttagcatctaagcccaaattgttaaaagtagaattttggctaaaattccataatttggttgtgttttgcagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggtattgtggaccttttgattttttatacttgggtagtagatagaaacatagaaatagttttaaatgcagtttgattcttggatatgtatagtctttatattctagctaggcttgtttcctgttggtacttgataagaatctttttttttttttttttttttttttgagtgggagtctggctctgtcgcccaggctggagtgcagtggcacaatctcggctcactgcaagcgccgcctcccaggttcacgccattctcctgcctcagcctcccgagtagctgggactacaggcgcccaccaccacacccagctaattttttgtatttttagtagagacggggtttcaccatgttagccaggatagtctctaactcctgacctcatgatccgcccgcctcgacctcccaaagtgctgggattacaggcatgagccactgcgcctggccggtacttgattagattctaattccagagaagatattggttagtataaactggttagttataaacctaccacatatatattggaaaaattaccctgcgtaattcagattaatttcataactttataataagcatttaaaattttttttcctttaatgcaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacactaaagtttgtcaaaaaatgaattcttaacttttctcccagagaaagggagacaaaaggagctttttaatacctaatctactttggaacataaccgtatagagtacgaaaaattttacgacttttttcctaccagattctgacagttcaccaaggtattataacatctccatttttgcgtatgaagacagtgacttgctccaagtaatccaggtagtaaatggctagaatttgaacactaaagccatgctctgctgcctgtaaggttttcaaaagaaatctgattaatcatttcgtatgtgattcacttgatcctcaaggcaacagggatgccattgccttgatttttcagatatggaaatagttctggagaattaatttgcctcatgtttgaagagctgaactcagtcttgattccaaatcctttaagtttgacctgaaaactttccttacctggatactttttgatattctcatatgattgcatatttggtataattggctttatttttggggggttaactttttaatttacctcaagttgcaatctgcttggggggaaaagctgaaacttaaaaccaatttaagtttctaaatttataaaacattgctaccttaggaatccactgacaacaaggcttaatgtgaacagaattatactggaacacaggcaaggaaccagaaaactgaattagaaactttctgaaaagtcacgtactgatttttgtactattatttgtaaagaaactacttactgtaatttctcaaagcaaccatggcctcatctaactttttctcctttttaagaactacatttgctctctgaactacaaaaaaatcaaatttctattcaaagtttctaatactagttttcccatttctaatgtggacactagaggccctgatgattttataaacaactatataacattagtgacatcggtgctccatacctgatagaaaagcagctacaattccttttttttttttttttttttgagacagagtttcactcactactcatgctgtctcccaggctggagtgcagtggcgtgatctcagctcactgcaacctccatctcctgggttcaagtgattctcgcagctcagcctcttgagtagctggggttacaggtgcctgcaaccacatctggctaatttttatattttcagtagagacggggtttcgccct

SEQ ID NO: 69073 - DNA, 1059 bp, Homo sapiens
atcactaccccataaatgcagcttaggtctgtaagtctgaaggagtatgtgtatctatctgggtgttgttttattttttttttttgagacggagtttcgctcttgttgccaaggctggagtgcaatggcacgatcttagctcaccacaacctccacctcccagggtcaagcaattctcctgcctcaccctcccgagtagctgggattacaggcatgcgccaccacgcccggccaattttgtatttttagtagagacggggtttctccatgttggtcaagctggtctccaactcccaacctcaggtgatccacctgcctcggcctcccaaagtgctgggattacaggcgtgtgccaccacgcccagccttgggtgtttttctttcagctcctccagtactttcatactattctaataaatatattttgttggtatgaagctatgaagcaaaagtagctattaccaatgcatacatacagtacactggttttaagttccacctcaaagtgaatcttagagcctggtgtaagtgctccactttagagatgtaccttaattactactgtatttgcaaattaagggaaatttaggtcatcatttgattttctgaaatctaaaaggaactgaccatcattaccaagtctttctagataatcaagggtagatggctgtttttaatgtaggaattaatgtaggcattcctgctttcaggtttaagtatgaatcaaagcatattttaatttgctagtgcaaatggacccagaattggaagggctatgtaactacacagtatgcacaccacagccatgtcagtgtcacagatcctcttgtgcattcagctttcttaaaaacacatcaaaggctgcaaagaagctcagaaaaaactaaattgaaggacaggtggaatacaatgactctatgtgaggaacttgccaactcacatctttcaaagccagatcagcttatatagtacatgcattatagtcatatgaaatgttgtcttggtgctttcttcttggaggactatggcagcagctttaagactactaacaaagattat

SEQ ID NO: 69074 - DNA, 1096 bp, Homo sapiens
ggatcacttgagcccaggagtttgagaccagcctgggcaacacaggagaccccgtctttacaaaaaaaatataaaaattagccaggcgtggtggcacaagcctgtggtcccggctgcttgggaggcagaggtggtagaattgcttgagcccaggaggttgaggttacagtgagccatgatcatgccactgcactccagcctgggcaacagcaagacccccatctcaaaaaaaaaaaaaagaaattgaaaacaaagatgccaaaatagtaacaccttaaatctgggtgatgtgtgcatgggacctactatgttcagtacatttctgtatgtttgtttcatatttaaaagtaagcaggataaccttaaagggtagaagagctggagataaaaattaggtatgttatataagtgtaactctttattttttgtctcaaaggtacctgaagctgttcactttcctgccccttccagagattgatcatatcatgcagctgcatgtcaaagagccagaaaggcggggtcctcagaaacgactggcagcagaagtaacaaagcttgttcatggacgagaaggattggattctgctaaaaggtagtagtttagtatgattaacacttgatagttagttattcagtggatagacatgagaaaagtaggagtatgttttaggattatcttgtcatttatcacaaggactgtcagtatttgacttagcaatttaaaatagcccctgtttattggaaagaaggattatcttgaattaagtttatgaattataccagatagatgtttaaaaaacttttagtctatgccgggcgcggtggctcacgcctgtaatcccagcactttgggaggccaaggtgggctgatcacgaggtcaggagttcgagaccagcctgaccaacatggtgaaacccccatctctactaaaaatacaaaacttagctgggcgtggtggcacacgtctgtaatcccagctactcaggaggctgaggcaggagaatcgcctgaacccgggaggcagaggttgctgtgagccgagatcatgccattgcaatccagccggggcaacagagcgagactccatctcaaaaa

SEQ ID NO: 69075 - DNA, 1479 bp, Homo sapiens
aacaagtaagtgcctttaaaccttggggaaatcctgggaccaaataatttacacactagtagcctgtgattcactcttaggattgtagttgctgcccttcgttccagctcttgttggttttatccccattaaggctctataatggcgttaataacactggctaataagaattaaagggctgaattaagggtattaagagtaaacggtgtattctaaaaattagctgggcgtggtgatgcacgcctgtaatcccagctattcgggaggctgaggcaggagaatctcttgaacccgggaggcgaaggtttcagtgagccgagatcgcgccactgcactccagcctggggcaacagagggagactccgtctcaaaaaaaaaaaaaaaaaaaagggaaacagaccactagtgaagatttggtcggtctgttttgcttcgcctaagtcgtcctctctaattagagaaactgcttttgtgtgtttataccagaacgtgactgggcctccttgagtagctagcctctgctttagctctgcaccctccatgaaactagtgttagtccttggttggtatctcaaaaagttttttcaactccaaataattgacaagtaatgcgggtctaatagcattttcttgagagaggtgaaggatagggctagctcatgtgcaacagagcaaagcacatgtttaaaaggcgtttagaagatttcctttagtgtctcttcctgacaccccttcacccagttttctccttcccactcagcctttcaaaatctctagtccattgttatgtagcacttccccttggcctgcctagaacctgcctggaaccactcatgaggttcagaatgaatagagtaagtactgtaacaatacataagaggaacaagaattcagatttaggaggtcaaggaagttttcctggagcaagtaaccagaaagaaatctggaaggtgaacagtagaacctaccaccacttgtgcttgaggcacataatgaaattgttctttatgcgtaggttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaaggtgagttctgaataatgggctgagaaaaactgacaccataaactcatgatgtaattttagccattgaatctatgtacattttatagtttttttgtttttaacgtagtttctgtctgtacataaaccattacatcatagaagactaatttttactgtgttctaaagttaaacactttgttggttaaagcagaaaaacagtgggtggctagaaaatgtagagccaactttttgatctgtatctagcaagttcttaggattttatcacctgcatattctagttttttcactcctttcaa

SEQ ID NO: 69076 - DNA, 1033 bp, Homo sapiens
atggctagtaagttacgtatctaagctatacagttgttctggacacactctttagaaagtaaactaaaaagactcagcctctacttcttagcattgtactcctgactgttcatgaaaaccttagcttttctagccatactcattgcatttcccccaggcaacccgcagtttaagcacacccagttgcatctggtaaaccttgtaagagctaaagcctgtgtcctgtgatatcacacctgcaaggatatctatatgtatacgatcaatattcttgtcctgttttctcaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagaggtatattgggaagtttttgaaagaatgagaaagggagagaatgagagagagtgtgtgtttgtgtatatgtgtatgtctaagtacttggtatatatcggcactattttaagttattttaattcttacatcaaccttttgaagtgtgtattattaataccctcatttaccagtgaggaaacagagacacagtaagattaattttcctggaataattcagcaaataagtggaagagattgaatacaatgccaggcagtctggctccagattttcattgctacccatgaaccgtactgctttatgccttataggttaggaaataagcttaatgcagcatagctaattgtatataaattgtttttattaaagtcggccctgatatttggccttgggtattctaaaaacaaactttggacatactaaaagcaaacctcataggaaggaatacatatttatttccatactgatatgaaaactaagagaatgtaacctcccctccttctctgagtatcgtggtatttgtggaaaccagctggtaaatttagaaccctggtgctatcctggacactttcacaagactct

SEQ ID NO: 69077 - DNA, 1050 bp, Homo sapiens
atactgaaatttagaaaaccacaaagaatgtagtccaacacactgtctttacaagtgaggaaactgaggcccagagcaactttaagttacttaaagttaaaacatggggcaaattgggacttggcatccagtatattataatgtctaatgtgccatttgctcttgttctagttgcaaaaacatttgcctcatatccacactcaaaatggagtgaagattaagtaaataatgttttgatcatggtacttggagtgaagtagaagacttatgacacaattacgtgttgtttggaaatatttagaaagtatgttcatagttgatctattaagcagtcaatgatttgttgactgggcaagtctgccacacttttacaaatttgccagtttccaaacacctggaagaagcatcaagtaaaacttcaaaacaaagacctgttggatacacagcctagacttacttttttgttttttgttttttctgatagaaacatgagttctgctggcgctgatgggagaaaagcgatgagaagatgtgacggactcattgactcactggtccattatgtcagaggaaccattgcagattaccagccagatgacaaggtaattcaagagataaatatcctgttttgtcttactaagatgcttcagaatattcttaagatagccgcttggttttaggtttattcactgattcatttactgagcctaagatcttccattcatccttagaaatattaaaacctaggccaggcatggtggctcacgcctgtaatcccagcactttgggaggctgaggcaggcagatcacgaggtcaggagattgagaccatcctggataacatggtgaaaccccgtctctactaaaaatacaaaaaatatagccgggcgtggtggcgggcacctgtagttccagctactcaggaggctgaggcaggagaatggcatgaaccccagagcttgcagtgagcagagattgcgccactgcactccagcgtgggcgacagagcaagactctgtctcaaaaaaaaaaaaaagaaatattaaaacc

SEQ ID NO: 69078 - DNA, 1055 bp, Homo sapiens
cttggctcactgcaacctctgtctcccgagttcaagtgattctcctgcctcagcctcctgagtagctgggattacagatgcccgccactatgcccagctaatttttgtatgtttagtagagatgggtttcgccatgttggccaggctggtcttgaactcctgacctcaggtgatccacctgcctctgcctcccagagtgctgggataagaggcgtgcgccaccacacccagctgaaaaacttttgtagagaatgttttgataacctttgatcacttgccatatcccagggtggtgtgaaactagcatttaaaaacattaacgtacgtttaatacttgttcttggccttcattacttaaatttaaaagtttaatacatcattgttatacagtctgtaaatattaattagcctacttgtattctgagttattttaatatttgcttgattgcaggaaatcttcaccgaaccagcagtgttcctgagtatgtctacaacctacacttggttgaaaatgattttgttggaggccgttcccctgttcctaaaacctatgacatgctaaaggtaggatatcaaagaatgtaaccctagtgatcagattactaccatgaaaatattttcaaacttcctaagattatttttgagtgtttacttttcccaagtattatcatttcctaaatgagttttgagaaaattgatatttatgaggataccatggaaaactagggatgtgaaacattcttacatcctagtgcaaataaatatgactcaagtcaaccaagtcttattttcaaaaagcctttacccagaaaggggcaaacttctcgtcatctgattcagagaaacggacatgttgggtaatagtcccagagtaattagtcctcagcaaagttgaaatttgatttatgccccctttaaactttatttctctcatgtgcaggctggcacaactgccacttatgaaggtcgctggggaagaggaacagcacagtacagctcccagaagtccgtggaagaaaggtccttgaggcatcctctgaggagactggagattt

SEQ ID NO: 69079 - DNA, 1033 bp, Homo sapiens
ctgcagggcagcccctccctgcatcgagcggaaatccatcctgtccagcgcggggcgtgggcagagcggggcgcggccccggcaggcggtatccgctgggactccgacaacgtgcgcgaccccaggcgaaccgcgcccctctccccacctccccgcgggcgggtacaagtctccaggtgtccgcgcgctcagcgggtccggcccgcccccgcccccgcccccgggcccgactgcgcgtgcccggccggagccgcgccccctcctcagggaaggccgggcgtccggcccacgaggccgagctcccccccggcccgggcctctcaccggcgcggggggcgggccaggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggtgagtggagcccgccgctccccggcgccgccccctgccccacacccggtcacctcctcctatcccgccctcaccccgcgtgctgggagtgcgggaccccgtgttctgcccacctgttgctcgccgtcttcggtatgaccgacttgcttgtggaaagcactcttttccataacctattactcagctttgtcatataggtacctatgtatattaaatattgtacatatctatcaatgttaactaactcacttcaagatttcacccctttctttttctactccgccggtccgcgcccctcactggtgcggacttaatttgaaggttcagggagtctataaacaccttgagatgct

SEQ ID NO: 69080 - DNA, 1053 bp, Homo sapiens
cttgaagaaccagagacccgtcaatgccgaatgaacttcagtgagaggagtgtttgttcgtttgtttgtttgtttaggttaagagagaactctttcaaaatgtggatgctctcagaggatttagtaaaattgacactcctagtgcactctcatagccatattaccctgtaggatttggaagaaaatatatattttagaatttgggatgttttaggtgtgcctgtaaattaggttgttaatatttataaggcagccttctgtttttcctactaaatcataagcgtgaacatcttagtgggtggcattatacatcctttatgtttgtagtcccccaaatggctttcacacagtaggcacttaaatttgtggacttttataggctgtgtagacatcatcaaattcctgtattctgggattaggtgttgggggcaggagatgtggtaaataatttgaagaatgccgaagataaattatgtgttggaattttgtcttgagcatggttggccatgttttgtagaaaaactttctctcaggtaacctcagtcaggttgcctttggcaggcatatatcagattgagtcgggatttaaggttgcaaacctcagagttctcaattgagctctttttctgggttaaaaataattcagtatttctgaacttaagaaagtttcttaaatcaagctgactgcctttccagtctgtctctgcctgtttcctcaatgataagaggaggtagtggtgaatgagggctgggacgggaatatttacattactggaataaaatcatgtcaggattctactctgatgtgatgcttagctttgctttaaccatcatctcccattttattattgattccatgctgtacttatctgtttaagtcacttgtaacacatctccagatgattcagtcttcaagaggttgatgtgatctacgagtaattagcccctgacctattgacctgctaaatcgtgttatatatactctgcagcttactgacccaccctagaaatagtgggccgtttttaaagggagtagaacaagactagacattt

SEQ ID NO: 69081 - DNA, 1050 bp, Homo sapiens
gaaacgtcgccaccttctggtaagtgatggaaatgagcaggaaaaaagatccaagctaagaagcggcttttttttttttccaaagcagcaagccacgcccctcccgcgctcgcgaaatccgagacccgccctttccggaagttttgacactgtgcgccccgagtaatgtgatggagagggtaatcatccggtccgttatctaaacccgtcactccaggaaacagcgacccgctgttttccggatccgcgctctcccagcatcctttgccttccggtatgtggccccgtctggctagtcctgtctagcgcgcccatttcgagcccaagtttccagctcgggtttccgggctcagaattttccaggagtgggttcttgggcagtggctgtgggagcaggaatggcgcagctagagggttactgtttctcggccgccttgagctgtacctttttagtgtcctgcctcctcttctccgccttcagccgggcgctgcgagagccctacatggacgagatcttccacctgcctcaggcgcagcgctactgtgagggccatttctccctttcccaggtggggtgcccaacctgtccccaccccaggagaggcctgaaaggtcccagcgtccccagctccttctcccatctttagacttaactcgtccctttccaccccaccccagcctcagaacatgaaagaaactgggtatagtcttttgttcctgtctctgagatctgtgaaatatttattaaatgaatgaataaacagcagatctgatccccagggaggagtgatctgggagaatacttagtggggaactgagcgctcctcttggcagctgacaatatcgatcccactttgtttttccttgtctcaggattaaaggcattcgggtgctccttggaaatatcagaaaacttccctttagctcacctgttaagcacctcactgtgcattttaggggtgggatagggtggactggagggatcttcggctaccaaaaagtgacaatttataatcacaaattccttccctgggtatttttagtgaacta

SEQ ID NO: 69082 - DNA, 2706 bp, Homo sapiens
attgattaattttatttaaataaggtttgagtagttgagtagttttaaataaatctcttcattaggtaagcagaaatagcatttatcattaaaataattgtatctgtgttttttcttcctccaaggctgcctcaagtatccagagagtcttgtcaacattaacactagcagtatttccaacactttatttttttaacttcctttattatacagaagcaggatctatgttttttactctttttgcatatttgatgtgtctttatggaaatcataaaacttcagccttccttggattttgtggcttcatgtttcggcaaacaaatatcatctgggctgtcttctgtgcagggaatgtcattgcacaaaagttaactgaggcttggaaaactgagctacaaaagaaggaagacagacttccacctattaaaggaccatttgcagaattcagaaaaattcttcagtttcttttggcttattccatgtcctttaaaaacttgagtatgcttttctgtttgacttggccctacatccttctgggatttctgttttgtgcttttgtagtagttaatggtggaattgttattggcgatcggagtagtcatgaagcctgtcttcattttcctcaactattctactttttttcatttactctctttttttcttttcctcatctcctgtctcctagcaaaattaagacttttctttccttagtttggaaacatggaattctgtttttggtggttaccttagtctctgtgtttttagtttggaaattcacttatgctcataaatacttgctagcagacaatagacattatactttctatgtgtggaaaagagtttttcaaagatatgcaattctgaaatatttgttagttccagcctatatatttgctggttggagtatagctgactcattgaaatcaaagccaattttttggaatttaatgtttttcatatgcttgttcattgttatagttcctcagaaactgctggaatttcgttacttcattttaccttatgtcatttataggcttaacataactctgcctcccacatccagacttgtttgtgaactgagttgctatgcaattgttaatttcataactttttacatctttctgaacaagacttttcagtggccaaatagtcaggacattcaaaggtttatgtggtaatatcagtgatattttgaactgtaaaaatggacttaataattagaccatttctacaaagaacaactgaataggtggaaaacatggaatttcttttaggtgcagtggtggtcctcaaattacattagtttttttaatatatattttaaacatatgtaagaaattaagtggcaaagaactgggaaagcttaagacctgcttcaaaagcctgaataatgggaaaataaaattgttttcagatatctcatatcgctctcgtaatgttggcccctcacaaagcttgggaatgttttgtatgtataagtttattaaaactgggtatgcttcatattactagaactaatttattctcttcagagagaactattaggttagtgcaaaagtaattgtggtttttgccattgaaagtaatggcaaaaccacaattacttttgtaccaacctaataacaatgtgttagcaaatatttacaaatggtcaggtgatattcttgactgaaaagttccttaacatttcagtaaatataattttaattctaagtcaaaatagaaatgcatagatagtaaatgataaagtagagactcatatatgtctgtctaggcatcaaattgttggttattgtttacaatccagaaatgatgaagctctttcactaattcctaatatgaaatgtatgatggccaaagacaaattgtgttgattataatcctttaaaagggggatttcctttatgaaatacatattgtattagcttcccagggctgccataacaaatgaccacaaacttgggtgcttacaacaattttcctcacagtctggaggccagaagtctaaaatcaaagtgtcagcagagttggttccttctggaggctctaaggaagaatccattctatgtctgtttcctaatatcttgtggctgtctgcaattcttggagttctttggcttatgggcatatcttgtctaagtattgcagacagcaatcttcactccagtctctgcctctgcgttcacacggcctttccctctgtcttttcattaccttttaaggacagtgtctttgaatgtagggcccaccctgatctagggtgattgtgtctggagacccttaattatgtttacaaagacccatgttccaagtaagtttgtattcacatgttctgagtagacattgtctcttcatgggatacttttcagtccatgacagttactaaaggacattttaggataatcctcatatgattgttaggagactacctttaaaaattttttattatatatcaaattatagttgtatatacttatgaggtacgaagtggcattatgatttttgaatataatgtgggatgattaaataaagctaatctatccatcacctcaaatatttgacatattttgtgatgaaaacatttgaaatgtactctcaacagtattgaaatgtacatacagtgcttaattattagctgtattcaccatgttgtgtaatagatctaaaaaaagtcaaacatattccttctatctaattgaggctttg

SEQ ID NO: 69083 - DNA, 1903 bp, Homo sapiens
ggtgaattttccaaaatagataacagataaaatgattatgtaagaacttggcacaacagatcattttgcctttagtcgttcaagaaatgatactaaactcaaagtcattcacttgaaacaactgagaagaccattcttaggtgtttagatccttgcttttagaaacattcttagttatatttgtgttttcaaaagttattgagtagatagatattttttcatgaatttttaaacattagacttagctgaattgattaaaattaggtgattatgaaaaaaatattgccctgctcgagggcatctggagccctacagttaccattactaaagtctgtgagtatgtctattttgaaaagtgtcataaaaatatctagtccataaatcattataggttcagtaatacatcattttgaactgattctatcttctgtgaaattctagagatatgttatctttaggtagcatgagtaagattcaggtatgctgtgaattttgttaacgtttatgttttccattaatggatagtcaggaatcttttgaactgcgtctatgtatttaaatgatttggaaagatagcatctctcagtttaaacttagcatctcattttggcaagataaattattttagctgtctggccttttctttgtcttcttagagttatttctgaaatgtgcatagccagtcataaaataacttgtgtaaatagcctaatgtaatttatttctaataaatacgtagcttaatgaaatgtatttctagtttgaacttaattgccacttggcttgatattattttccttagaattgttggaagagaggagagaggaagggatctaccatttttatttataccacctaaatagtggactgttattttggactcacttttaaataaaatatttattcacatgaagaaataaattttgtgtttattaggttagcaagcgtttattatctttgaagtaattggaatttcattaaaaagtgaagcaagtaagaattgtgatataaatttgaaaatttttaaatggaaattgaaatatgacttaggaactgtgggcttgtagaaaaaaacatttaacatgggagttaagatttttatatttggttgtggctctgggatcaataaggcaagtggtttagtctttagtcctcatttcaaatgagaatagtatttgtcctaactctagtcagtgtctgattggtatgtgtataaccttattttaaaaaggattcattcctgccatatactcataatatttataagtatgtcatatgataaatattgagtaaatatatactgaatgaagtttttagtatagagtgaagtgaatagaaaaaacatcctacataaccgtggctaattttaggaagtaaatcatgtttcataataagagtcatcctaaacatttttctgtgtaattttctgacccagtgttaacaatttttatttgccttagtgcaagcttgttcaacccacaggccacatgcagcccaggatggctttgaatgcggccccaacacaaattttgtaagctttcttaaaacatgatgagatattttgtgattttattttattttattttatttattattttattttattttattttattttttagctcatcagctatcattagtgttcgtgtattttatgtgtggcccaagatggttcttccagtgtggcccagggaagccaaaagattggagacccctgctagcatttaatgcttatacatgtatttacttgtaaacatgttgtttctttgataggatatgatttcaacataattactgtttatttaaaataagaaaaacaaataactttcaaccattaaaaggttataacactttaaaggaaagtttcttattaaagaaactttataccctattaagggtataa

SEQ ID NO: 69084 - DNA, 2883 bp, Homo sapiens
aaaaatattaaatgtattggtttttcacagtgaaacttaattcagtttagttgaaccatatatgtgtgtgtatggcatatataagatgaaaaaaggagaaaaagtaacaataataatgatggttgccatcattcattgaacacctataatgttttaggcattatactagctgatttacaaatattgtctcatttgatgctacatttatatttctatgaggcagatgttgatttctctttgactgctgaagaaactgaaggtcggtcaggtcaggtgatttgcccaaagtccacactgtcactaaatgaacatagattggtatgactcccaagcctgtgagtttttgaccgtcatattctgcctcactatgaaaagttttttttcaattttttttaaatcaaaagaagtagtatatggagagagaggtgaaaatccatgtttgctctctgcagtttccaaaccattcatgacgtgttatttttgtactggatatagtcattttttaaaatgctacaaactgttcaaaagagcatgaacaacatgataactccttataattttgttgtaagataaatgactaaaattatgtgggatatttaatttggataagtggaaattctatcacttgataagctctcttgaagaataattatttgaaagattggacttaattctgtattgcctgaagtgtaaatcagaggtcaacaattagattgcaaatcatgaaaagcataacttctaattgtttagtctttttagggaaacaagcccagaaaaaaagtaagattctcattcattggagataagatttctatttatcaaagatactacacaagagttagatagcaagtagttcaaatgtcttttaaaggtatctgacatctttaaagctctgtaatttttaaattctaaattttgttacagctaatttttaaaaattaattgctaagtcatggtcaagtatttctgatgacttacatgctgtctttggtatattttaagtttctaaaccaaaactactatttgactctattacaccctgttttagaaaaacatttgagttatacaacttactaaaatgtattttagcggtgatgttttggagcactggtaatatagtgtttaacttattttctattttttatccctctatattcgtgaaattacttctatttgaaaagttttccgccagtgataaaaaaaggctgagcactatctgtaaaaatttttaaggtgtccactaggtggagatattgtgctacatttccaagtgttgtagttaaacttttattagtctgaattaaactcttttatagtgttttattgttttaaaccacaaagatttataatcatttatatctatttatctaatgttattcaaatgttttctgcgttgtatgaagctaagataaatgtaaaaaaaacaaacaaaaaaaacctcactttgtgttttgtaatcattagacgatttaacctaatatatcttcccatatgatatgatctttgcatatggcatacttcattcatatgacatagttagaatcttttcccacaaacaatgagtgatgatatctcatttgaaaactcgtgtaacattgtatcagccactgttataaagtgatttacccatgttagtctcataacaactctatgagatcagtaccgtacacatggggaaacttagtatagagaggtgaagtattttttccaagattacaaaataactgtctgagctgggattcgtaaccaggcagcctgactccaaaatcaatattcttaactctattgttatgatggagaaaggcatgaagtctaccttcaaattcatggcattttagaaggaaaaattgtcgcaagtaatgtgattatacttcctagttttataggtcagaaaaatgaggtccacactaattttgcctcttccacagggagatagattctcatctaccattgtgtcttttgtttctgtttttgtcatgatacctcaaattgatatatgttgtaattatgaatttaaggaagtaaaaaaataactcagggctggagccttcagccatattaacatacattgacataaagacctttgttttaatatgaatgattccagttaacaaatggagaaatagttgtttgaaaattaatatttagcttctcaaaagagactcctgtttggaagcaaattgttggtttaacaggacatactttagatatttgaaaaattctctgtggaatcacaatctcttatttttaagaatgtaggaatatgtgttctatatgcttttaagttatgtattacatactattctctaaaatagaaatgtttatttggcttctaaaagtcatttgtgagttgatgttatttaaaactgcttttcagtcaacttattctttataaaaaagtttgttcaaatagcatgtttttattttgtttctaaataaattcatgtttgataatattttataatgtgttgtgtctattttttttttttttttattgatcattcttgggtgtttctcgcagagggggatttggcagggtcataggacaatagtggagggaaggtcagcagataaacaagtgaacacaggtctctggttttcctaggcagaggaccctggggccttccgcagtgtttgtgtccttgggtacttgagattagggagtggtgatgagtcttaaggagcatgctgccttcaagcatctgtttaacaaagcacatcttgcaccgcccttaatccatttaaccctgagtggacacagcacatgtttcagagagcaccgggttgggggtaaggtcatagatcaacagcatcccaaggcagaagaatttttcttagtacagaacaaaatggagtcccctatgtctacttctttctacacag

SEQ ID NO: 69085 - DNA, 1136 bp, Homo sapiens
gttatttttttgaactgtccagagaaaacaaaagttgtacaattccttgtataaataatagattgctcaaacctagtgggagtaaatggccaggaatgaagcaatttctctttacaaatgttatcatttatatggctgagaatgataatcagaaacttatgtgaagttaatgctacatgtaagattagaaaatacgtaaatcttgtgtattcattgcaaaaatgtagtaaaccaagattggagggattaagtgatgtatccaagactatataactagagaagagctcattaccatcttggaaatatttgttataacttacattttgttagttgctattaggtgctatgcaataggaaatcccagagacatgcttcataaaggaaaacacatagtaatagttgtacatacaaactggttatcagggatatttacacttacggtaatgagcaacaagaaaggtatatattgagaaggggtgatagattcaagtcattaaacctgctgcagaagtcagtcttcaagtggtgccctcaagaaccccagagactttgggcactgtcctatctttgtaatctcatttccttcctctccaatgaaagcctctaattatcatttgaactccaggatgaactcttggtgttattttcaagtatctccatcatctgaatttgcccagttatgtaataccaattcctattgcttctcaaattaatattaaaactaaccaggcctgcctcattccttttccgcaaccactccgagtttacctggagtctgtctatagtgttcatactctgttctctcatcaagccctcttctctggtctttacctgaggatatcctttgcactttccaactcaagccccagctcctctgaaccttgttctttaaaacttcaatgctaacaataatcagtactttctatgagctcatctttgtattgcatttcagcatattaattgcctcagattatttctaaactattttattttatctggggcatcttgtctctccatccttatggaatagtatttaatggcacctggtaaatttttaaagctccccagtttattgtaatgtgtagctagagtgtgaaattgctgcaactaaagactattggatgactcaattacta

SEQ ID NO: 69086 - DNA, 1052 bp, Homo sapiens
caaagtatggatgtcttctctaaatctttctttctttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactgtctggacaaacacaattgcaaataagggaagggaaaaatgcttttctatttttcagtaactggattgtcttaagaaactacatctgcttaataaacaatttctcagcaatgtttgctgggtatgggagtttaagcccggcagatgtgtctcctggttgaacatgcatttttcatggagtttgggttctaaatttagactgcagttggtttgtattttgtaacactaagtagaaattataaaaagtcaaacattgtgatctataaatgcacagaaaatactttgtaaaaagtagcatccttatataataatgctatttagaaagactgaaaccaagactatttaactgtgaactatgtagcagatgttttaaactttttattccattatatcttgtctagatattttaattcaaagggatactggctctcttgatcggaatttcttgttatcaccattccacgttgccacacaaggtgcacaggctggaagtcttttgtgaaattcccagttaaatatatacaactatgtgacttagtgcacaacacatttgtgaaataacctactcctatatactgacctgcctgtccacgaataattgtaaagggtttttgcatgtacagtttttacaagaattacagttttgtgaagttgtgtctaaattaaagcatttctttagaacaaatggccttaaattctcacggaattcctggaaatgattgtgaattgccttcaaataatagaaaagtgtatttatttgtg

SEQ ID NO: 69087 - DNA, 1056 bp, Homo sapiens
aagctcttctttagctaaatacacacagaaacagacaaacacactgtactttatcttaataaactaacttcccatcatacatttccatggttcttgcttttactttcacttgtcatttacctggaatactcttcctcctcatctgtgctgatcgaaatcctatactttcaaatttctccacgtatagcctgtcacacagccctctccaaagacctcactcgccgcacctggatgaattttcactttgtccccatattactttatatcttcctaaaaataccggtcattgtttgtctcatagttatttacagataagaaaactgaagccagccccagatcaaaagttaaacaacttttggaaagttatttaggtcataagttggtagatccagatttccaagagtgttctggttctaaaacctgtgttactcctattataacacactgtcctaaaagacaaaattataaagaaaattattaagatctattaccctttttgtattactgaagtggctaatcaattcaagtcagatccatttgagttcaagtagtgattctgacatactcagagctgatcctggataagttaattaaactttctaagtttcagtttcctcttacgtgcattaaaagtatataagatatttgtgaatattaaatgacatattgtgctaaatcgcctagcagaagacctcccaactaccagttgctcaataaatgcgttattatcagtacagtacattggtacagtccagtaggaaggcattttttttgtcattatttcatagtagctgtgccctaacataagaaaataagttacttaagttttagaataataaccatcctgcttactgtttatactatagtgatatgaaattaaatattgaggcaatgagacttaatcacaaataaagcttactaccttgtcataagtcaatatacgtaaaggctttctatttgtttgtttatgctgtggattggccattgtgtataaggcagtgccattccgcctggctgcatgtagctgctggccagcttatcatttcctgaaaaatt

SEQ ID NO: 69088 - DNA, 1111 bp, Homo sapiens
agaactggtagaatggagagatgatagacccagagacagtttcacagggtctacaaagagatagacccagagactggctctgctcacctttcaaagagtcacaaaagatcttggttcactttctttgtctgtaaaatgcacacttaatcaagttttgtatgagaaatgaatgaagacatgaagggatcaacatgctttctgtcttttcatagcacattttgctacttcatacatcttgatttccttgttgtccacattgttttagtatttggctaaaatgtactgaataaatgatcatattttctcttaaagcaatggtcgaattggatggagatgatgtaagagtctcctctagaggaaaatatgctgaaagagacattgtgcaggtaagaaataaaccttttcctactttactattgctagaaaatatcattgggatctttaacaaaattagaagctagaaatataacagactttttaatgatgcttttctatttgttagtctcaacaaaaactaaatatattttaatctggtagatactcagagtgaataaatttagtaaaaatataccaaaaactttgtatgtattttcatgcttccctcatacattatggttagaaaaaatagagaaatagatcctaaaatatgtcatatattaaaaaattacatctacatatagaaaaggctagaattaagaaaaatacttaagtaaagcgtattactctggaagtgaatataaacaaccagtaattaaatgtagttcaaattataattgaaagcaaggcgttaattcaacttaatagttgcataaaatttccatatttttaggatgtcagaaaaaaagctgtgaagtatatctttttggataggaaaaggaagaaggtctcagtaccatttaagcacatggtatcaaaattttaagggagcaaacaatgaactttaatattatttcctaaatagtaacatatatattcacccataatacagtcattaatagaaaataatttgtgattgtaagaattaaagaaagaggagagaaacacaaagggtggctcgacagtcaacaggttttcaaacctgggagggacttttgactgaattagatcagaa

SEQ ID NO: 69089 - DNA, 1078 bp, Homo sapiens
ttggtaggctaaaataactcatgctttcttctttggctactatttgcttttgactttgaaggatgtatctttcatgggtatatctcaggtctctcagactcctatggaagtccacctttaggcatatgacctcagagatggtaaacctcaatcagttctttttctttgagagctcccacacctgattcataaatgcaaagccactgacccttcctggcatatatttctggtaacacatttctatacagagcagcaggcacagccgttttgctactgcccttatccaatagccacagctatttattttcttcgtttctttagttcccagcaaatttgttagggttttaaggtatgataattcatcattttctctctgtgaggtcctgaactaactggaaaaaaatatatgcaagaatcattcggatcactctatcagctttattactagcaatgcagaatttgagaacttgggttaacctgtggacaatcacattcccattactttttccctccaaaattaaattatctcattcttatctccaggacttctccttatagaggcggagttttgcctattaagcatgccaccgagagaaattatacttatcctcaggatagtgctgctccaaatgagagtgattcaagctcagttatttctcctaatcttagtaatcctattcctctttccatgcagaaaggtaaatgaagattgtagatgaaaagggaagttgccttcccagaagttagagtgaaattttcctctggaaacatgggaacagggaattaggctcctgtaacacctggtttctgttttcaccatgatggaagttctaatgggatagaaaaacttctgggcccagtactagaaaagtagattattctgctaggcgacaacaggtgcttctctaaaatatttttccttttttcctttcaaaacacatctcttcatggcttaaaaaaaatttctatattaaactcatgtttaatatagaaaaatctctgactagtcaaattgttgctctcctatcagaggagcctctcatgacacttccaaatctactctagagtaagtgtatat

SEQ ID NO: 69090 - DNA, 1057 bp, Homo sapiens
gtactggaacatggtgaactcataacattgttgctagcatgactccacacatgaaagttgttttcttctagtttacctccaagaaagtggggaaaaaatgtatgttagaaagagtctctatcaaacgatcatgatactttgctgagaactgtacattaaaatatcaagtgaagaaacatttgctgggttatgttaggaactatctttgttcaactaaggaaaacattttcttaggaaaaggcatccatgaggaaaataacaagatcaatggtgatgccaactgtgtaaatcattcttatctaatatcacattccataatagtaataagtagcatagaagtagtaagagactgaattctattagatgactacttgaagctgtcaacgacatatagggcacattattttaatctctctgaaatgaatatagtagctaatttataaattcccagagctctacctgtatatggtacatagtactgagatcagaatataattgcttattactccaagtacatgttctgaagaaaatgttaaaatgttaaaaataaatctatacatacttatcattttttcgttagtacataaatgaattagacaacactttttaaatccctagaaagtttggcctatgtaaatcctatgacaccctgaattattttgagataattagaaattgcatatcctttcaaatatgtagccagaacttgaaaaaaattatgtattttggtcagtttatcaagtacaaaggcaatgtgaaaccccagttctctgaaggttctagtactttaccatcttccctaatgaatattaccggcaacttcagtgtgctctacttttcattatctgggacacggacaaaatgctaaaatatcccttgcacccagggctgaccccagtgcaacttccctgtggaactccaactcaggttgacagtgatacattgatgacttttctctgagtgtgacccttcggcttgaatttttcggacaaaatcatctgcaatctctactaaaatatgaattttattaatatatattaaccctgtacatacacaa

SEQ ID NO: 69091 - DNA, 1043 bp, Homo sapiens
tttcagcaaacttcgtaaaatattcagatcaaatttgggtttgttattgattttcaggaggattaatctctttatattaaaagctcatttggtcacacacaaaaaagaacatctgtttagtttttttctaggattatggcataatattaataatataatccatatcctttattgtgtgcctattatagccagaaagtttgcaaatatttaactggagaaacagattagttgaatgtgaattcaaattccaatgctgttgtttattactggcatagaaattattaagttttgtgagcatagatttccttctctgtaaaaagaggatgatagtatcttctctttaaaattattttgtggttaactggtacaagccatgtaacatcacattatatataatgtgtgatatgtataatgtgaatatcttatgatatatgtatatatatattatgtgtgtaaaataaaatgtatatgtaatatctcatgttgtttcctttcagttctcattttttttctatctgccaggtacctgccctccaagagttttgaaatttggctaaggtcaccaactgggttgctgggactcaaacccagttcattcagattcaaaatccacaccctttctaatctaccttactgccatgtatcacagtcatttctctccctaccacagcatgacgaagcaatgtgctgatggtgattgttcttttcaatccctcaaaggggcttttatctgaaaatgttctcccagaagtcttactatattctttttctaaaagtttgtactcacttaggttcatgctggttagtgttatgctccaaattagcctatattcttagcctataaacctgatttctactctgagaaaaaaataccatataactattaatataaagggaatctatactagtttttgttaaatataagcaagaaaggttgttgtttccgtaggaaaaaaaatgtgtgaatttgattcaatccctgcattgtatttaggtctttccaggccgaatatttggagaaagaaggaaatgtcacaatagtt

SEQ ID NO: 69092 - DNA, 1060 bp, Homo sapiens
gacggccatttggagcacgattttctaccctttttttctcccaaatttcttatcaaaattaaaacctaatgaacaaatagaactttaaatacagaatgtgacaaactggaatgcaaaccctcacatctgtctctctcagattttatcaatttgcgatcttactctctccacgagtcacacagcaatcatcagataaaacagatggaccaggctttctggaataagaaaacatgcttttgtattgcctctaccgaatttgtctcagctgaactctatatcttcgttgtagttacttggaggaagggcaaaatcaagattagaagcacaaacagcttgttttcttcatatcttaagagaaagggagtatgagagaaggtaataggagagacagtaagtgggcagtaacttccttattgaataagaaattcaataaggaataaatgtttgcgaaaaagtcagcccaatttcaaagaagtggttgctgataattgaggcattgtatagtagtggcaaagaatttgggttctggcattaattgtacagttcaaatcctagatctgcctcttgctagcataacctgttttcatttctgtaaaataggaatatgaataacaatgattatttcatagagtggctgtgagggttaactgaatttcatgtagttaaccctcaataaatgctagctattatttttctgaaaaatctcaaagttctaatacgtctaagctcatcgtattgttgtcatcatattgttgtagtaattgccctagttataagagatatgaagaaaaaagtatgtattcaaatttacaaagcccatgaaaatcactttcttgtagttcatttctatttgaggataaccccaggatacttctttcagtccagacagtcctgttcgctccaacccaaactcaactctaaatctaaaacttgtttgaaaaaaatttttaaagagctatctacctatcataagctaatcttaaaggctaaagtgggcttcttgatactacttattttggaggctagatcaatatcagtaagttcctttatcaacaggccc

SEQ ID NO: 69093 - DNA, 1029 bp, Homo sapiens
aaggaaattattggttgtggtttattatcaaagtatttttcgtcacgtttctctgtatagtgagaattgtttcagtattacagtattgagcatcatgaacagataaaatattaatgcacattatattttttcttttaatcttagtagaatctaggaatagttggtaatagtgtaaaatataataaaaatcagtgaaaaatacctttaatattctctttagagtaagtatctgtgatttaatgtatagtatttgaagtcagacaggttacaaaggttagaaagtataaaaatatccatgtattaaaagagatctataacaaaattggcctgagaatctatctacttatctacccagattcttcagatatattcttgagacaatgcatcttatagcttgggttggctattttatttttatctccatatactgccttatgtttatgacttttagcaaatcctcactgctggatcatctacttctctagatgctgaatggatgcaataatatgttttcttagtcttacagaaatgttatgttggaggctgaaatgcaatatgtgatcaacatactttctcctctacaacacatggatagcattgcatttacatgacatgcaaattcagtgttttgttcaaaataatcatcttgaacaagatttagaaaggaggactaatattttattcattgtttcatttatgtatgttctatcttattctgaaaaggatccaaggcagcttatagagatgcttgtaatatgagagtaaactaaattggctggggacattgaaacaaaggagtaatatagggtgagaaatctgaaaagtctgcagaggacagtatgtcatgaagacatgtcttgctagagactttagctgtaagctctctaaccactaatgcagaggagaaagctttctccctttcatgataaaaagggtcctttcagaacagaaaatataagtgggcagcacaaaaacacagattcctagtcctgagaccaaagagattgtcgtagacctgttgttcactgc

SEQ ID NO: 69094 - DNA, 1039 bp, Homo sapiens
ctgtctctactaaaaatacaaaaaattagctgggcgtggtggcaggtgccagtaatgccagctacttgggaggctgaggcaggagaattgcttgaacctgggaggcggaggttgcagtgagccaagatcgtgccattgcactctagcctgggcaaaaagagtgaaactccatcttaaaaaaaaaaaataaaaaaagatgttcactcattaaataaaatctaaatattaagaaaaatacaactaatccaaaaatgtcaactaatttgaaaaaactatttttaaaagttggtgaatctcatttcagaaaacttttcatttatatttacacacagaaacctagtttgccagctcgatccagatattttatgtatgtgtacgcacacataggctttgttgtattttgagtgtatacagatgcttttacgcctcactttttgtctccatttttaactgcaaagattctagctttattttaaatatttttttaatatgggactatttcaaaaattgcctaatacctagtgtatttgtggcttatttcgtaagaaagacaaaaacttaatttctactggaagtattaattaaaagccttcatacttatgatcttatactcatgttcttgctttgacatttatttagtagcgtgatatttatatatgattgggtaataattttcctttggaatagctatttttggtaaatggcctcacttaaagtatcttaataccagttattcaataaaaatatatttttataatactatttgtaacacacacattatatttatatagaaatatttctgaatgttaggcaaagctacattggactcctggcagaatttttatgagttacaccagcactggaattcttaccagtgaggttttcctatatatatgatatctaatacattagaaatgagaatgattaataggcaataaatgactgcctgcctcataaatatctcagtaagaaggacatgccttccctcagaggaaatgtttcaagtgtcaaaagtatttaattactgcagctggtgaca

SEQ ID NO: 69095 - DNA, 1097 bp, Homo sapiens
gagtggtgcttggaaggcagcagtatgtgagctgatgttgggtagagtgatgttagcctccagctttctacttagtggagatctgtaggcacatcacagtcatcagctcttgcttcttggacaagtgatccattgcactgactctgggaaaagcaataaaccctaaaagactgctaatctagctaattgtgtaaaatatttggaggatcattgtccacttagctgttagcaagtgagctgaaatgtggttactgcttttagagtgggcaggaggagagactgagaaaaataatgatatataatctcaagtgttgtaacgtagttagggaatggtgtaatgtattacaggcttagcaaaagtttagagccagaaagatctggatttaaacggcaactccatactttactctgagagttcagataagttagtttccttgtgcttctgtttatagaaattccttctgatacagttgtataaggattgtttgagataatattaataaagtgttttgaaagtttcaatagcttagcaaggaattcttgtttttatacagatattcaactgaaatatttggaaaacagtagatcacttcatgaagataaagttgtaaaaatatgcaaaaaaaaatcaaattatgttgaaaagagcaaaggagaaagtacaaatcaccccaactttcttacccagcaataggtcaggccaagcagatatctctttgtgcatttatttagaggcatataaggcatatttccattcatatttattttacaatgacttacgtaagatggaagtcgagtttttttccttggattttggcttcagatattaatacctgaacctagctgctgcttttcaggcctagtaccccctgcctggagagcatctctccaagggaatgatctcagctgtggtctcaatatacccctcttcctatctgtctgcctccatggagccttcactgctgttgttaaaacattgctgttgacagtgccactgggaagttgcagtaatgtcctattgctacaaggcctggcatgagaccttgctgtctgctgtccctgtaaccctgtatgtaactctgctcattgcctcctgg

SEQ ID NO: 69096 - DNA, 1021 bp, Homo sapiens
gcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaattatttttactgtattgttctttttccaaattgcaagagaatggccagtgtttgtaaaactttgttttatttttgtgtgatggaagaaaagacatatttttggttatctggcaatccatatgccttcctttctttgcttactagacgtgaaatattcttgaggattttaaacagtaacctaatcttgatgaaccatggaaactcactacttaaagcaattaagttcaactgtgtaatttaggaatttgaacatggatgataaaacaa

SEQ ID NO: 69097 - DNA, 1035 bp, Homo sapiens
ataatttatcaatcattgacccttggggggaaaaatgtgtgtatatttactagtgttgagaatgttgtgaggaggtaggaatatgatcagagaagaatgttttgaagaggctgatctgagactgccattctaaattcagtggcaatttgaagcaagactcttgatatgaccatttcaaaaattttcataaatattttttcaataccacatgatacatacaccagacatcccagacttttatctgatcctttacacataccttgtctttgagcctgttgcagagggtcaaggatgaagttaggatccttgtggtatgttaattactattttcatttccttcccatagaagagaaattatttaaataatttttattgttaagagaacctaaagtagttcatattaatggtgttttcttttttttatgtgtttgttttagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtaagtaacttgaagacatatagcataaaggaggaatagctcttcttttttttttttttttacaaatataagaaaagagaggactataaatgcattttaatttttgtatacctgtccacttcccagaggatattaaagtgttcacaaagaaaagcacagataagaggggggaaaatttgacaaatgaaatataagagcctggtattaaacagaaagggataagccatatttgatcggtgactaagtatacatttcatattttctccctcccaaatataaggtattacattttcatactatttcttacttgatagagttcaatgttttatattacttgcttcaaataactaccattccttgggaaatggctgaaatcaccatggtaggcagtgaagaagtacttataacttttaatta

SEQ ID NO: 69098 - DNA, 1064 bp, Homo sapiens
ttaggtggcatatatattacactttctccagcatgttcctttacacaccagtttgacatagaattatgttttcctgttatttgtcatttctgctccttccttatttgtcagaattcagtacactcaaataattcccattgtggcttcgttaaaccttggagagatgaaattattaataagaaaatctagatgtattatagtctttgctctttgcagaatgcagctgttagcagatgcctgattagttgatatactccatcactattattatttcacactttgtccttttgcttaaaagagagcagtctggattttattactaattacttataaagacttcttaaagttaggggaaaaaaacaaaactagtctcatgatatagtctcatgatactgaagtgagtcttggtttgtttgttttttccccaccttaggggcataatcaacccatttcctgcttcaaaaggaatcagagcttttccacttcagtgtattcacatagctgaagggcatacaaaagctgtgctctgtgtggattctactgatgatctcctcttcactggatcaaaaggtgctagtagttatctaatgcagatatttaatagctttttttttaaaaaaaattacatttttaacatattctagaaaactgtcaaactatttaagaccagaaagaatcggataatctggttcaacccctgaatgtaaaatatataaaattattgcatagttgagcagcaagtaaaacctctgttgatgttttgtgaatacaatggtgacagaatacatctctctacagtatttgggcatgtactgcatgtagagtcctgaattttgaaatgcaggttatataaaaatctataaaaggctatttaaatatacaatatgggaaagagaataagatgcatagcaaccactatttctgcaacacttactacatatcaggggctatgctaggcagtatactaatatatctcacctaattctcacaacaatctcaatgagatacatgttgcatcctcattttgtaaacaaagaaactcaggattcaagtgaataaatact

SEQ ID NO: 69099 - DNA, 1029 bp, Homo sapiens
gttctacgtcgcaaaactgaagaggtacagtaagcaagctgaccatttggaagaaaccttctgactttgagataaatgatgtatttctatagactaagagaatgagtcaacctttgctgcaatttcaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggtctacataattctgttcctgctgatgtaatcttcttggccgttaatactgaatgttgtacttaaatgaaaaaatggctcattatttggcagtgcacaatcaaataagtgcataagtaattgagcttgtctgttttatatgattataggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaaggtgtggaaaatagagagtagatacgctcccccttagctaactgttaattttactcttccaattttgttccctgggtaaatttaacacttaccaagttttttttggggggtgggggggtttgatggtactgtatataaataagtgaacataatttcttaaaatccaacctgctttctcaatagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggtttgta

SEQ ID NO: 69100 - DNA, 2501 bp, Homo sapiens
tgaatattctttatctttaaaaccctttacacatgatatttcttatatgtttcttaaaaaacaatcttactaatggaaagtactacttttctccccaccccccttttttttttgccactgttgctttatagatatgccctttcagtagttagtttataataattagtaaactctttaatcccagtgtgaaattttattttcaattaataaaattacagtttttcacagatatcataacaaccatattcatttgcctgcaataccatttcatgtataactttgaaatcagattttttttagatttattgatattcatatgtagtatattaaaacagaaagtatgtttttaaaagtagtatcctagaatgtagtattagtggtattttcatattatggtataaaggcattactttgtgaaattcttttaatgatgccattaaaaggtcttctgtaaaggcttgaaagagaatattattgaaagtggtcttttttgggggaagctgagtaaattgacccacttcagactaaaaaaaaggcatccaagcatgcctaatccttatcaacttttataaattgagactatacattttgctgctgcataatttcaactgatagtctatatactcttcttagatatattgctgcttgattttctacttactttttattcatacaaatgtattgcctttttactgtgtattgtcctttgatgatatcttttaaaatttattttaaagtcttcaagctcatgtatcatttttaccttcttatcactttcgctttttactgtctggtttgtccttcattggcttggccttccaatactgtgcctcgtgattttgaaggctacagaaacttgaggaaagcaatcgagaagaaagaaggttggaatatttcccaggttttttattaaaatgtcgtttaaatacttagttgccattcacaaggaaatgtgttatagtattatagattgtttcagactagataagctgggctgctcctaaaagtaatgctgattttataaaactaacaagaacactgtaataaatttttaagaaaatactttttaagaataaaatcttcactagatacttgaattaaaattcaggcagtttcatgtgattacagaataaactatgataattatgatgatgacttaccttttgtaggataaaaataaccctaaaacccctgccatttgatttattaaaaaaagaaaaaacaacagtaattctttgtcttacagaaacttgtgagcagagtggaaattgacattttgttgtagcacatgctgaatcatgggtgggcctctgtctctctcttctttatttggtataatctttactggaaaaaaaaatcattaaaatgacaacaaacaaaaggaaactgtggccttattacaaataagatttataagacattcttaaggttgaaatagaaaaacaatttttgcttttaaaatgtatttgaagtggacatcaaaaacaggatagttgcttttttttcatttgaaacgagcaaaatttagaataatattcttgattgcattttactgattcagaattatgattatttaaccaaagataagtggtattttccttcttatcagaagttttcttcatagattttcctaaacaaatctctagattacatagtcaaaatgattaagaaaatatactagtttcaaggtaatatttaactattttggaagccctactttagacattcatcttttacttaagaacttgagaacttatactatgcaattagttaaatgaatatcttactttaaatatcttaaagcttaaaatgtttttctttaaattaccttataatttttattttataattatatttagtatgttatatagtattctaaagtttttatacttacatgccataagcccataggttctttaaagtacttaggctataattttaattttttattggtcatactataactcacctaagcaatacatatttaggacaacatgtttattattggaattaagttaaggcattaaaattgtgaaatttcttctattctgaaaggtaaaaataagatgcgtcattaaagttgtgtgtggaagcatttaatcaccataaaatattcaagtcctttaaatgttctcagtgaaaggagtttactcccatctttacatgatccctgaaggacagcaaaagcagagtggttgggtggttacagaacaacttctcaaacatagtcgtgtgtacagatctcctagggattttgataaaatgcagattctgattcagtaggactgaggtggagcctgagattctgcataagtaataagctcccaggtggtgcagatgcttccagtctgtgagctgaactttgagatgttctgggagtcaggataactggttttagttctcttgaggggattcacttctccaggccacagttccctttttgtttgtcaaatgaaggggttaattgctaatgttccttccagctcccaagcttctgattc

SEQ ID NO: 69101 - DNA, 1119 bp, Homo sapiens
ataattattcaatcaggaaatatgaaaaaattgttaaatgttaatgtgtgtgagcattcttttatgattatttttattattttgtgagaattttatttagtttaaaaatccttatcttgtagccatgttgaaatgcattttggaaaactttttagcatgaagactaactcatttaaaatgttcctgccttattgctagagcagtcagattcatagagacagaaagtagaatgatggatgccagagctgaggtagaggggctgaggggaagttaatatttcatgggtatagagtctcagtatgggaagataaaaaatttctggagatggatggtggtgacggttgcagaacaatatagatttgcttagtgctacagagctgtacacttaagaaatggtagtgtggtacactttatgttatgtatttttatccacagagaaaaatgctccctatttaaatatatttttatttgctagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaaggtgggattataaaatcaccactaaatgaatctctatttccttttcagggtattttaatttgcaattataaagagcatacatagtctcatgagtaccttagtatatgaaataaatcactatgttagctgaaactacaactatctagtttttaatggtttatctctacttatatgtaagaaaaatagatttaattgtaataacatggtaatgaattttatttagaacatgacaatataaaattactattataaattattttattatttcttcaaatagctgcttttgcattccattcattttgcttttcagcaaagcttgctgtaccattacaactcagtgttttcattttttccccatttcctaatgcaattaaatagtctcatggatattttcatccctgtctagattagtttaactaaaggctaaactaatccatcaga

SEQ ID NO: 69102 - DNA, 1059 bp, Homo sapiens
tggaatctcagtgttttcttctatttaaaaaataatacactattatactgagaagtccatctcaaaaagtgcctgtaactgaactaataatgtgaaattccacatcttttatatcccttaacatggtgggttttagccattacctcagactttggattgtatagtatcttgtttattgttcaagtaaagtccttgtttcttcccctttttcagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgtgagttattaattctaatttcttaaactttcaatttttatctccctaaaaccacatgaattctctgagaatatatttgagccaaattcagttcatttagtcattcctttttctaatttccttttctgatcctagttaagttgaagctggtcagccatgtaagattttgaaataaaaaattgtataaatgtctgaaaaaccaaaaagcatgctgtggccatatgttgttggatgtcatcacctgagaccttttgcttttgaggattatatgctgtaggtttcccttcattagcataagcaaagcctcagttgataatagttgagttctgaccatccaggctttttctgactttaaatttctaattgccagcagacatttttgaatttatttggctttatgcctgtttctttggttgtgcctatatgtgtacatgggataagcgcaaggtaggttaggaggatatttaatgttacattaataaagtattttcaattatttttcttaatttcaggacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttgtaagattaaggctttgtgctgagaatatat

SEQ ID NO: 69103 - DNA, 1035 bp, Homo sapiens
tctgggttttttcagccactattgatacaggaacactaatattgttactgaccttgcaaacatgctaagtgttaatttttcaacacgttaagaaaggtttcagggcaacaggaaatatgtttttagctcaagtagtaaaaattctttaaatattctgaagcttaagatttgtccacatttggcacatgtttctagggtttgcttgtatttgtaaatatttgactatctcttgcaaaggattagtagatcattttagctagtcctcaacccattagtcatgattaagtcacttactgtttttacttttgtaaataaatctggcatttacttataattgttataataatagcctcattcattttaatgtgttattttgaaaaaatatgtcattttgaaatactttaaaaatctgtatgaaggaatcattatgtaatgtgttgttatgacaactacccagacaatttctgctaaaattagatttctaatatttttttgatagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagaggtaatatttatattatagttaaaacagagcatagttggctttatttaaatagtgagctttgctgataatctgcttaagatcaagatatgaaatttatatcctgaagcatgacatggaattaagatcttgtgttctttcctcacatttaaaaaatcagaatattagtataaaaatatcaggattattataaagtcagcatatttgtcatagcatcaaaagaatctaaggcaatttatgaacagttttcattcacagctagagaaagagggttagacaattgatggtgaagaatgagaccacaatccttttgtactttttgctttaacctatgtagaactgtatcatggctcctagagggagattgttgagaaaaattacaaaaaata

SEQ ID NO: 69104 - DNA, 1046 bp, Homo sapiens
cctttataatctacttacagacattaggcctttgccggaaggggaaagctagtggcttagacaactcattatggttcaaaaatctctaatgacatttttattcaattcctaatactcaaattgttctttcagaatgtacaaatgtagttcctaactctattagtattcacgctaatggatcacatttatctatttcctttgaccttcaattcaagaagaggattaagtgcattttgcacatttgtcaaagatactttgtcctctaatgtttctctagtacattcatgcattaaaatgtctagaagagcaagccagctttcctagatgcctgctcttgcccacttgctaaggatcttttcacttccctctgattttgtcctaaaagtaatagaccaaattaaactggtcagaattgtatgagaaatgctgtttgtattctccatttctgatacttcatgcagtaatgtaacgctccatggatgacattcggctagctttctaaaaggcaaacaatctgtaaaaaaaaggttgaagcaaatgtatgcaagtttattagaaaggtaatttcattgacaggtaagttcactccacatgctgttttgtgtgcatttaggaaaatatggcttgttaattgtttttttgggaggggggtttgttaattgttcatttggattttaaatacaaaaaatctatttgtatcctgagtcttatggagactcttcagtttgccttagtaagcatgacagtaagatatcagagttgtttcgtatagcaaattcaaatacactataaaaataattttaaaaatctaagtctgctgaaactattgaaaatgccccattggagtagattatttttttctaaattaaattcatgttgaccggagaaattaagacacatatgcaacattgccctttcaaacatgactcatgtttttattttattggcaaccagattacctgtaattgttcttagaatcatcacaatataaaattttcataattttagagctgatgcttaagagaaccttaggatcatcttatttc

SEQ ID NO: 69105 - DNA, 1037 bp, Homo sapiens
tcagcgttccaagttaaaagcccgcctacttctatttatatttccttgttcttcatcaataaaattggatggtttattgtgagggttaaatgacattacatgaaattacatgaaaacccagttgtgattttcatgttatttcatgtcatgttattaacctcagtgccaggcacattgtaaatgtccaacctgtattagttccctttctcctcactccactgcaagcacagaaatagttaaaaatttattctttttctcttaatacttttgggaaagcattaaaaaattgcctcagttagtttaatactgactatcttaggctgggtttcctagacaactgtgcctagaagcttgtgctctaccaagtggggaaataacagtgtaacagaagtgagggaaaaatgaagcaaggcagagaagacggaatggcaaatacaaggtgacacataatggagttgcgaacacagccaagtcaccaggggtgtctctggacaacccatatggaaacactcatttgggattagtccattggagggaggaaagggaaataatttatctgtgcctttttcttatctcttgccttctattggttagcatttgcctcctgccctgctgggttctgctactcattccagaagctactgggaagccagatcctgcaaccccatggagcagccttcatttgtgtctagaaatggtgggaagtgcaagggcttttgtgagtctagtcagaccaagtctggtgccatactgctgcaggtcttgcacagtgccaggagctcagccctccctccaggcgaggctgagacagctgacaaggttaggaggtgatgcaggtagggctgaaggatcttcagaagaccaaaaactgggttccctacacagcaatttccttagaatgctatttatttcagaaacattttcttttaaaatgtggatccttgttttatgtaaacatctagtatggctcatttatagtatatattttcccacaatctgaattttattttattgtctttattttattttattacctt

SEQ ID NO: 69106 - DNA, 1072 bp, Homo sapiens
acataagtcttgactcctagactcatgctctttccatatcaaaccatattaagttatctaaaattgaagcactgaaaaagtgtgtgtacatttttaaatatgtaggtgtatatgtatcacactcacatgtatatacaaatgtatcatcagaaatgattaaactttttctaattaaaaacttagtatgctgattagattttggcatttttagacagtaaacatgctttgtcttacaaactgtagactgtgagttccataagggcatgtactgtgtattgcatatcttggtattctcattgcctagcctagtgttttgcatagagcccccaggtgttcaagggtttgatgaatgaacaaatgggtaaatgaatgactgttaggtttttttttgtcaaggggtgtttgaaggtttttgatgtgtatttttgtctcaaagtgggaaaggttcattactgagctcttgacttttaagtggggatgacacacattcttgaattatgagtacatgtagtgccagttctcacaagcagatgccaaacactgcttcatgaaccagcacaacaatcatatgatggtagtagtttcttctcttgcaatgtgttatgacatattttacagtttttagttatatacaggtaatttttttttaactaaatataatgcaagggtgtccagtcttttggcttccctgggtcacattggaagaagaagaattgtcttgggccacacataaaatacgctaacactaatgatagttgatgagctaaaaccaaaattgccaaaaaaactaataatgttttaagaaagtttatgaatttgtgttgggccacatgcaaagtcatcctgggccgcatgcagcctacaggctgcaggttggacaagtttgatataatgtatgttactgggtaaaattaaattctaagtagaggagaaaggggctcctcttattttattatttaaaaattatttatttatttgtataggtatgtataatacaggtgtcttgctatgttacctgcctaggctggtctcatactcctgtcctcaagcaatcctccctcctcggcctcct

SEQ ID NO: 69107 - DNA, 1536 bp, Homo sapiens
tattttggagagtgggttgatttgagattacgaatgagtcttttgatagtgctgagggcccatttaagtttgtggtcatacacgtaaagtggagattgtggcagtaggagagaaaagggaggcaggaagcttgacatctttgagaaagaacaaaagatgaattaacatggtgaagccaagaaaggaagaaaacagtccttcccttgaaaagcttaaagtatacctgccaagttagatgatacacagggaaaaggatacataagtaagcaaatgataaatgccaaatgacctagaacacaggctttgttccttcacaggagggagtgaacattttgggtgacatggatggctttagtgggaggtaagcattgattggacattaaagtatgtgcagatgccaaaagaatagagaatcatttgccaactccctggttccagtactgtgctttcttttatttggagcctttgaatttcctgtctgttgattctacttcttttggcattgggcagatagagacattgatgcatccctttctgtctgaagataatacaatgttatagttacccacaaaggaggtataatcacactgtaatgaccttgagatgttttcacttttacataatgtatcaaatatgttgcttgaaaatttgttaaaacttgaaagtattattttgtgtttgtttggcttttttttttggaggaagtggggtgctgttagagaatagaataattttttttgtttgtttgttttcaggctctgttctgttacttcaaattttagttgaaatttacagatgtgttttgaatgttctaagctttctttgacttgaacatgaagggtgggaagaaaggaaatctgcaaagacacgctttacatataagctaaaggggaaattttcttctacacaaaataaaatgttagtcacacatataatgatgggtttgtaactgtcttgttactattttgtccactactgagtgactttattatttttcttattgcatatttttttttcttacggcctagttaagaatgatcaacttcgtgtttttagtcatttcagtgaacaggcagtcttctgtttcaaacagagaaatgtctgttggtaagaaacttgcaacaataatgtagggctttttttagtggtttgttttggaactttatatacgctttttaaaagcagctgcaaggaaaagtgtgtgtaggtttttgtttcttaaatgttaatgtaagggatatttaaagaactatatgaagctttttaacagtgctttatttgacttttactagttaaatatttcctgcactgtagttttactgtaagatggcaacaattttacataaacaaaatttttcttacaaatactttttttaatgttgcaattattttggcaaagatacatttttgaaaaataaattgcatttatttttctagttaatctcttactttaaaaatagcatttaatattaaatttaaaaaataaattctctcttttgtttttttgatggagttttgctcttgtcgtccaggctg

SEQ ID NO: 69108 - DNA, 1075 bp, Homo sapiens
gccagagacataaaggaaataaatatgacagtatttatgatagattagatgaaaggaataaagaaaagaggagagaaattggttttggggtttcttctatagcataagggaaattttcaaatgaatgtaagtaagagtataaactgttttgttagagaacaatatgagtttggtctctattttgcttttaaagtaccagtgggagctcagcttcatttattctataggacatagaaagtcgagtgaagaatagagtcaaagattgagtcctagctccattaaatatatttattaaagattttagagtgggtgatttctctgaaagaattagtataacaatagaagaacataaagctggcattttaaacataattatcagatgaacagttttgaataaaatatagctgtgtgagatcaaaaaatatatgtgagaagatgcaagctgaaagccagtcttgcctcctataactgactcaaaaatctcaaaagattttgtgagttttgaatttgttttttgttagtttgcttgaccttaaaatgttgacttctacaaagtgaataaagtagattaaaggctgatcatcagactcccttgataatgcaaattacatagaacacaactctagtaaacatcaatttcaatatgttattgacaatgtgacttctcttaccttaagcattttctttcatatggtattatcaccattccagtaacaatgtttcaggtaaaacatgatttaaaacaacttgtattttagaatcacaacactcctttactcgttgtgtgaaacacgtaaatcaggtaataaaaaaccaaatagatgaataaagaagggaaactcttcttatgctagaaattcattttgagagatgtcattcattaatgctgaggtaaatattataaaaatgaaagacactttttcttaacattagtaaataaaatatagatggaaattatatgtgtaacatagttacaaatttcttaccaattaatttctttatactgaccatcttcacttgtagattaaatttgtcaattttatgctaaattttcagctaacagtaaagaaaaata

SEQ ID NO: 69109 - DNA, 1031 bp, Homo sapiens
gtgcatttctaatcaatctaaattgtttctttatcattgtttatatcatgtgcttttaaatgccaaaatataattctttatctttgtgctatattttcagattgatagtatccctgcattaaaatgttgtatctcataaccttgtctctgggaactattacttgcaaaaaccctgactggtaaggtttgtgaaaattgactgtctaagaaagtgaactgatcctgttctctcttagttcctagctgaatcaggacaatgggaagcattttcaagtaaaaacaaaatatctgatatgtcatgtcctactggcatagcctcaatcttgaacctcatgccccacaacaccccaccgtgactgccaacacctgctttattgaggaggaaatgcagggggtgaaattaacatgctgcctagttctgtgcaaacacatttatacctcaccaaccacaatcccatccaaccacacacatacacgtataattagaattccttctgctcattagctaccactattgtttccaaattgctgaagactcattactgattatgtaaaaacctagaacatatctacatctaacaaaggagataattgcatgcctaacaccttattttattaaaagcattgttttatggatattgcattcagaaagcatctacaggcaatggaagtgatgcacttcaaatctagggaaaatatagacctcactggagatggggaaaaaaaacgaagacaaaacttacctcaaggggtggttgtgaaggtttatgaaacatgttaagaatctgtcttgaaagatatattgcaagcaaaaatttttaaatattgccacatagttccatattaccatgatgtgaaattacaggttttatgtgtgtgcaatcaaaagcttactgctcagtttgaaaagttttgcaatcactactccaccagtgagggtcaaccttcaaggcacctacctcaattcagacatcatgctgtgaggccagtaataaggagagtaaaagtctctgcctcctatctatttattt

SEQ ID NO: 69110 - DNA, 1048 bp, Homo sapiens
tcatggtctttatgttacctaggcttggaagtgatgccacttgtttttatttttttaatcagtatcgttttcttccttagacataaaaacacatcaaggtagcttttgtagccttctcattctaactaatgtccgcagaggaccccagccagcaacatcttttgatgtagtgatgtgcagaaatagatcattgtctccaagcattatttaaatcattcaaaaatcttctatataaaactgcaatttaaactccagaaagttcacttggagtaacagaaagactaagttagaaacagacaaacctgagttctaatcatggttctgctacagccatagtcatggttctgctagaggcatagcctagagaagacttcatgagctcagatttctaacttgtaaaatgaactagctaaatagatgaactctaagatcctttctagctcaaaattgtatcaagtgaattcttggtgtctaaaagaaacttgcccttattaaaagtatcaattctacccaaattagctttcattcgttacatttaaactattcctttgtatatggtgttaaaataggaaattactaaatttgtttgcaaagatccaaatatcatttctctatgcagtttgactactttaatgtgaaaataacttgcagaactgcaaactgcagaggaagtcagagttcatagaaaatctcttgccttcttttaggaccttctgctcagagtgtgtttttagagttaggcacttcaccatctgaggcaagaaaagaaagagaaagcaacctaatcaaatagaaaactctgaaaagaactcttctttcataaattagacttcctgttctttacttgaggatctgcagtttggacagaagccttactgtttagtgtaaactccccaacccccttcagtgaatttgggtagaaaattaaacatattttccaggactgtcaccaaagtttctcccttatgtagcactgacatttcttcaaatctcctctaaatattatgagagaaagaagtggccttttgtttggaatgctagttgtgac

SEQ ID NO: 69111 - DNA, 1036 bp, Homo sapiens
ttgaacattgtggaactaaaacaaggaaatttctgcatattgccacaatttgaggccatatggatcataaacttttctatttatatttcactggtagacataaatgacatcccatcacaaaaaaagaagcaaggaatacacaactgaagtttagaaatggacgtcttgctactgaatgtcagataaaggtgaagcttttaaatagaaggccccttgatttagtacctttaatgtgcacaggaagggatctgcacagcacatcattagtgtgacggggtgaaaggggcaacacgtttcttctgttactgtggaaagaggatgaatctggcacagctctgatgtcagaacctccatcacctttctcacagatgatgtagattttaattgtactcggggctgactcgcgtcgcaccagctcctacgtgacattgagatggatgaagccatttgttggcattatcagaaccagctgtgtgcttggctgcagctacagtaggcattttatctcatgcataatcctctcattgagaggggatcacaaacatctgaaccatatggcaaataattttattatgatctaaaaaggactcttgaagctagttaaacagaagagtccttgaaattcaatcagaagaagttttattttcatgtcgcaccatcgtcctaaattaattgttagtactgccacaatcatcaagtagagcccagactcctccacccacccttgcttgcaaagtgaaaataaacttataattactttattttgcctggattttttttatacttctcaatgtgggagaatttattttgatccacattagagaagagaatctggatttcaaagactgaagctggcttctgattaaaaataataatttttaaaaaactcttcaaatataagaaccttatatcaaatggaataagcttgaatttttgtctaattgcagctctcttaaaagctacataagatggaggctatatatatattttttctttagggaagtaaagtcttaaagaaagaaaatctattctttca

SEQ ID NO: 69112 - DNA, 1046 bp, Homo sapiens
gatagtcccactctgttgagcatttccagtattttctactcttgactttatgcttcactttcaaccatttccccccaagcacacctaatagtgccagagaataaataggaaggtgcttcaaactcatgtacatgagagagtcatatagctgttcctcattgagctgtgaaaggatgagtatttggtgagatttaaaggaattatatacacgcacatacacacacacttcaaacagaagctgtcagccattattttccaaataactctcaatcaagacaaccctgagattgagcacagaagccccagtctagtcttccccgttttctcacctctaagttttttggggtgggggcttttggcatctttcttgcctgcagatttcagttggcattatctcactccatgcaaaacattatgatattatttgttctttaaaggaatgtttagatctgtatcgcttccattaaggtgctcctgtatacattagctcatctcctcccaagtgaagagcagtctggggagccaaggggatggtggtcagtggctgctctcaatgaaaatgtaaagctctggctgcacgtttcttatgggtgcctcctaggacaatggaagtatactgtttcatatttacataagtaagagagttacccaagatcgaaccaatcttgaaggtaactttccattttcactttaaataaatcacttttaaacttttcttgctaaaaagtactgcccagattgtactcatttcctgttatgaaaaactttttcataaagataattatttttatgtgtcaaactcaactattaagtgctcatataaaaacagtattgagtaatctaatgaccctatctttattatagcttattaaatgaattttattgggaagggaagataatgtttctaggtactataaacagcatctcattttacctgcactacttttttgtctgttttcagtttctcagaatggtatgataaaatcttacagtacaattgtgcatttgccaattcttccttgtagttctcttaatttctttcttta

SEQ ID NO: 69113 - DNA, 1452 bp, Homo sapiens
tcatattctcatatgctgggaaatacacatactcacagatacatacatacatacgtacacgtaaaataattacaacggtaaagatgaatattctgaaacttgtgcataagtctgcctttaaatataagctgcaactaagacttccttatcataggcaatgctataattaacatatctactgtgcaaccattttactattgagccttctgatattgttttgggccaggctgaagtgaaatgctaaaatattatattatattcacagtttagatggtgcagtcttttctttagcatttagaatccaaagtatattttgttgggtaccccatccaggaggaagaatgctgcattgaaaagaatgatttaattgggaatcccactctggcttaatggctctaactgttaaacctgtctcagccttaatttcctcatctttaaaagtgaaagggctgttgtcaggatgaaattacataacatgacgaaatgccttttctcaccgttgggtgcagagatacctgagaaagagttactcaaatctgcttaggaatttgtagcaagtgaagcgtaggttttgggggatattttctattttgagacagagttttactgtgtcactcaggctggatggagtacagtggtgtgatcaaggctgactgcagcccatacctccaaggttcaaccaatcctcccatctcaggctcccgaatagctaggaccacaggcacgtgccaccacactgagctttaaaatatatatatatatatatattttttttttatttgtaaagatagtgtcccactatgttgtccagactggtctcaaactcctgggcttaagcagtcctcctgcctcagcctcccaaagtgctaggattataggcatgagccaccgtgcccagcctagcataagttttacaacctaatgcctagaaggttagaacaaataaaaccactgttacccccagatataagtacagctctcctatttgtagtactagtcttcatttctagccccacttccttcatctttccatttaagaaaggaaaagtgaaaaggaaggagaaagatggcagtcccatgtgccaccttagagacacaccacctccccttaggtttctctgctttagtcatgggttagattagtacaacttgcacctgtgagtgagaactgtcattgatcagactgacttctctcaccagctgaaagacaaaaaattcaattgattcagagttccttgtttattgggcactcatcaacaaaagcacagatattgcatcctgagtttgactttttagcacgccagagaacttggaggataagcaaattctggcttatttgatcctaccgtgttattgcttttctggggactgcttaattgaagcaagaatgctatttcaagtaaaatacatcaaaaggcatttcatttaaacctagttaattctttacaaggc

SEQ ID NO: 69114 - DNA, 1079 bp, Homo sapiens
aaattaacttacattttaaagggtccttgaggaaaatatccacttcatatatgatttttgtattttgcagaattgcttaatatagtgcttttacaaaatagatatgcagtgtttgtggaacgaaattgttaagacaggaatacctataaaactcagatggagtcattcaagtgctgagcatgcatttcttatgtatatttctcatagaaagttaatgtgccaggaagccttcattaagttttcattatgctttaactctaaaaaggtattgacatggtttaaaagtcattgatcattagtcacaagatgctgctaatctctctacctgagtaaaacaaatgaagctatccaggtaaaaaattgctcaccagttagtcattccttcagaagagttcctagactatgtttaaggatatacagacatatctttaggaagacctaggaagtgtctcctgcctggattctgaaatcttttctagccaacctctgagaaaaaggcagagaacattgattaatgtcagattttggcaaatcaagtttaaaaaatgtgaattttagatgagggggagactcctttgctatagagagaatatattataaaaaattgatgaacacaattatgtatcagtaattctgtgatttttttttcagaaaatggtcttataaaaaacataagaattatgataattcaacagtgatattagcaagaacaattggccagatgtaaaaggatttgagatgtgtaaaaggaattgtggtctgtccactgtcaaactcttggtgcatcttggcttcctcaaggatcagaaggagggatggaatatctgacccctgagattgcttctgtccatgataggcacagccttgtcaccctgatgccagatatgtattcttaaagaatatcaaactatagcattctctttctcagaaatcttcagtagcttccaactatctacaaaatcaccaaatcagttgtgattagcaagtattttaagactgcaaagctgtgatcaaacccacctttctctcaagccatatttccctgtgctctgaaatgtacaaatgccaaactggacaaa

SEQ ID NO: 69115 - DNA, 1073 bp, Homo sapiens
ggcctaaagaacaatttcatgccagttttgtgcttcattttcttttgaaatttgcgttttacctcttagtagatatattgtggtttccccacacccactttcacaaattgatactccaggaagatgcaaagtgcttaaattgtagttttctggctcccctgacattccagtttggaaaactcaggcctatataatgaaatgtaaactccatagcacatgaggcacttccccccatctgcctctctgtgctcacctcccactaatccaagtgtgatgtgggaacgctgtgcttctgcacacacaaactgcctgcagttccccagggatgacgttttcttggttttttgtttttgttcttgctttcctctgcctagaatatcccctcttctcttcctccacactgttctataccattgatttcatgacggaggtagaaataagaacacaaaagcaaaaaagtttttttaactcttaaatatttgacaaacaaaagatatggttacagtttttcacttaaagaagtactgaattcttctttaaaaatgcttagattctggcctctgccctctcttccatttgccttatgtgccattattgttttttcttactttgggttccgccaaaagtctctaaccttcttcaatatggctgaccttgttttatgcatccctctcttccaagtactctgcacatggtagaatgattgaagcaatgactaaatcttaaagacacttgcaggctagcaaagctaaagcataaatctcgaaaaggatttagaactgagactctttggatatacctctcactttttcagaaagttgttttgttcttcaaattaaatatgagagaaaatatgatcatatttttgtagtttaaatttgaaattattatttacttttccagtaaacatgcctaaatacagacacacacacacacacacacacacacacacacacacacacacacagcctctaactcagccgcattattggctggtagcatgtttaaagtgtgttgatggagcaaataaatcttttggctcatttcaaacccagagaaagatgtcagcagta

SEQ ID NO: 69116 - DNA, 1098 bp, Homo sapiens
taaggcaagatcaaatgagaaccaagaggtttattctccagcacttgtgaaccagagagtctctgagcttggagattccagacaaatgggatgaaggggtgccatgcacactgaggattcctgcagccccatcctccctgccagctcagaatgccaagagccacaggtcagctctcttaagcctccccatagctctaagacatatggttttagtagccccacatttagatacaggaaactagctttagtccagatagagctgtcctagaattggaaggaagggcagtgtggtattatggaggcaaaggagaaagagcctctcaggaacatgcaatggccaagtacaccaggtgttgttgagattataaggtagtggaaggtaggactggatttggtctttcaactatttctcatcatcctcaaatcagatttcaatgggttgagaaataaatgagattttttaaaaatggcagagaatcaaagtactattttacgatgtttgggaaaagggacaatagagaatatgaaagtcaaatatacaaatgggcttaatttgaatttttttttttgatgaaggacacttgaatatattcagacctactatgtttctcagagcattcttccttgtgcatggctctgaatcatgtttcaagtgcttgtactcggaccctatcatccacaaggtatggagtttcttttccattttttcctttcttcataaatattctctactataggtgatgaaattgagacttacaatggttaaatgatggaatagagatatataacaaatctacgtagatctgtctatacctatatctatcttacatatctatattccatcatttatatggtttcatatgtgtatatgtggcatatacttacactatgagtttatatatacatacatatatatttacatatatttcacatatgtgtcagccatgatattacatgttcttatatattatctcatataatcctatgaagtatgtattattaatattatcttttcacaggtaaagaacctgagtgtcagagacgtctcacaagtactaagcagtgaagcttgatttgagttcacttcaggctgattcc

SEQ ID NO: 69117 - DNA, 1143 bp, Homo sapiens
tcctaccaggtccctccttcaacatgtgagaattacaattaaacatgagatttgggtggggacacagagccaaaccatatcagaagttcaagataaaaataagcataattatagaaaacaaactgacattatttgcacatttgagttcatagttgagaaatctgtattcattttataattttacctccaggaccttaatactttcaataacatatgtttttttgacaggactaagaaagaaagagttgaaagcactgattagctttctgatgtaactgaattgacttaaaatttaaagtttccaattcctataagttaaagaggatatataagccaatataatttattatgtttctgaagtctaatggttgaagattttttttaaatttcaaatcagttttagtgaatcatattttagaaatgtgaaattttcattgatttttgagagtctaaaaaacctgatcttaaatataaaacatgccttagtttaaaaaaatctcaaaacacgtaacagttttataataaatttaaaatggctataaggaccattttatgctcatttattattcatttgcacaattatgaaacagaaagagaagtatattttctattagttgcattgttttatcaatgtaagcgtaacaaattgccatacttatctctctttctgaaatttctttctgaaattatgtttctgattttacatagctgataacgtatccatttgggagcttggcttattatgatcataatttgaaaaattcactggggactgtcaaaacttgaaattcaaaacaatatttatagaaaccaccaggagaaacactagtttgttgttttatccagttgtttctgtggttcagtttctgagacagatattgttagttgcttatacagttttcattatctctttctttcttcttaaggaactctcccttaaatcaaccaaatatatcactaagaagttccattatagagttacacaacagaaaatgaaaacttaagagttttgagagaaattggtgctcctagagcctatcaaccccggctcttctactattaagattttcaaaaaactttgatcttctgaggtttcaatctaatatacctgggtgtagttttttttttttttggcattctgtt

SEQ ID NO: 69118 - DNA, 1062 bp, Homo sapiens
agattgattattctggtaaaaatgtaaacactccatagggggttaatacatattatgtaattaatatcctagtataaacttctatcattgtttaatcaccttctcaccctgtataaatgccaaagcacagaataagaacgggatatacctctctacaggatccccattacagatgttttgtgcgatgcaggacatgagtttgacctctttaatcacttgccattacacgcagttgaaagcaaatatggaacatacagctccatcctttcttctcttttcagaagctgactttaataccaaagtagtaaggctctttgcagagcttgctgcatatgtacaagaactcaatttggagcagtctcagatattcaagtttactgataattcagcatgttaaagggaagaggaaataagtgagtgccaatggcttgtccctgctcatgtcctcttgtatctgctctgccctgaaagagaagaaggctcaaatatactgaaaaggctgccatgggcatatatggagactgccatggacattttcaaaatcacttcccctaagtggggaatctcttcaaccccaaacaatacagatccagagctaaggactcagagggacccaaggctctggaagcacagggtcaggtctcaggacttatcatgcaggcttctgaaagtaacaaggtcacatcacattaattagctgtttcattcattttcaggtaagacagttgcttttcttctacatactctccaatacatacaagatgtgaatctaaacactacaacgctatttttaaaaaaattaaacctatcagaattctacatccaaataaggttgacccatgtaaatacttaccttgggaaacaaagcattcatttcaatgatgtgtcatatctcagaacattgtcagaagtcgcccttggaaattgccttcagaaactatagtacatttttttagagttcacaataatagaaagtagttcttcagaaatataatcgacttagaacagctattctcaaaatttggggtcccatggtcattttacacaggtaaaaattatgga

SEQ ID NO: 69119 - DNA, 1067 bp, Homo sapiens
taaaatagaagacagcaatccaagataaagactaccaatttaaagccacaatataacaaaagtgaaaagtacattcaacaccagagaaaatggacaaatgaattagtagatacatttgaaaagtttcttaggtaaaagaataaaaataagactgcatgaaaacaggaaacttttatatataaccaaatttcacaagtggaattgtttaaaaacaggaaaaatattcaccaaaaaaattcacaaaaggctaatagccttaatttttaggaacccacagaaaacagttaaaaatactgactcctttaggtaagtgaaaaacaaacaattcagtaaacaacagacatgtgcagcaatatttaccctatttagtaagcaaagacataaattaaaacatattattttcactatcaaattataaaaatataaaagcctataatatctggagtgaggaactgttgtgccctgctggaggccatgaaagaaaccatcccacttcacctttgctctaaaagcaagttggcaatttgggaaaatatcaatacattttgagatctgagaatctaaaatctccccataggtaatactgtgcaactggccctgtttcctgtgagagctggagtctatgttccctcctctggaatctaggtaggagcttgagactactctgaccaagaaagtatggaagatgcatgcaatgtgccttccaaagttaaatcacaggaagaatacaacttccacctggtgctgtcacctcgtgcgatgctgcccctgggaacccagccaccacgatgtgaggaagcaagcagccacatgaaaaagccatgttccactacagcctcagctgttctagtctccctagtcaactaccagcatcaactgccagacatctgttgattccaagtgagaggaggtgagctttctccaccgaggcctccccagattggagattcatcagcaaaatgtgtttattcccatccccacaactttaaacagtgtgggtttagaagtcttcatcctggcaaaaggaatgcttccagtaaggaatacaacaatggtcctgtagaact

SEQ ID NO: 69120 - DNA, 1016 bp, Homo sapiens
cttggcaaggttacatcaagcaagcagagaaggtgatagcagagtgaaatcatggtagaaatatctctgcagatgagaagtaataaggtcaaagataagaggtacatgaccagactgggaaagaagaatagaaaaggtagttaaaaagaaagctgatttaaaaaaaaaaaaaaaaaagaattaaagatgaaaacataaaacgagttttataaatattagagctgggctagtctagtaaccttgaatttggttaacaatacttctaccagagacatccgcagctagctatgcttgatggggattttcaagtccctaggccagcaggatgataggaaaaaaatattcacgctggcagacaagatctttctcactgatcctggacatctggtcactaaatctttcagaaggacagattagagatggagaattgaaaacccctccagcagaggcaccaatagtgatttttaaatgagtatggaagccagccaatctcttgccacaggatctgcaaaactacattacatattcagtgttacagtaaaaacaaaagaaaaaaatttaccagaccgtattttttcaagaccctgaaggggttacaaggacagtaaaaagagtaaaatgaggacaattattcacccaaaatgcatcatgactcaaccaggtcaagcaacctttagtaaggtacgttccgtatgacaaggaaatctgtgccacaagcttaacattgaaaacaagtcctgcatatcttgatgatgttgctcatgggataatgactttccaaactgaacatttcacaatcagccgactttatacttagttcatgtgtatacctccatcaggaaccgagggcaggcctaaactccattcacaatctgtctttctgtaataatattgaaaaaatttttttaaaaaggttggggggaagagaagacaacataaaaatcaaagaaagatcagtcaacccagagaaatctcccaatgccatcatcccgccacctaatgctgtcgcaaacagg

SEQ ID NO: 69121 - DNA, 1014 bp, Homo sapiens
taggaacacactgcaaggttgcatgggtctgcttagggatggaacctaagccatgaagtcaggtggatgcagcacattaagaatgagtaaactcagcctctgtgctatgtggtgtcgcattttcgaaagctggttgttatcagcaggaatatgctcccaggggctcattgtttctcggcacaatctctgctttaggcccctctgtttcttgaaaagtcttgtcaaggttcccagtctgaagacaaatatgtggtcctctgaaggcttttcacttaatagactactacccaccatgtagcccgtgtgctttgtaatttcacttaaaatgtttgttatatttattatagtaataggagtggcagagatagtgtggagatagatagaaggcgccgctgaagcctcctttggtcctcttggaggatagcaggttatcgctttgttttcaaataatgcagttggtaataagtttttggatatatgtgagctgtaaatcgttctgaaaattgaactgaagatacaatatcataaatctcttccttggtggtagaatatttatggggagagcaatataatcagttatgtggctgtgctatgtctgacatctgactgaaggggaccctgtaccaaggatctatcgcttattagaaaactcctgtgggtgagcatgtgtgtgtgtgtgtgtgagtgtgtgtgtgtgtgtgtgtaggttggaagactcttttaaatggggataatcagatatttccttattaaaattaatcgggaatgcattagtggagcaggtagggatgctggggtagcatggtgctggtagggcaaggagacgcaggacgctttaccctcctgggcagcctcctcctcgaccgggtggtgtataatttggttcccaaaatcaatgcttgtttgttctgggaactcagaatcctaagaaaatgcacgtttcattagacttgttttgaaactcatgatcatcactgtaaatacctctgtgtggaaagcaatgaaataaaacca

SEQ ID NO: 69122 - DNA, 1025 bp, Homo sapiens
actatgaaaaacagccattttcaacctttttataaaacctcttcagggaatattggaatattatttttgtcaggcaaaaataatccagggcttgagcattgctgtagaatatgttatctgttcaaaacttagcagagcacgcatgcatcacatgcattgtcatcagtatttgagagctgaaccaatggtttttgatggttgccgtaacagaagatctgtgaagaggatggtggtttgcacctgttcctgaagtcaaactggaaaaggttgcaggtatttcaattttctcaatcattttgcataaatgtattaatattttgagtagtaatagttctaaacctgcaggaaggcatcattgtatactgtggtatgtagagaatactactcttacactgctctttatcttaaaatgttttggtatactgtgaatattttcctctaagtatttggtgtattttgacagttattaaaggagaatataaaattaaagattctggtctaaactaagaataatggaaagttgcttcgtcctgccttagaggagttttcagttcatcctcttcttgagaaactatgtgttgctgttactaaataaacatttactcaataaacgttttatttcctcaaattatatgtctggattattttagcaatcaaaaacagttgtagaatctttgggattgaggtgcttgagaaccaggagtctaggtggagggcagttcctagattggctaattcagcagctgaacagtgtcatcaagagccttagtaccttctgcctttcattgccattcttaacaagtgagtctgatgtctccccttatggctccaaagtgaccacaaaggttccaggtggtggatgataagaggctgaaatatcttttttttttcttttttataagaggaaggtttcacctgcccccattcacttgctctcatggccacagcaaaatgtgtattatctccaaagcaatcacttttcaaagggaataaagctcctatgattggctcagaccatgaagacc

SEQ ID NO: 69123 - DNA, 1016 bp, Homo sapiens
ggatactttcagttgaaccattctgagtagatttaagagaacaaaagacagcagaaataccttaaaagatattattggctgtcttatttttcagatatttgtatttaataaataccttagtagtagtcagaacctctttgagatgtttttagaaagaccactgatttgttttttaaaataatttttttggttccttagagtagagaagaaaagtaggggtgcaatatgtcaggtgtggggccagttatccatttattaaatgcaatttcaagtgtcttaaaaacaataattgccttattgcattttaatatttaataaagtagattaaataaagatttgtattataacagttattcttttatccattgccaaagcaacccttttttgcctattaaaatctggctaaactgttctgatgttgtttcttaattcattaaacatgaaactaggttttacaaactaaattatataaagacagaagtctaaaaatggtaccagaaaatttttttttaaaaaattaatgtgttattcaaatatccagcaattaaagactcatgagaaaaacagaatagcatattagatgtaacagtttaaaatggattgcaaatcaatgtcagacttaaatagaaaatatttattatcacctcatttctaccaataatttcagatgtttaatgggactttgaaaagataggaaaaaatagaaatgaaaatttatctcacctttaatactgtgaatactatttggagggtccctggtcagacatttaaatatcaaacttaagaactgacatggagcctttgattagtttatatacaggatctgaatatttacacacatagcacactatagcaacctcttgtaaaaaatcatgaagatagaattcaacagtgtatattctattaaaaagtaaattggctgggtgtggtggctcatgcatgtaatcccagcactttgggaggccgaggcaggaggatcgcttgagcccaagagtttgagaccagcctaggtgaca

SEQ ID NO: 69124 - DNA, 1789 bp, Homo sapiens
ctcttcttttagccagtccaccttttattagtttcaccgagatactcgtagggcttttggttgtcttcttaaccagtatttcagtcttctctgcccttgcgcatgttctccaggattcccccggagatttaccatggctgtctttctttaatgggagataatagttctgtttaatttattgaaaatatttgttaaacatctaatttctgtgagacgttaaatggagatcgttcatattaaactgattgaagaagtttggaaaataattgaacttacatatgtacctttgccttttaaattttttattttttaaaattttctttctctagtgttcttttgaagatgacaacatccgttccttattaaaacctttagaactggaactacaaaaaacagtgcatacatactgtggaaaaatttacaaaatatttatcaaacaactagcaaaaagtgtaagagatcgttatgccagatcaccaaaggaaaagtgattcttggtgactgcttaatcaaatggatgaaaacaaagaatcagaagataagtgtgaaggaatcgtcttggatgaagtattcaggaaggaattactcatctccagaataattttttttttcctaaagaagttaagtaagcagtattttcaggtaatgaagaataagttaaaatcttgggcctcaacattgaacattttttatctctgatgttttgtaatgttacttgctatcattccagtattgatgaaaatactattgaatgggtttaacctgcagacttctgttgactcatactctcaagagtggtaggggtgtgtagatggagaaaatgtacctcaaacagtgccaacactcaagactgtgagtagagcaataattttatgtcagcactaacctcactttaaaagtgtgagaaaaaagtttgtttacaggagcagaaacaggtctgttgtttctgaagaaatgtgatgtaactgatgtaaccattgacaatctatgtgtgcctttatacatttcatctctgttttaaaatatttttatgacaatcatgtttaaaattatttttagattacaagtaagctgcatgttaaaaattgagctgtgtaaggtagaggaaaaatagtgaaaactttgggattttaatctgtgtgtgcgtgtttgtgtgtgagagagagtgagaaatgtagtgtttcattttgtatgcattaaactgtcttgccaaaactcagatctaagattgttaaatagatatttggggaatttttttttaatcactttaaatgaaaaacgtcagctttactgggcattctggaagcaaaatatattatgctgatggtaaagtgagaaccttaagagtatactcatgatggtggaaagtgtgatggaccaaaatgcataagctatatacttcctgtgagtagtaattttagttacaatggagtagaaaaatatggtccatttaaacttgtcttctacctcataacggccttgcaagatacttttgaagaagcaaatgtctagagccttactttaagtaagttaaacaacttaagtggatgatttggaataagattgttacatccagctgtagaaaatgtggttttaattgggttgatgtgcatttttgaatatcacctaagacagttaatttttttaaatcttgagaaattacttctttggcattcttgacctgttagctaatataactatagattctgaatacttagcatatactatgctggggcacatatcttattttaccaacaatatgattatctatatggttatcttctttttc

SEQ ID NO: 69125 - DNA, 1026 bp, Homo sapiens
gatttatcaatttcaaaatgatctatttgaactgccaattatagaagttaagcaaataaatcagactaatagccatcatggtaaaaaataataatagctaacactgaatatttaccacgtgtcaggtgctattccaagcactttaaatttatatattaacaattttaatcatcaacaactctgacgtaggcccagacgtaggtaccaaaactatcttcattttaagataaggacacagttactttcgctttctttcgtgacttactagttttgtcactgccacatacaacttccttttgttatcttctgttttactgtacagcccttctcacatttagggttagaaatgtcacttgatattgtgaggagtttgcatttctctttgtggatttgtaatggttgctgtgggaagaatgaggaactgtcatcatgctgccattttaagcctgaaagtctgaagctcttttgaatgtttttatcaacagaatgatatgacaactgtacgactacaatggggagatatacttatgccattgcttaaaaaatacaaactaaacatcacatggggtgatcaagatctattgaatatcgtgttttttcataatccaggtaattatttaaattccttttatttgcattaaaaaaatcacagataatacttagtgaaaaaggaaaacatgcacttatctgattctgtcttatattaatgattattgctatttatgtttaagacggagtaaaacttttcttgaattttgctttaattggaagagatctaaatgccagacatttttcattaattcttacttgtaagagctgtattttttaactgaaagttttgcataatgttacatctgtggaattaggggtatttgcttcattgtttggtcttttctttatgtagaaagcctttttgtttttccgtgtcaatggaattatcgaccagatcattgtatatatggaagcaattgccaagaagcagaagaaggaggaatctttattcttcatgggaacagaggtgtttac

SEQ ID NO: 69126 - DNA, 1078 bp, Homo sapiens
gacacaacctagaaataagagtatggactctgaatctggattgcctgggttccagtttggctctaccacttactagttgaaaccgaaatgatgtaaagatgccagtgttacaggccaaggggaataagttcagaaaatctttatttgtattggtttatttctgtatttatctcaggaaattaggattcaagatataaatttacctaagttaatgttattatccattatgaaaaacatttcctccctgatctttgaagatttcatattattctctcaatttttataattgagtattttgttttggtttgttttcatatcttctctgaaagttaatatgaaggttagcatagtatctttatatatatgctattgttaaaaatgacagatttaggaaagattaccttaaaataaaataatataaattagctaatctcttaggtgtatcttacacaattagaggtgcttttatgtttctttttaaaatagaattatagttaatcattcaaatatctctccttgtagttaatcctgaaagaagttgactcactattgtatgtcgacactgatatcctttttttacgaccagttgatgatatttggtctttactaaagaaatttaattccacacaaattgctgcaatggcaccagaacatgaggaacctcgaataggatggtataatcgctttgctaggcatccatattatggaaaaactggagtaaactctggagttatgttgatgaacatgactcgaatgagaaggaagtatttcaaggtaagtcactaatacaggtagttgttaacatttctctaaaaaccttctaaattgtttttaataaaactaaattttattaaaaactaaattgaactataaataatttttctatttagaataatctcattagaagaatataaatatctagatttatctagaagtgtgttcatattattctgtttaacagagcattacaataggtcaaaccagatgacatgacaatggagtaaaataacaatgccctaagtagtgaacatcttctccctagattgccattccaggaagcagatgttattttgtagtt

SEQ ID NO: 69127 - DNA, 1037 bp, Homo sapiens
actaagattttattttgaagttggtattgaaaagatctttaagtgattaataagtggagcagggaaatgacagtgctagtattttacaataattagtagatagctggttgtggtggcatgcacctgtagtcccagctacttgggaggcctgaggtgggaggatcacccaagcctgggaagtcaaggctgcagtgaaccataatcatgttactgcacttcagcccagtctgggtgacagagtgagaccttgtctcaaaacaataataaaataaaataatcagagacaccaaagcagagtgttggaagtaaaggcattcccttaaactatattggaagatattagtgttttagaaatgacttaaacactatcataattcaaaagagattttattcagcctgtacataaactacttagttttttcccccccatagattgtttcttaatgctcctcaggaaatttgaatcagtaattctgttgaaataagaatgagagataatacttaaactgaattagaaacaattcagtatcttgaaatgcatttagggtactaagtgtaaacatgttcatcatagattttcagatacattttgctttttgtaataatttttaaaaaattggcattggctatgtatcagaatattctcagaaatatttaggcatattaaagctatgcattgatggacaaatattttttaactagtttcatatttggtctgactttgaatgtaagcatctttcatatcgtatatatggtggtaataatattagtgcttaatttttctgattttagcttgttaatggattaagagaatttacacattaggtaaagttgaggaagacaaacttgcgagggtctttcacctttctgattttgggagttggaccctgataactttcattatgcttcagatcttaatggggaagtctgggatctaattttgatttttagattttaaatgaaaacaaatacagtggtggaacagaagaatctttcctttaattttacagcataaaatgtatattatcttaattttt

SEQ ID NO: 69128 - DNA, 1114 bp, Homo sapiens
gctaatttttgtattttttgtagggatgggatctcggtatgttgcctaggctggtcttgaactcctggactgaagtgaccctgctgccttggtctctcaaagctctgggattacagacttggcctagtttgttttataaataaaaattttgaacttcagtttttctttctttcttttttttttccttccctccctccctttccctttgcctttccctttctctttcttctctttctgtcctttctttcttctctgtctttcacagggtctggctctgttgcccaggctggagtatagtgatgcagtcatagcttactgcagcattgaactcttggtttcaagtgatcctcctgccttagcttcccgtgtagctgggactgcaggcatgagtcacaacatctggctttgagcttcactttttgagcatgatgaaagtacacattgtaaacatatactaaaactgttgaaaaatgtggttttctttcctattaggtacagtctgaaaatacagcctgttgagaaaatgcatctagctgtagttgcctgtggtgaaagactggaagaaactatgaccatgttgaagtcagctatcattttcagcatcaaacctcttcaattccatatttttgctgaagatcagctacatcatagctttaaaggcagagtaagtatttgagacatagtcaaggttgtagagttgaatatttaataatatactataatagaatgttgttgtaatagtctgttcacattgctagaaataactacctgagacttggtaatttataaagaaaagtttaattgactcacagttcagcattgctggagaggcctcaggaaacttagaatcatggcagaaggcaaagggggaagtaaggcatgtcttacatggcagcagaagagagagaaagagaaagaagaccacacttttaaaccatgagacctcatgagaactgatggttatcacaagaacagtaagggggaaacggcccccatgatcgagtcatctcccactaggtccctcccttgacacgtgggaattacaatttgagatgagatttgagtggcaacacagagccaaaccatatcagttgttttatttcttaattgcaca

SEQ ID NO: 69129 - DNA, 1028 bp, Homo sapiens
aattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaa

SEQ ID NO: 69130 - DNA, 1121 bp, Homo sapiens
aacttacatcaatctaagctacctgcatgttcaattattagcagttttaaaaatgttttcttttaccatcagtataatgtatgattgaaaccacagccgacagattttattctctcttgtgtcatgcttactttcttgctgaatcttagctagaggcagagaaaccattttgatagtctaggcaagaggcagtaatgtcctgaacaaggggaatgccagatgggagacagaaatgaatgtattatagatgtgtttaggagagatctgtggaacttgatggttgattggatatggttgtgggaggcaggaagttgggtcatagtgaaggggaggtatcaaggatgaatctcaggattctggcttaagcagttgagtgagtggtgttagttctcactgagatagcaaataggaagacaggtttgggggaaggtaatagtttgcctatagatttgttgaatttggggtgcctggggaaaatttgagagggaagatctctgaagcagtttggatatgttgggtaaggcttaggaaggagaaaagggctgtaaatacatatttgatagtcatttgtacacatgatttgagttgaagctgtaggagtgggtaagacagatcagggagggaatagattgcctaccatgagaaaagagacctaggagagacttttgaggaacatctttatttttttacagtggtagaagaagagcatcccacaaagaagaagaaagaaatggagaaggaaaaaaaaattaatagggagtaagaaacccaggagagtgtaacaatacagaaacagagggaagaggatattttcaaaaagaggggggtgtgtttagccatctccaatggcttttactttcatcagacagaatcttaatttttctctcaagttccatgtagtatttgttttaataagtatggcatttagatttgtatttttaagttgtaacaagataatacttttgcgtagtgattgtcctcagcttttcatgttacaataattctggtttatatttatagactaaataaaggaggttaatattggtaggtaggaagataagtaaaattatgttagtaactaactttgtttcccaaggatataattatctagtaatatctat

SEQ ID NO: 69131 - DNA, 1043 bp, Homo sapiens
accaccatgtacatgcatgcagtaagaataatgtcagtttgaattaagaatatccttgaagcagaaaaatttactaattttattacatctcatatttttaaaaatattctgtctgaccaaatgggaactacacataaagcacttctactgtataccaaagtacagtggttaagggaaagcacatgtgtagtttgtcttgcaagcagagctagtctttttgtcatagagcatcatttttacttgaaagactacctgaaataccatagttattcagacttggatatttagcatatattttcttgaaaatgaatatattcaaaaaatatatcacttcaaggaaaacacttgatactatatgttgccagtgataatcattcaagtgaaaattagaatttttgaaaatttgtagcaacaatgagctttagagtttctgtgtataaagacttttctgagaagattagtggtggtatcaatgaatataatttctgatatttcaccatgaaatgtgtcagcatttggaagctacgcataactcagcaaacaaatggttcctagttaccgatgtatgattttacaaaactgtaatgggtaatccatcaaagtacaaaataccaacagattttaagggaacactgaaaacttcattgatgtggtttcagatttcatattgcaactaacctttgagaaacaactgtgtttttatgtagtatcaaagaataacacctatagttatctgaaaatgctattcaactacttacctcttttcaactgtatatctgtgagagtccagattttcttaatatttttggaccaaaacaacatattgcaacaaattgaatgctgagatagatgtgacaatccaggtgtcttctactaaccagatgttagaggtttgcaaaaatatacgatgccactcttcatacaaaatatctttgttttggaaaataataagtttttaaaataaaaatatgtcatttaatatgtgatgtatttattttttaaatgaactaatatatttagatttttatcagtttttatttcta

SEQ ID NO: 69132 - DNA, 1329 bp, Homo sapiens
ggtctcaaactcctgacctcaggtgatccgtctgcgtcggcttcccaaagtgctgggattacaggagtgagacactgtgcccagcctatctgaagattcttataaggcaagaaatgtcccaaatataaatgcaagaaactttaggaaattaaggatcattcttggctggcccagtggcccacacctgtaagcccagcaccttgggaggctgagacaggaggatttcttgaggccaggagtttgagaccaacctgggcaacacagtgagatctcgtctctactaaaaattaaaaaaattagctgggtgtggtggtgcatgcctgtggtcccagctactcaggaggctgaagtgggaggatcccttgagccccagagttcgaggttgcagtgagctgtgatcataccactgcactccagcctgggcaacagagtgagaccttgtctcaaaaaaacaaaattctgagtcatcagagaaaatgaaatattaaatattaaggatagtctgtatgagggtgataatcaatgtgtgatgattaatttaagactggtgtcttattggtacttcatctagtagtggacagttacttaatattgcttaattcagatagcaaatatttagaaatgaaaatgatagaattattggtttgggtttcaaactgtggtctaaatggttcataccaggctttcaaatgtaacaggtaatgttacattttgttagaggatattataacagtcctttaggtttctcataggtgttattttagagagctataaaaaagatttcacatagtagaaagagtgctagatgttacactagtatgattttggtaacctgggttcatatctcatttcatatcaaccatttcaatattcagcattcagcaaatgtttattgagcatcttatttaagggctgagttggatactagacatacagtggtgagcaaaatggatttttttgtttctttaaaattttacagttttgcaaattagaaccgctttaactgtaccaagctctatatgtgaggtttagtgttagtagatctttcctttatgtgtaggctgaagaggtggaacttcttcattaaaaatatatgttgtttataactgaacacagtattattattatggttaggtaaaaagagtgagttatttcagcttcttttaaaagtaagctataaaatccacattctgaaagaagcttaaaccaactatcatctggtagaaatcttttcagcatcgttgttttcttgtcatacttgctttatgtcttcaaatttgaggtttggcactgattcttctagacttttggtgtaggaatgggagaaaa

SEQ ID NO: 69133 - DNA, 1069 bp, Homo sapiens
ttccattcttgatatcccttgactttgaagagatagctgatttttcaaatgtattaatttatcttataaatttttagccctttttaaaatgaatttttcaagtattagtatctgttttatttattgctgcctcatttttaactctttgtttatgctttaagggttaccatcatgaaagataaagataccaggaagagtaaaggggttgcatttattttatttttggataaagactctgcacaaaactgtaccagggcaataaacaacaaacaggtaagctattcatctccatcaaggtttttagccccaaagcctttatgctcatccaggccaaaaatgtggggatatagtggatcatcaggtctagcagatatcagtagattcttaagatatctaacttatagaaagaaaagaggtcaaactactgggttctcaaaacattggtggaatctcaggaataagaatactacagaatagaatttatcacacctaagtgacaattgctaaaaaatccaaaataaactggaattgaagatttgagaaaattgattaaataattaattttaggtttcagtgaaatacattctacatttacatttttctcttgtttagttatttggtagagtgataaaagcaagcattgctattgacaatggaagagcagctgagttcatccgaaggcgaaactactttgataaatctaagtgttatgaatgtggggtaagtaaacctaaaacttaatggaactttccatagtttaagatacttttcacatcagtcttttatttttgctcaccaaaacttctgactggctaaaccagattatgaaaatgctttattttttaatatttatttttttgagatagggttttcctctgtcacccagtgcagtgatgcagtcacaactcactgcagcctctacctcccgggcccaactgatcctcccaccacagtgtctgagtagctgggaccacaggcatgcaccatcacaccctggttaatttttaaatttttttgtagaggcagggtcttcctatgttgcccaggccaatctcaaactcctgggctc

SEQ ID NO: 69134 - DNA, 1028 bp, Homo sapiens
ctacagctgattgtggctatgtgagaatatgatcccagttttgccagaacatctaattttttcaaaaaaagttggaaataccattttttaaaaagcatcctctcccagtttttaaatgttgtcagtggaatagaattttattaaaaaaaaaaaagtgggtcaaacacaagtctcatatggcctatcagtcactagtttggaatctgttttaagtcttgtagggtttatataatgggctttgtggagaataataggttttgagttgggccttgatggaccgttggatgttgaatgagagaatggaaaaagatatcccgtttggaaaataaacagctccgtggtagtatgtgttagtctgtttgtggcacagtaaggaaacaggcataattatatgcttttggagagaatagaaggttagatataatagaaggaggcatatggaagatagaagtttggatttattatggttaataaaaaacctcttggattcttgatcctggaaacttcacattatgaatatgcgttaacagttgattatccttttttagggtaaaatggagggtaaaacactggaaggaggctgaccggttaaggccttaacttccatccatatatgaaataaaattcagatttataaatattatatgtaggcagacatctggcatttttgtttacttgtgtaatttcagttaattgatcaattataatggacaatcagggatctcctactaagtttagtgcagtacattcgggcttataaaagaagtatccttaaagcgttggaaagtcaagtgacttgtgaaactagtagagaatgcagtactttttatttttttattttttgagacggtgtcttgctctgttgcccaggctggagtgcagtggcacgatcatggctcactgcaacctccatctcccaggttcaagggattctcctgcctcaacttcctgagtagctggaattacaggcatgtcccaccatgcctggttaatttttgtatattttttaagtggagacggggtattac

SEQ ID NO: 69135 - DNA, 1053 bp, Homo sapiens
agctagtcctcctttccctgggagtgacctgccatagtagtcacattgtggtcaccttaacctatttaattgtctctgtaaccagctacagaaactgttcagtgtcagtggatagttaggtcttggaatttggcatacatggcaattatgtgcagggacattcagaacccatggcagactgtttcttccaaaagaagcaatagaatagatgccgaaaaaaatgctttgataaaattaatcaccaagtagttataaaaatagccagctgggaatggaaagagaatttccttgaccgggtaattgggcatttgctgtactgaatggtaaaattagaaacatttgctttaaaatcagaacaaaacaatgacatctagtcactgcttccactcaacatggtaacaatgcctacagtaaagcgaaaaataaataagttgtaggaattagaatgaaaaacgcaactacttaaagataatataattatgcagaaaatctaggaaagtctatagactgtaagaactattatgaaattagcaaggtccaatgtaataagatcaactatcagcataaattagaaaatttgttttcaaaatactatagcatgaaaactgtaatgagtgataggaataaactcaccaaaagagtatgaggcctatacaaggaaattacaaatcatttctaaaggaaataaaagtgaatcagagtaaaaggagaatcatgacatccttagcgaggaagactcagtatcatataagtgtcagttctcctcaaattaaggtggtaattcaatttggttccagtcaaagatcaaaattttttttattttttattttgcacggaagttgacaagttaattttaagactaatatgaaagagtaaagggctaaatggcaaaaatgccttgaaaaagatgtgaagactcaagataccatatgtgcataattataaagctgtagtgatgtaaacagtgttgtactgttgatgtcaaatagaccagtgaaacagaatctgcaaataaacctagatatatctggagtttggggtacagtagcagtg

SEQ ID NO: 69136 - DNA, 1056 bp, Homo sapiens
cttggacctgggaggcggagtttgcaggcgaaggcgtgctgttgcaccccagcgtgggcgacagagggagactccgccttaaaaaaacaaacaaagttctagttggaagatctcttagtccatatcttatgcctggaatactttcgtttgttctactttttctagaatgcttttaactgtaaacatgtgattttgtggaaacagccttgaacttgaccaccaaacttctaatctgaactcaagcaggcagacaggtgtttgattttttgataggatagaagaagaggtgatatggaaaattcctcagcttaagtcgcagtgtctgtggttttccgtttccacatttaaaataaaagatatttgaggttgtacttcacttattcttaagcttgccttgctaattacctggctgctttctcaaaataattcttgaaatcgtaattctttttggaagtccctattgactagaaaggaagtagccaatattttatatgaatatttgtgtatatttggatgtgggaaggagagaaaaatgaggttcagaataagaagtaaatgctttccatctccccattcttcccttcccttgtatccctttctcccactttgtcgaattttactcataaccggtgaacatatgtctgctgacactgagggttctatcaccgcttacctggtttgactgatgtgaggggcgggaattaccttggggatttgtattaacaggagaatctgagcttcaaaaatctgcttttcaaataagcatctaaagtaatctgcaatcacagatggttcaaggaccacattttgagagacagtgccttatggggtgttagttcttcccttcctccattctcctgatgactttgcgtcttttatatgccagccagtatagctggagtgtttgcgatatagccaaagacactgtcctaactctcaggctgtgtactctttgataataaaaagcatcagtttcgtcagatgtgttttttggaggcctcataatcctggttgtattgttatttatatttcttcaaaggccctttttgattcatc

SEQ ID NO: 69137 - DNA, 1023 bp, Homo sapiens
cctaattccttgattcttgagatgagttcgggcatatttcttcctcctcattactttctccaagcctctgtttccacgtcaactttgaacgtcctcatttacaccaccctgtcttattgtattctctgatgaatttccaggagaccattccttcttccttgatgattacaatttctgactcacaatcttctctatccaatctgcctctgtatcgtgatttaatgccatgtttaactctagttgtttcttgtatttttcaactttatatatccacaggcatggccaggccttactttcatcactgggaattgttttgccgttatcatgaactctgaatttctgctttctgacttctgaacggttcacttacatacagcccttacatgctagtgagcttctttaattcagtcctttttaacatttcgtgtgcataggaatcacctggaaagccttatgcagaatcctgagtcacacccttagagattctgattcagctggtgagggttgatgcccatgaatttgcatttctatcacctttcctgcaaatgctgaggcaggtaggtctatggacgtacattttgagaaggattgctctaattaatactttgccccagaggatcagtaaaactttctaatttgcataaagcctccattcacattctttctttacttttttgatgacttctgtaattactgagacaaaggccttttgatgagaactctgttgtattttattttcttgaaataagagtttttctatttattcttttcatattcttctcttctacttagtccctttgtctcactttctccagttgacttttggctccttctttaccattaacatttttgtgtcttgcgttatcagtttccccttttatagtgaattggcttttttctatcagccttcagtagtggtcaaataagcccctttcctcaaaataccattccttcccatcttccctccttcagcctgttttggaagaaaagttacagcttttaacttcttcactagctatatct

SEQ ID NO: 69138 - DNA, 1022 bp, Homo sapiens
tatattcttgtatatgtaaaatttgtgacccctcacctgctcctgtcccatctaagataccactgtctcttgcctggactaagttaggttcctcgttagtctctctacatccattcttgactgcattcacatgttttatgtatatttgtctaatgtcagcctctcctattaaaccgagagttctgtgatggcagggactgtgtacatttggctcaccattgggtcccagcacctcacacaatttctaaaacctgtttatttaatacccatatcaccactctggctaaccagtgctgttggtatgacccttgtagttttagtgactaaactagtgctagaattccttaatgctctatttcattattagtgttctataccagttcatttaccataaatgaatttaagctattttctgctttttcccagggaaacttacttgtgtctgaagggacaatatatttggggtattaatcagctagtgttcaaatgaactttaggacaacagcctgtttatatcctatggactgccaatcaagatgctgaaatgattttccaagcacttgaaattgtatgctattggtatgtctcttagcactcttctgtctgaaatttagtattctttaatgttgcagtacatttgttaaatcatggattaaaacctgtttgactcttaagtgttcttttattagaggcttagttgatgatggtttcatttagtaattttgatttggtttgacattttaaaatggttttgctttataaggttttactactagggcttacttggtgctttgagttgatggtatttctcaataaagaaatttaatttataaaagtagaggtgatttataaaaagtagttatttagagatgggcaacaatctatgtactgaggatgcacactcagcaagaatttaataggtatatagcagggtttctcagtgttggcattatttacattttggactgaagagttttttggtgtgtagtgttggggggcatgtcctgggcactgtaggaaat

SEQ ID NO: 69139 - DNA, 1047 bp, Homo sapiens
aatttttttttctttatttttgagacagtctcgctctgttgcccaggctggagtacagtggcgcgatctgggctcactgcaagctccgcctcccaggttcacgctgttctcctgcctcagcctcccaagaagctggggactacaggcacctgccaccacgcccagctaattttttttttttttttttttgtatttttagtagagatggggtttcgccgtgttagccaggatggtctccatctcctgacctcgtgatctgcccgtctcggcctcccaaagtgctgggattacaggcgtgagtcaccgcacccggccccaagagtacaatttaaagggtagcttataagcagagcttttgccattgtgcttgtatatagaggatagagtataattaacttattttatgtttttttttttttcaaagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaagtatgtattttaagactttatttttttctctcacagtctcctctgatgagaatgtactgagtcagatttccttctaggtgtaagagatttattttttaaactttttattttgaaaaatttcaaacttacagaaaagatggtagaatagtataacaaacaccatacacacacatttttttcaaactatttgaagtggcattctgcatgacacttacctttaatttcttcagcatgtaaaaggttttttttttttttttttcagagtctcgctctgtctcccaggctggagtgtagtggcacgatcttgtttcactgcagtctccgcctcccggattcaagtgattctcctgccccagcatcctgagtagctgggaatacaggtgtgcaccaccatgcccggctaatttttgt

SEQ ID NO: 69140 - DNA, 1218 bp, Homo sapiens
tggctcaagtttctataaaaaataatatacatacagcactatgtgagtaaagtgactaaaggtaaagattagtgactttatctcatacaggtttatttttaaccatttaacaaatatttgggcattcattaatgccaggcactgattagtgctctgaattatagctttctaactttatgtttaaaactgtctaaacatttcaggaatatctgctaaagttcctatgtagatcctcttgagctaccccttgattaactagttctcctcggtatctatataataactacctttgtatttttattgtgatatatcaaaaattagcatttaggagcatggaagaagtagcattcatggttttaaaatatgttttgcctttcttgaagtctctgtggctccatgtttacttactagcagtgctgtggcctagactggcttctatgatatcctttggttccaggttatttcagattgttgatggtgcttagcctctgagaggtagttttagatattaacctatttaatgtaataatgtaatgaaaagttttagtactaaaataagtgtatgacccccacattaattccattacaaaattactttatcaaaaacaaattagctagaaaaaaaattacatcttatgttttcttatatagataaagagaggcctgtccagtctttgaaaacatcaagagatacttcaccctcaagtggttcagcagtttcttcatcaaaggtttgttatatttctaaaatcagtttaaagaagaattacaaattgagatggactgactagtacagatgcttttattctttactgttatgccaagggagctaatttgctgcatttaaaaacttaaatttttggctaggtgtggtggctcatgcctgtaatcccaggactttgagagactgagattgtagggaaaagaaagagagatcagactattactgtgtctttgtagaaagggaagacataagaaactccattttgacctgtaccctgaacaattgctttgccctgagatgctgttgatctgtaactttgccccaaccttgagctcacaaaaacatgtgttgtatggaatcaaggtttaagggatctagggctgtgcaggatgtgccttgttaacaaaatatttacaagcagtatgcgtggtaaaagtcatcgccattctctagtctcgataaaccaggggcacaatgcactgcggaacgccgca

SEQ ID NO: 69141 - DNA, 1349 bp, Homo sapiens
ggtaccaagcattattgtggatacttccagatctattacctccttcaattctcacaactgctttgcaaagtgagcattattaacccctattttgtaaatgaagaaaccaaggctcatggtgtcgtaagttaggtgtataaagtcatctacctagcaagtcattaaactgcgattcaaagccaggtctgtatataactgcaaagtccataccttgtttagtattgtgtgcagttagataaaggaactagtagtaggatcaaaaaatgaaatttaagtttaaaaattttgtgtaaggagtaggatttatgtaactcactgtacactgtaataatagcatatctgtacgtttctgttgtattaggagtttgctttactgaaatttagacattacttatttcattaaatatgcttaaaggcacaaagttgaaatcagtatgatgtcttttatattctaaatataattattatatgagttaattgtcagtgtcttttgctttgttacttagatgaatttctagagtcttatgtaaatgaaattaagaattagatctggtctatatgtcccaaaggaattgctacttaaagtaattccatgttgaatatttttgaaggaggaaataaagaatgtacctgttctccatagaaatttggaggcttatatgattttaaatgtaagtggagtgtacttcttggtgtatttgaagtttaaaagcccttgagaattgtaacagaaatgttctatttttattaggtgttagacaaacccagtaggctaactgaaaaggaacttgctgaggctgcaagcaagtgggctgctgaaaagctagagaaatcagatgaaagtaacttgcctgaaatttctgagtatgaggtaaggcataatgtctcctttatgtttcacatctgaaagttttgtctggattttaaattatgggcgaaaaatatttggtttattcctatacttcaaaatatatccttatggattacaggtattaaaattaccacacagaatgatagtcagaatatgaatgactctgaattcagtaatcacgctttgtctgaatgtttcctgtagttttggtgtgtaagaatagtataaatatggagtataagaaaaatgcgttatttatatacttcttttaatgggctttgctgttaaaagtatctcaggaaatcatgctaagccactagttataaaccagtgaattcagaacagaaatctaatttgaccttggattgtggaccatatttatattgcttgttatacttcatgcagattatctcataaatatcccaagaaataaaattattcattgtctgggcaacccgagaccttgatgagtcttgaa

SEQ ID NO: 69142 - DNA, 1141 bp, Homo sapiens
ttctttatttgtgtacaacacctctcacttccatttggactttttctcctcagtatttcgtaaactgatcacttaaggaatagtcaagggacaataattttttatctgtatcttaatataatgtgaaataatattttggaatcgaataggcctagaggctttgtcttacctaaaatttaaaaagtaacagcctcacttgcttcggcagcacatgcactaaaaattggaatgaaacagaagattagcgtggcccctgcacaaggatggcacgcaaattcatgaagtgttccatattaaaaaaaaaaaagtagcagtcatttcttctttaatccatttcacatatgctcattatgcatagtgaaatggagagagttttcttttcttaaaacatgttaaatctagcacttaatataatttgccagttagtgcctatacacaaccatctgaactgctctatgttttttaagaaaataattaaagatttctaattccttttcaaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtgagagtctagttgtcttcatgtacataatttttgtttgtgttgctttgcacatgtaaacatttattgaataaatatgcttcatttctttttccacctgtaactctaaaactacaacttaaaaaattataaaaattgtttgagttgacttcacagtcagtttgatcagtatggtcccccacctggattgtttatttttaaataaaaaacagacttcttttttacagaatattaatattctagttagtatgaagcaattaaaaattattaaagttaatagggatgggatggaagaaatgttcaatgtagcaaaatgttagcaaatgttatttttgaatattgggattacagatgtttcttatgttttttcattatactttaaggtagtttccaaatattaaaggaaaaataaaggatactatttaagtctagttttttagtgaagtcattctgaaaagcaggactttgtttttaatgtgcaactattatggggttatttt

SEQ ID NO: 69143 - DNA, 1058 bp, Homo sapiens
ttgtaagtgttgtagctgtggccattttctcttcttacagtgtctcatttcagctactactcattgtctgatgattcccaacactcactagctcttgctgtttctcatatataatctgtttttgttttacatttaaagaggctagaagtaaagattagtgaaatgtacagtcttgaaaatgttaactagagttgtggacatggaaaataatcagcttttagcatatgatgcattccaatgaaattgttttcaaagtagtggcagctgtatctattgttgtaggttcaagatctaagcatttcatagtaaccttacataatagaaacattctttgtttttcctttttatcagagcaagtaaccaatgttctttaaagtgcagctctcaccactatcttgtctagacatcaagtctaccctactgtatttaacaatccattattaccaaccacttgttcagattttacatacatacagttagtaaaatatactcacataagatgtacctctgaaagtctggattcccaaaacaacttgaaaagagatgatttattttgaccaaatttcaaagagtttgaaagttacaatttaccagattctggtcatgctgttactgcagaagcttgttgaagtaaaagtataaagtttttattttaagagaatctaaaagctatctctataagataatttgtatcatatttaaaaggaagcatctcttaaaggtaatttagttattttgtacctgatatctctttaagtgggaagcttgatgaatctgttaagatgttatatttacatcaaatataaaatctagatagtacagataccaagtcttattagaaccatacttaaaatgatatgagtaccttaagggatgaggccatcttgcaccttatccttggggatgttaccactgaaacaaaaaatacccagttataaagcagttccagtaaaggtaatccccatggcataaacccaagtataagcttcattttcttacctcttctcctcatccactctctaccagtgttaggtaaggattttacctagtggttccaa

SEQ ID NO: 69144 - DNA, 1054 bp, Homo sapiens
agaaattaaggtagtatggaaaaggatgggattatatagattgtattttactgaaatttgtagatttatattttactgaattttgaaggtagaataaagataatagatagcaatgcagtatcattttatgagataggtggatcagagccagatggttgaaaaatttgaaagccagaaaaaaagtgtttgaattctatgatgggcttgtggatgaattttgaatacatgagtattatgattaagatgtttgttggaggattagattggctatacagaaatgtttggctactttttgagggagggataatgagagcctaagttaaattggtagagtctgaaatgcagaagaataagtgcatgagagtttgtggcaggcaagtaagtaaaacttagcgaccgatttgtctgttcatctgtttacttttgggcacttgtgaaagaagaagggtagaatgagagactgaagaggaaaaacagaataactgataaagcaagaggggctatcagtagcacagatataggaactaatcttgaaaattcggagaaacacttttctgagataggaggaaaggaaaataaaggacaacatttttgaggtggataggagatgagtttgggaaagaggcagttttgctaagagtagggggaaatgggatagggaggagggggagtcctatcagcagttggatttcctgaattgggcgtgcaaagggcttagaataccccatatgttacatgttggtatggaagtcaacaagagagactaaggagttaatagtggatcaaataattgcagttttggactttttccaacaattcacagcctcctttaagtaagcgtagaaaggcaaaccggattatttatccataattgaccaagtaaaaacacttcaaatgttattaaataaaagttgccccctgataaggtggtgaagatgatgattttatagaaaaaaaaaatgacgcaaacttagtctcttttactttttaactcagtgtttatttgccaagaagttcgaccagttctgagtaactagattattgggacatttca

SEQ ID NO: 69145 - DNA, 1045 bp, Homo sapiens
cccttttaaaaatactacaataatttagcagttaatttttacaaatgatttagtgtttttcagaaaataagtcaaaccataaataataatttctggacttttaaatactacaacacaaataacactaaaccctcagagagcaaagccacattttgatgtttatgctttttattgtgataggacactgaaaatgtgtatgaggagaagaatggtttaatgcctttttccaggatgtgtttatatgaaaaatttctgtctatgttgtatctacatgagcacatggtaattttccatgaagtaaggttaaaggggaaatgacagcgtactgtttcttttggctcttgtgctaagttggtcagccttctgactcttatctgaaccaatcaaatgttcagcactgctaaaacaaagatttttatttctggctttccctgttattctttcctaaaattgacgagtcattccagttttagtgattttactaaccaaaaaagttacaatgttgtaaactaatagttcaaatttaaaaaatcaattttaataaacatgctacgtactgaaaatatgtatggcaaggttcatttgatttttaaggatttcagtagaatttcttagttataacactaccatttttgcccttgtaatttctaataaatagaaatactgagttgtgttccttaatactggcttaccccaaattatttgcaaacaaaacattaatttgactggattcctacctcaaatccttggctgtaggtaaattctatttcaaaaagacttcttgaaaacaagattgatatcttcatttactaaaatttaatagcactgtgcttagtaactaacacccggtatttaccttgagcataaagtggaagtagcaatatgactagttgatgtaataatgacagcatggttctaacattagtatgttcatttttgtgcacagtattattctaagtatttctctgattcttggaaggaacttaatatcatttgagaagtcagtagcagtttatatttgtattgccaactggacaaatcaaga

SEQ ID NO: 69146 - DNA, 1050 bp, Homo sapiens
atgaccagaaatgaagagatcactaagcattcagaatgcacaaaacaacttgcagcagcttttcctgaggaatttgttgtgagagaaaatttaatgggtgtggcaataggaacacatggtagtaacattcagcaagctaggaaggttcctggagttaccgcattgagctagatgaagacactggaacatttagaatctatagagagtgctggtgctgtaaaaaaggctagaggtttcttggaatttgtggaggattttattcaggtttctaagaatctcactggaaaagtaattggaaaaaatggcaaagttattcaagaaatagtggacaaatctgatatggttccggtgagaattgaaggggacagtgaaaataaactacccagagaagacagtatgattccatttgtatttgttggcactaaagaaaccattggaaatgtgcaagttcttttagagtaccatattgcttatctaaaggaagtagaacagctaagaatggaatgcctacagattaatgagcagccataacagattggttctaggtctcatagtggaagaggcagaggttgtcagggccctaattacacctccagttatggtacaaattctaagctgtctaacccctctgaaatagaatctgagggtaaagacaagctgagtgattggtcattgaagaagatgatcgagacagccgacatcagcgtgacagcaggagatgcccaggaggaagatgcagaagtgtttcagggggtcgaggtcgtggtggaccacgtggtggcaaatcctccatcagttctgtgcccaaagatccagacagcaatccatacagcgtacttgataatcagaatcagatcagactgcagacactgatgccagcaaatctcatcacagtactaatcgtcatacgaggtctcgtagacgaaggactgatgaagatgctgttctgatggatggaatgactgaatctgatacagcttcagttattgaaaatgggctaggcaaaatatgtgattgaagagcatggtccttcagaaaaggcaataaata

SEQ ID NO: 69147 - DNA, 1096 bp, Homo sapiens
ttttagcatgtccttaatttataattggttttgcagttgcttccttttgtggttgtaataatttcactcacatattgaatgtaggcactatagctctgatccatgtgttcataatgcatttcttagcaaccaccagtgttctttttaggagctgtgtttttaagaggcattggggctgcagctttgaggaggactcaaaagatatctttttctattaatacagcacaagcagcaacatagattacaatagttttgacaccttctgcattactatagaccaaaattaaagggtttaaatttatctccagtatttaatatcaatgtgttatcgcttttttcctggcctcatcaacacattaaacattatgaatggttccttgtatattacgccccaattggagtttcttttttttaacttatttttatatacctttcattaaaagttgtagaacattttacagatgctaattatatttcacaatgctcctttaaaagttgtaagcttttattttccactttaatggtaaaatagttgcaaatatgtatttaatttactagatcaccacttaaccatgacaactttcccttctttttactcctcagtcctccatgacaactctgctaaatagaattgtctgcagtgatgaaaatgttttatatcctcatgtccagtatggcagccactagcgtttgaaatagagctagtgtgactgggaaacagaattaattctatttcactaattaaaaataaaatatagtcacatatggctagtggctactgtattggacagcacagctctccagtctccaccatcccaacaaactgctattgtggtttacctgctaattgccaaatccagtcaatatgtttctttgatctttctctggcatttgattgactgtgtccttattttataaactctttctttggcatctgtgccttcactgtctcttgattcttaatttttctgcggatgatatcgatggttttagatgtctgcacttggctcttacattgtcttaaagcacactttagctattcattcaacatttactgggtatcagttttgtggtgctaggaagaacttactccctc

SEQ ID NO: 69148 - DNA, 1694 bp, Homo sapiens
gatccacccgcttccacttcccaaattgctaagctaacaggtgtgagacaccgcacccggccactaaacagaatttgttatctgatcatgattcaaacaaagaatctaaagttaggggctcagaaacttttttcttccaacaaataaatgaacaaagtcattgatatgtcttccctagcctttgttcttattctcatctctagtctgatgtcctttgagtagactgccttacactgacaaatgccatgccaaacttctatattcagtaatgtagtttgttaatgttttccttctcattcaggtattgtcagcagatctcatggatagaggtttaaatggcctctggtaatagtgacaatgcaagggcgagaaaggttccgctttcttttttgtgtctctcttttagatgtcagcatcataattctgccaactcagttagctaagtatttggctagttattttcattctcagctaaccagaatgtgttttaccttttaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatcttagagaatatttgctttgagagtaattctcattcaatgataaaatagagcacttaaatctctgagagatacctcagaaaaaaatccgtttttccaagtaatgaactcagtgtcttctattacaataatcctgaaactcctgactctctcactgatgtatgagtcttaaataatatcatatacaagactaataaatagaagatgcagtttgaggtggaaggtgagggatattttaagtttcggactgtaggaaatcagtcagggtggtaggagaagctataaggaaagacgcaaaccttcttggaaggctgggaggttttgcaaagcttcagagagaataaagctgaaggcagctaattctcttaccccgaggctgagggcgaagagtaggtaacaaggtagtgtaaagaaatttatctagataagtttgtttacatatgtcctccagaaaccaacccttgatcagtgcaagactgctccctgcaaaggggggcgacaatgttcattactcacaaattgtgttggcttcaggcctttggcgttctgtctgtaccgaa

SEQ ID NO: 69149 - DNA, 1109 bp, Homo sapiens
gagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgta

SEQ ID NO: 69150 - DNA, 1109 bp, Homo sapiens
ctatatacacaacatggaagaaccagggattagcgccaaagttggctttgtactgtgtcctttatctctttctaccagacccaacgcagctggctgacatttgacaaacaaaatgctgcctctttatttctctgcctttggcatatttctgattttctattatcctctcctccattaggacattgtagttcagcttgactttagattagaaacagacttgtacaggtatagtatacttatgagggcctgagaagaataatgtctgagaatcattcattcacttaactcatgtttattaaatttgtctgctatgtgccaggcatcattctaggtgctgagaatacagtagtgagtccccaaagtccccagcttctaggaaaggagaaagacaacgaacgataaacaaatagacatgtaaatacctggcaatgctaagtgctttgcagacaaatattgcaaatggagggagggtgatattttagttagggagttgaagccttctctgtagagatgaccttagagcaaagaccaggatggagcgagggaaccaagccctgtgaatttttgggcttcctttctcaactggcccctaaagtgtgatctgcaagcatgaatattccacctggctgaaacaaaaggatgctggttgggggccttgctctccattctgcataagttcacccttgacaataacaacccctttcagaccagactaaagtctgtttcattgagattgaacctttgtaggaagcttgcaactgtctccacactgcttcatcactaaaaacgcttacaatgggtaataaaccatgacagtacctgttgaaaatataacaaaacgtatttacaagtaactgcgttagaggaagcacatttacaatggctgacatttaatagtgataagtgctgctatagtttgtagttggaagtattttgttgcctaatgtagctgtcctttaaaagctattccaaaaagggtctgcctggcttaatgtattcacctgctgatactccctttatcataatcatatgatatttcagagtttgatttaaatcaataattgattgcgcatttctcctataggtaggtagctgaaatcttccctgag

SEQ ID NO: 69151 - DNA, 1136 bp, Homo sapiens
caatgtactcagctgtctttaattggaactagagtttgtgttaagtaaaaatgtttggtcttcagcagaaagtagattgtctttacaagcccatgtgatacgagttctaatagtctcctattatttgagctcatctgcaataaatttttgtttggggacatattgttagaattgcccagatatgctgctagaaagaatattaattctattgcttttttttcatttgttgaaactgaaagattttagtaaaaaaaaaaaaagaaaattaatgaaaaatgtattatagtgctatgagttgagctataatcaattttgtctgaaaagtttgttaatggctgcattacttcattgccttcaggatatcatgtgagatacgttcagtagaatgcgttacacacaaactaacaactgaaccatgctcatggtctctcttttgttcagcataatctgcatttaagtggaagaggtgatggttgggttgctgaactcatccaagagtgctgtctttgactaagtgcttagtacgtactgatactggtaatgcctaataggcaacagagcaactattatataaagatcttcaaatacaggctagttttgttgtatttggacaataaaatgattttgtatctatagaaattaagatggtacaatgaactgcttcagaaagctcagggtgtcatttgtctgattatctccagggttggtgtgtgtgttggagggtcccctatgttttggcctttgtgctgtataactctttggtccgaaaggccagcaaagccaaaatattgtcattgagctcccctaaatgagactgacaatcattgcttcatttctggctgaaataatatggtattaaaaatttctaggccgtggatgggcacggtggctcatgcctgtaatcccagccctttgggaggccaaggcaggtggatcacttgaggtcaggagtccgagaccagcctggccaacatggtgaaaactcatctctactaaaaaaaataaaaataagaataaaaaactacaaaaattagccaggcatggtggcaggcccttgtaattccagctaattgggagactgaggcaggagaatcgcttgaacccgggaggcagaggttgcagtgagccaagatcag

SEQ ID NO: 69152 - DNA, 1049 bp, Homo sapiens
tttctttgccctataatacgacatttgggagactattttgttggcagtttcaaagaaaggataaactgatagagaatacccttatgcaagtcaccctttctcttccagtaaataaactaatgtttccagtgaatttcttcaaacttcttggttttaaccaaatgatattgcttcttcttttcctcattttaaagttcagtcatttactcaacagattttttctttctttcttttaagataaggtctcgctctgttgcccaggctggagtgcagtggcgcgatcatggctcactgcagcctcgacctcctggactcaagcgattctcccaccttggcctcctgagtagctgggaccacaggcatgtgccactatactcaacagatttttgtttgggtgagctgctgtgtgccaggttggaggacagaaggagaaaaatattttgtccctgatttcaaggggcttgcaatgtgggtgcaaagtctgaccttgtgaacaatagcaatactgtgaggtacatggacagtggagcatttcagcatgtgcaaaggtgtcaaacaagaatcagagcagagatgctacttgagcttgggctagaaggatgagtggaagtttcccaagttgttagtatagtaaagagggaagagtgtgtgcaagacagggaggcccccaaagcaggttaagctcaaggacctcttaggtaattagatgttgccagaatgcaaatttcaagggaagcatgttggaagctcaagtcagactgataggctggggccagataatgatgccctttggagctttgctaagaagttcagattttatcctgtagatgatactctatgtggcagcagtgtggtgtatggatagattagaggaggtggaaacggactggagagataagtgagccatctattacacaagctagggaagagagggaagggtctatggggacttgtaggtttgggtttaggcaattgttgggaggaggcttgtgcattctagagatagggaatgtgtggtgcctttgagtcatcgaggtggagatgtcagt

SEQ ID NO: 69153 - DNA, 1026 bp, Homo sapiens
tttgccttgcttttcttgaaagtttacttgtccattagcacagtgccacctaacatcacgctgggacattgatttcgaattgattcacaaagaagtgccgggggtcacttagtgactatctagtcaatagcaggtgtcctctgcagatctttcatttcagagtctgtgctgtttagctgatgacacaatctttcagctttaccatcccgagcagaatttcccaatgccacaatgctcatcttaaacatgaagactggtgaagtgatatgttgccattattgatgcatctgttccagagattatgtcaccacaaaggagttaattggtcttgttttgagggtcatgtttaattgcataggtcagcaaaggaagataaatgactacttctttaagtctgtgcctcactttttctctaagacagctgaaacagtacaatcgatttccttatcgccacagctggcaccataagaatgacatacaagctgaaaaagattactggtatataaaaacctgagttaatgagtccagatagttaaatatagaatatgcttaaaccgacttgctcacagaaatcttcccacatccaacaggaagaaaggaggcactagatggcagtcttcaacaaacttgaaatgacatttcctcttaaaagaaatgcattacttaaaagcagtcatgtctgttctgaatgaatttaggcttgagctctgcatcataaaaattgcaactctacgggcattatgtactttaatgtcacattatcgaattttgtttttaaatgtaaaatgattccatatatactttaaaggtccattgctaaattaattactgagttattttaatacctgttttaactttacattttaagatgccatcagagagcttgtttcaggatgtaacagctagggaaaaatgatggtatatccattaagtgaaaaattatgcagctgtcaaaaaataaagatgtagagataaagtagtatgaaaggatattcaggacatatttaagtggaaaaggcagattat

SEQ ID NO: 69154 - DNA, 1006 bp, Homo sapiens
aaatgcatgctaaatctggaagacttagaatgaaaaaagaacgtaaaatatattattaataattttatattgatatgttcaaatcatattttaaatatttggggctaaacataaaggttattaaaattaatttaacttttttttttaacgtgactactagaaaatataaagttccagatgtggttcacattctgttttcattggatagtgctgttctcaactaggaagctagtggtctaaccattcttttaaaatacttttcaattaattctttattatttcaggcctacccctcacacattcgccctgtcagaggaacctggtgttttccattcctgggcctctcttgggttctatgtcatgaatgatttgttgcttatttactttcccactttgcaggcttaggttccaattccttggctctgttaaatagttatttccatctacttttcatattcaaaatttcatttccttgctgttttttttcttttcctttttttcttcttttacgtttatgcgttttcagaatttctcatagtcatttcaaaagatattgagaaaggagcagagataacgtatataatcatgtttagttaactggaagcacaaagttgaactttgataaaacagaaatttgttcatgtcactgactgcttaaactctttactgtctcctcattgcagaaagcataaagttcaaatgactctggtcagttatgaccacttctcttagtttgcttttgctgtagttatcctgcatgcaaaccaccaaatcttaatggcttggaacaataaaggtttatttattgctcatgtcatgttttggctgctaattggctatgggtctactccaacttggtatctgtatccatgttttttttttttatagactttttttattttatttttatttttatttttttgttttttttttttttttagaaatggagtctcactctgttgcccaggctggagtgcagtggtgcgatctcggctcactgcaagct

SEQ ID NO: 69155 - DNA, 1163 bp, Homo sapiens
tttcatttataggggaaaaagagcttttataaatacctttgaggtttgtcttttaccttgtaatttgacttagaaaagcatccacttttaaactcacaggatcaaagtaactccaaaatcataattacaggtgtgctttttttttctccatggtagatgtattttaaaacattgcctgtaaaatgaatatataaattcaactgtaaattcacagctcctattttaaagtgagaaatactgcattgctaacagacctgcttgaaatcaccaatcagctgaccatcccagtcttaacttactgtcaaccccactggggctacctccactcttgccaaaacatgctaccaccagagccaaagtcatcactataggtacagatgacaaacctgtaaatatttgaggctgcacagctataacagtagtaaagatgctggattatgtatttatgctcatgctgaccctacagtgtcagcagctctaaagatgcttttggctctagttctggtagtagtccttttggcacaagagacattggtagcagtcatgttatatgttgtggtgaagcagctttgatagagtgagggctccggtagtgatacttctaacaaactgtaagcttcataaggtcagggcctttgtcctcttatctatatctgcttctctagccaacaaagcaatgagtagatactgaacatttctttattaaacaactgagggaagtagcacaccctggagcaattgctgccttgacttaggcagtggccaacaagaaggtgatctagggtttagaagcagatttcattgcacaggtagcccagatccagagtgggatatgcctctaattaagtaccaggcagaggcattggccatggaagacacccctactgcagtggcaacctctataatggctacaagaagagaatatgaattagcgaatgggatggcactttgatcatgaatcataaatgagcccatgcagagcccattcagagtgcctaacattctccaatcctggaaaattgaggaccaggttgtgactcatgacctcttctagggctgtttatatgattctagatggatctgcctctatggattctggtgatgctaaactttaaaaataataaccatatttggagttggaaatatgcaactgtggccgaaag

SEQ ID NO: 69156 - DNA, 1029 bp, Homo sapiens
tgaaaatcagaacagttataaaattatatttgtttctaaagtttatggtgtgtactcccctaaactactttaaaaatctactcacatcattctttctcatcagatttcaccccggtgggaagagtttcctatttcctattcttggggagagcttatgtgagattactattatttcttaaaaaaaaatacatatatatattatatatatttcttagtaaacttcattttaatgggtctcaaaattctgtgacagatttttggtcaagttgtttccattaaaaagtactaattttaaaaactaatgacttaaaatggccacacacatataaaaaaaaagaaagaaaaagaaaaaagaaaacaacaacaaaaaccaaagtggtccacaaaacattctcctttccttctgaaggttttatgatgcattgttatcattaaccagtcatttactattaaacttaaatggccaattgaaacaaacagttctgagactgttcttccaccactgattaagacttgggtgacaggtattagggataatgttcatttagccttctgagctttctgggtagacttggtgaccttgccagctccagcagccttcttgtccattgcttcgatgacacccacagcaactgtctgtctcatatcacaaacagcaaagcgactcagaggtgggtagactgagaagctctcaacacacatgggcttgccaggaaccatatcaacgatggcagcatcaccagacttcaagaaagtagggccatcttccagctttttaccagaagtgctaccagtctttttcttcagcttagcaaacttgcatgcaatgtgagccatgtggcaatccagtacgggagcacagccagcactgatttggcctggatggttcaggataatcactgagcagtgaagccagctgcttccattggtgggtcgtttttgctgtcaccagcaacgttgccatgatgaacctccttgacagacacattcttgacatcgaagtccacattgtccccaggaagagcttca

SEQ ID NO: 69157 - DNA, 1121 bp, Homo sapiens
agtaagggactttagtaagctgttactaatgttggattcttggctttttttttttttaatagcagggaaagtgaaagtagggccatattatgcttattattttttttaaagctcttcaagtgtagctaggtttaactgaaagtgttgaatatcatcttaatacccatgttcattgcctcagtttgagattagaacaaaagcctttataactggcctttaaataaaagtggctaactatacctgatttaccctttgtttcagaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaagtaagtatcattccatcagagttttccaagagtagttactataccagaacatgaatttttcaaaagccctgattatagaaacactttaaacatacatgtaatttatttatctatttgtacttatatttactcatctcctgcttcaagtctgctgtcagtttaggcttaacacatgttggtaaatggaaagataaaaatagtggtatggagtgaaagatatataggtagtaaagcttcctttaaaaaacccattttaaaaaagattacacaaataatgcacaaaacagcccataaaaataaaaatcaaggccaggcgtggtggctcacacctgtaatcccagcactttgggaagctgaggtgggcggatcacgaggtcaggagtttgagaccagcctgaccaacatggtgaagccccatctctactaaaatacaaaaattagccaggtgtggtagcgcacgcctgtaatcccagctactcaggaggctgaggcaggagaatctcttgaacctgggaggcggaggtcacagtgagccgagatcgtgccatggcgctccaggcagggtaacagaacgagact

SEQ ID NO: 69158 - DNA, 1090 bp, Homo sapiens
attctttaggtgttgggaagaattgaaagtttgagtaaggaagtggtcagagcagaatttcaggaaaatcctctggtgctagtgatttttcttggtaatgttgggtaaagagactgagaaggaaaggagcagagttggggacaggaagatcaggagaactgctaggagcttctgtcactcgagctaaggagaagtcagaaggcctacactggaagagtgataacattagtaatatatgttcaagtttttaaaatagttctgttaatgcaatcctataataatgggtattaagcacacatttggtgaaataacattaactttagaatattcttaaaaaattgtattagtattctcatataaggggttgcttggcaactgccacttaaaaccttattttaaagtaatttttaaatgtaaaatttaactgagtttatatgatttattacttacaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaaggtaagaaaacttaattttaaaaggcatccagggaaatcttcattgtctctttctctacactgaggcaagaggggaaacttctttttcttttgtacctttttatgggatttttaaaagtgattaattattttctaaagtgataattagggccatttggcttatattttattttcagcttaatacatttttgtatttaaacaaaacaaaatatgtaaacatgattttaaaaatgcaggatatggtgtcctccagagaagaggggacaatctacattcataagagagattttttttaagcatctgctatatagagtagtatttagtcaggggaatttattgtttggaaattttgatgtatacacattataaatcacacacactgtattagtccattctcacactgctagtaaggacatacctgagactggttgatttatgaaggaaag

SEQ ID NO: 69159 - DNA, 2147 bp, Homo sapiens
tcaagtgacccaagtgatgaaagggtcatgagtaaatgttccttgaataaatagtgtatcatagcaacttgagaatgtagtggtggcttctacttttaaacattatttaaactggagcactaagaaagaaccaagaaggaagtgaatgtagctgattatatattcaagtaactcatttagccccttcccccaaaagaagaaagtgaaactgtttacatatggtccttgattctgccttactggaaagggtattatttgtgagcattcatatacctgaaaaccagcttgttgcttgtattaggttttgaatgttgtgcttctaattttatcttttacagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattat

SEQ ID NO: 69160 - DNA, 1050 bp, Homo sapiens
ttatagaggttgggttttcttatgtttgccataggatactgctaactgctaaacttgtaaattaaatctgtcatacttaggtacagactgacgtgggtgtggacactaagcatcaaacactacaaggagtagcatttcccatttctcgagaagcctttcaggctttggaaaaattgaataatagacagctcaactatgtgcagttggtaagagatgtataatgattattaagtggctgctctttttggtagtttatgactcatatagggtttattattaatggattttacattttaaatagctttctgatttctaaaattcattttgtaaatgttcattgtgaaaaagtcaaaccatccagaactaagttcctcctttatctcttggtctttttattatatgttttaacttaatttccttatatctggttttaatgaacatattttgtttcttattggcaggaaatagatataaaaaatgaaattataattttggccaacacaacaaatacagaactgaaagatttgccaaagaggattcccaaggattcagctcgttaccatttctttctgtataaacattcccatgaaggagactatttagagtccataggtatatgatacattgtttttaacacattactttcagtttgtttattggtgtatcagccctatattcttacttatttcttgcccagagggcttagctgtagttttatgaagtttctgtacttgtttttatgaagtttatatatgtagttttatgaagtttatgtattgatatgctaattatatttgttattatttgaacttacagtttttatttattcaatgcctggatacacatgcagtataagagagcggatgctgtattctagctgcaagagccgtctgctagaaattgtagaaagacaactacaaatggatgtaattagaaaggtagcccacctattttaaaatcttcagtttttgctaaatttttcttttcatttctatgtagtttatgatgtactgtgatttataaatgaaaatatttatttttcttgttatc

SEQ ID NO: 69161 - DNA, 1327 bp, Homo sapiens
gagtttacataaactgcatgataccatcttactctgtatctttcctttttctgaaaatgttccatttgcaattagttttgatagctcaataattcattttaaatctgaacagaatgttatatgactatgccacacattatttttgcattgtcttattgatgaacattgaggctataacttcactgttactgtatagtgctgcagtgaacacctttgtatttatgtataagagattctgtatgcatagtagattaacagttttacttgattctgctgaataccatttcaaagtggctataccagtgtatacatctaggcaaatgtttaaatctgtagcattatggccaaataaaaaggagttaaacatggttttatttaatatttcttactgtacaattcattgttaatgtcagaaattatacttttgaatggtagtttaaatatattttgttgataacttaagctcagacattttggaaaatagaaatgtaatgactgttataggtcattacattatttgaccattcagttcaactgttatgatcatttttatatgtttctttcttaggctgtgtatattttaaacattttaaccatgttcataaaaagttaacagtttttataatactctatgtcataattactttctatgttaccacatttttcttttcaactttttgatgtgaataatagtaactgggaaatgactatatatttatttttctagtcttcatcacactaccacttgatatctcaaaccatttacctatctttctaaaaataatttttcatagagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgtaagtaacttttttatagtttgtttaacattaaatgctagaaaaatgtttttgaaatttctaggtcaaataaaggttaaaaaacaataattatttcccatagaagggaatgatcatgaggaaaatccttggattgataacggagaatcaggaataatgtgcttagattcgggagttttgcccttgaaatcaaaataattattactgatttaagatttaaaaatttgtggcaatggcaattttttctttcttttttaaggcagaatctcactctgtcacccagaccagcttgctgtggtgcagtttcggctcactgcaacctctgcctcccaggctcaagtgattttcccacct

SEQ ID NO: 69162 - DNA, 1053 bp, Homo sapiens
ttaatatgaagcaagttcaaatcttacggtaacttggattcctcatattttgtgcaggtccctatgggcccctaatttcattctgaattatgtgactatcagggaaacagaaagatgttttttgatgtgacttcttcctcttttactttttgtgtctcagtttctgcaccacagtccatttctaatgtcagtgcttccatctctggaatggaaatcactaaacaggtgattatcaaaaaaaaaaaatagttacttgtgaattattcaattaagtttgtttttaaatataaacaaaggatatcaaactcccattttctccatttgattgcaacctttgccacagaaatgatcatttccctttcttgttttgggaaagttctgagaatataacaaactacaaattgattctttaaaaataattctgtaaacagggaatctggttgagtgggagaatcttttaaatcaggcagatttgaatttgaacaattattgttataggtactcagtcataaatgaatatattaaaatattccagtggcctaatttcttaaatatctgaaaatattttgctttggaaaagtaacttgttctttcacaaactggaagtaaatctaatttgttttctattttctgcttatataaaaaataccagaatagtttgtaaaatatgcatttgtttacatacaacattcaataggaatatatgtatattgtaaaacagcatattttaaaaatactgagctaaaatttttaatgccatcacttcctaagtgactagttaaggaactaaaatggaaaagttaatctaactagcatctctacggaaggaaaatggcactacttcctaagttattattttctggttttacttttttgttttgtgaaaatttttaaataaggaaaattccaaagactaaaattgtatcataaatacctatatctcccctttattaataactgctaacattttatcttatttacttcaagcattttagaaaattcagtgtttttctggtataagagcatcccctttaaacaattttgcttctgacc

SEQ ID NO: 69163 - DNA, 1046 bp, Homo sapiens
agtcagaccttatggttgtcttcccttgttccataaaaatcactattattctgttctttttcaaggtgcactaatttcatattgttcaaacacacatgtttcacaatcaatttgtacagttaacgcaatgatcacagtggtcctgaggtgacatacatcctcagcttacgaagataacaggattaagagattaaagacgggcataagaattataaaagtattatttgagaactgataaatgtccatattaagatgaaatctttacaatttatgttcctctgccgcagctttagcccgtccctctgttcggagtccctgacttcctgtaacagtctgggaggagtgggcaggggcctaaagatttggatgaaactcaacagctgagatgggagtaagaaaggggaaaggatttgtgggtgtggtcacatgacatgttgtaacagaagtaaaccattctttagtagtgattcccaagtagggtgtggtctttagagagtgagtcctaaagtggagtggagagatggctcattgacacagagaatatttaggaactcagttggatcatccaccaaacattaaacaagcatcatgtcctacatagtaattatatggatagaagaggataagggtggatagcgaatgggagtgggtcattttccaaaaatggatggagagtgctggggagacaaaacagtagatacctgttacaagcaatggctggatgtatttggatcccattcaagaaattttctcagcataggaagctaaggcaaatttagaccaaaatatccagtttggagaaaagtcatctgtctatattgaagattgattgagaatcacaccattaagctaatggtattaattataaacaggacatttggttttgtaattgcaacattttgttaaattattctgttgcaaacttttatctcttatactaaaatcacatttcagttatggcttagattttaattctcctggtggtataagtaatcagccctgaaaaagcactttcgatttcaagtgatttattgagtacaaattat

SEQ ID NO: 69164 - DNA, 1470 bp, Homo sapiens
tgagtgggatgagagcttgggcttttatacagttgagagttgagatcagtcagctgacaatcttcccagcagcttggaaaatcagtcatttggtcttaaaaggggtatttgggaagtgccacccagtattcatgacatgttctataatatgtaactcataaaaaggagagaagtgacatttaatgtaggaatatagatttatttttagtgttctctttttgaagcagttataaaataaatagaaatttaatttttggtattttcctttcaaatgttaacaattctttttgcaacttctgggttaggttgacatcgtactttggtctggactgtaagaccgttagtgaaaatctgtcaataaatctcaccccatgcagtgtaaaagtaccttttctctcttcattcaaatgagaatcgtttagatgtcctgtcattctagatgggttttgaagacaaaagtagcatctttctttttcatcagattttagggctagagaaagaatttatccaagggatattttctcttcttttttgtttttttttgtttttgtttttgagacggagttttgctcgtcacccaggctggagtgtagtggtgcaatctcggctcactgcaacctccgcctcctgggttcaagggattctcctgtctcagcctcccgagtaactgggattacaggcatccgccaccacacccggctagtttttgtattttcagtagagacggggtttcaccatcttggccaggctggtcttgaactcctgacctcgtgatccaccagcctcagcctcccaaagtgctgggattacaggtgtgagccactgcgcccagccccaagggatattttcttatgaatacttttaaagaagacattgatttgtctcagttcacttagatgtcatgttatatatattctaaaagtattttaaaaattcatctgacttttttttttctaaagaggaaatctcggcagaaaaacagtacttatttttgttactttcttattgattcctaatgatttccccagaggtggtcatgcatgtggagggccatcctcctccacacccactagcttcttactttactgacagatatgatacaatcatctttgatgtgtctcaattctattcctccacatttcaggatttatctacttttaaaataatggcccttccttttcccttaccatttgacgagtatttgttgagtgcataccatgtgttaggtattcttcaaggtgcatggaatatgccagtgaacaaaacacacagaagtacctgtcctcattgagcttacagtcttaacttttccagattctgtttctgttcttaaggcatcttctaacatttcttttgggaaatacctcttgaatttttttttttttttttttttttgagatggagtctcaccctgtcacccaggctggagtgcagtggcgtgatctcagctcactgcaagctccgcctccc

SEQ ID NO: 69165 - DNA, 1024 bp, Homo sapiens
gacatttgggaagacgcaacatttgagttcagtctatagcaccttgtacagggtaggcaaccccatgtttttgaacattggattcattgtaacagtcacttctaggttgcctgaaataaacacatttttttttttgtggtccacacttcctatacatgcttttgacattttttctcaggccatggcctttgctggaggctttgttggccatggttatagcatgtgactcctccctcactacagttgactggataggaatgtgcacataatccaaggctggtgaactcaattgctgacccacagcttatcattttatcatattttctaatcagtttgcattaatatgaggaggtttcagtttatggtgggtgtttgccctataatttaatatatttttgtgtcaggcaaccgtattggtctgtgtgcaagaagaggaagctgctcaagagaacaaatagagaagatgagattcatcatataaacttcgagagaatgactagacctagttgcctgagtcaagtgcctataagacaactttttctttctctgtgagattgcctctctgattattaagtaaattctccctcacttgaactatattgagtgttcttttgcaaccccaaatgctttgaataaaacattgccacattcagtcttctcagtctacattttcctcagtctctcaccatattcttaaacttctgccgagagctgctttcttgaaatgtttccttggacttttgtggtactgaattatttcaattcttttcttacctatcagttccatctatactttccttttgtaaccattctttttttttttttttttgagacagagtctcacattgtcacctgggctggggtacaatggcatgatcttggctcactgcaacttccgcctcctgggttcaagtgattctcctgcctcagtctcctgagtagctgggactacaggcatgcaccaccatggcccagctaatttttgtatttttagtagagatggggtttcaccatgttggccagg

SEQ ID NO: 69166 - DNA, 1062 bp, Homo sapiens
atttacttggctctttctgcaaaacttctctagtcatcagaccatagaaagagggcttgattaaattgaatcaagtaactttttctatacccttcagtgatttgactttaagccacagttggaagagaacagtttcctgcctttgtcaggttctggaaagatttatttgtttcactacctatttcttcacttgacacagagtagtggcacgttattgttttttcttggagactgcagtgtctagagaaactctaattgtacttctctagttgaatcccaatattaaagtcttttaagtattttataaaggcttttaagtattataaaggctttagcattttaaaatctgactttattcagaaaacttttccttttataggagaatattaatattatttatttaaaatgaagggatatatagctgggaattatcctttagaaagtatgttttgtaaaggacttgttctatttctgagttcttgtttctttcacatgttttaagaaagtgctgaatgattgattaaataaactttagatcggttaacacctgatagtgagaagactgctccttggaatttctgttttaatttctctttatcctcttgtctaataactatgataggcaaaatttatgatctgtctctctatctcaacttaccttgttccagatgtacatttttgatgtctgttattccagttatcatgtatttaatataatttcctcatttgctacaacatggaaataggcttttttactaaaaattataaagtaattatgtcttctatgtttatattcttaataatattgacatatctgttaataatatgtaatgctaatgaataatttagtttccttagtgatagtttccatgatgttataactaacatccctacctatgaaaatgtagggagctgtctgaagcccaggaaggtcaggaaggtgttaagaaccaggacaatgtatttaacctatcacaatcaaaatgccattcagcctttgccctcaatatttgacagcaaatgaatttgtcattttctcacaaatatcctgccttgagctac

SEQ ID NO: 69167 - DNA, 1044 bp, Homo sapiens
ttaaagaaatatcaatgaaatgggagcatttccaatagaaatttgagctgaaataagttcctgtgtgatggctttatttgcaacttctctctttgagatttttttttgtacttacctaacatgcataaagattgcatattaataaactaggaatcatttgatagaaaacaatgggagggaaatgtccataagttcctacatatctctacatgcaaagaggtcaaacggttgcttgaaattctcaagaatgttttatagattgaatagagattttttttaaagccgttatcttctgtgctcaccaagtaaagtgtgggctagaaagttattttaaagtcattttattgcaagaaaaacagcaggatcctgccaaagcccaaaagccagtaaaattgcaatgaaacattgaaaattacaaggtcaaagctttatattcatatgaaagtaatatttgaaccaaaaaaggtgatatacttttaaaaaaatttggcctattccaaagaaacactgaaaaacaaaatagctgggttatttatcattgtatattttgattgttaccccaaatttaagaaattattagtgaagagcataactttttacatattaattatgatagttattcatttaaaaagtgcttgcaaaaaataattgtggatgattatttcttactgattttattttcaaatgtttgtgtatggaacattgttttggaaggaaagatttagcagcatcactcagcttataattagtgtcagatatgttaataaaaactaatcaagatgttggtaagcaaatgctagaaactgaaaatgaaggtgattaaaagaaagtaatttctgaaacaagctaggattaactgaggatggaatcccaacaggatttctgcttttgttcattggccttgcccgtcactgctaacataatatgtcatgctgaaagaacaaaccttcactgaggggtccagaggacatacttcaagttgaaagttctatgtttgttggttcaacaatgctgagttaattacattttataattctgctatac

SEQ ID NO: 69168 - DNA, 1033 bp, Homo sapiens
tgaagaaaatgactatgaagttattctgttcagttgtcttaacaaagatgaatgtgttttaattaatttttttgtgtaaatgtaaattgttaatgttaaaatgatagaggttaaaaaaatcaactgattacagaaatttttgaaaatacagaaaaatataaagaagaaataaaaatcatctacagttaatgtacttagaagtactcatgattaagtttttgatataaagtatttttcttttccttttgcattctcttttaaatgatagtataactggatataggattagaatttgactattattttccatcagcactttgaagacattactttgttgtcctatggcatctattattgctgatgtctttatgatttttttccttccattactgcttttaagatctccttgtatttgaagttctgcacttcactacagtacatctaaatgtggatttcttttcatttgtcttccttagaacttcgtggtattcctaaattttagaatcaatatctttcagactattggaaaattctcaaccattatctctttaactattacctctcacttctgtaacatcctttctggaatttcaatgagacataaattgaaccatctcatcctattctcagtttctcttaatcattctgtcttatccttcacctttctatttctctgtgcatattgatgttatccacaggtgttttccagttcactaattctcttttcagaactccaaactgaacttctgctgtttaacctaccaattagattttaaatttaaggctatatttttttatttccataagttttattttattcttttttaagtcatattttctcccttctatacagttatgggctaaagggctaaatcatgtccccatctcccaaattctttcgttgaagccccagcccccagtatctcagaatgtgattatatttggctacagggtctttaaagagatgattaaggtaaaatgaggtcatatggataggccccaatccaatatgacttgtgtctttataagaaga

SEQ ID NO: 69169 - DNA, 1091 bp, Homo sapiens
atcaacacctgacggatcctgtgacaatattcctcctgtgtagaaaacatatttatatctggtggccattttcttttctactgaatcctttttttcttattaacactttaggagttgtttaaatgctttgaatattaatctttttttcagtatgtgttgtgaatgttttctgcaaattgtggccatttcaaacacatgtaaaagtagatagaatagtggtacccactgctcagctacaacagtatccatttcatcaattcatggttactcttatttcatcaaacaggtactcacaattcaccacctccctgccaagcaaatgccagacatcatataattttactgtggcttgtttttcatttcttcagtgtttcttttgataaacaaaagtttgtaattttaatgcagttgaattcctaagtttctttcctctatggattgtgtgtttcttatttaagaaattcttctgcaaaagattgtggagatatttcctaagtttttgtctaactgttttaaagctttacctagacactagttataatagcctttccccattctttcacagatttcttatgctatctctggcatatcaattttacaaatctgtgagatctgtttctgggctctgtactcctgctaataccatattttattaatcactatacccttatagtaaattaatactatatattattgtatctatagtattcttatatattattgtatatataactatattaataattattagggcaggagttcccaactttgctcttcagaaactttgacaattcttgggcttttgttctttcatgtaaattttggaattagatgatgaagttctaccaaaaacttttgagattttgactggcaatccatgtatagataaatttgtgataaagttacagattttatgaaatgcaaaagtataacacattcacagattaaaattccccaaatttgaaatattttggggttttaatctgtgaatgcgttatacttttcaatttatttagctttattcctctttttatttaggtttttaattggctttttccttctcaatgaaatctttaccatccagactattt

SEQ ID NO: 69170 - DNA, 1034 bp, Homo sapiens
ctcaactgttcatttagccttactcatggacagtgatggttgaagtccagcttcctgtttgatcttttaattcctagccttgtgtctctggtcatgaattccactcacctacccctcccttcaggtccccacagtccagggacttagtcttggactgctgggacctaaagggtctttgaatccaggcctttgcagtcttctcatcacctttgcatcctcttagtgaatgcaggaacttctgggtcatctgcaggactttgtggcattggcagagagaaaaggagggcatccagagctttctcagtctcctgtgcctacctatatccatttacaaatgccctagactgtgataatcattcttttataggaaagacctgccatctcccttgggctacagtcagagaagccctgatgcaccttgagtgccttcatgtgaatcttgtcacttctacatatcaccactccctccttaaagtagatgctggtggtataggggaataagatccttgctgtctggctttctcactcttctatccctcttttgctgcctctaggtggaagggaagatttcctccattttcatgggcaggagtttcttttacattgtgtccatcctgcctattctctccacctctgtggtcaggtcagtcaggcctcttgatatagtagctctgagatgttagaaattaggaactaccaaggaataatgtattggcttaatagttccaaaacagaatccccattacatctctatagcaagtagtgctataatgccacaaactaggctttctagcaatataaatctttccagaatgctacattctctaaatcacatgttttggtggttatagatccaggaaggtgttgaaactatttaatagtaagtgtgaaccctgataaaaaagtcataaaccaagaattcaaaaacttttcctttttttttttttttagtgctagtcttcttcttttaacttttattttaagttgaggggtacaagtgcaggtttgttacataggtaaatttgtgtcatggg

SEQ ID NO: 69171 - DNA, 1033 bp, Homo sapiens
agctattagaaataatgtcttcaggatcattcttgcatacatgtctcttggatgatgggtatccccataactctagaatatgtatattcaggagtaaaggagagatacatattttcaccttcactagataatctctacagctttctggaatatcactttacacccccacaattagtgtatgaaagttatctttgttctacccgtttccttcacctaatgtttatagacttacattttagccaatccggtggttgttcagtaacatctcattatggcttcaatttgtattcccctgattattgtattgaccattaaaaatctttgtttctgaagtgcctgttcaagtttcttgcccatgtttccattggtttatatgtattttcataatagaagagtttttaaatattttctgcatgctaattccttgtcagttgtatatggtgctcatttggtacctggtctttttactcttcttatgggttaaagcataaactttgatgcaaaattgtctgattcaaataatggctctatctcccttaacaatttgaactttggtaagtcattaaacttctccatgcctcttctgtaaaaatgagaatagtagtagtcctacctcacatggttgttgcttaacctatataaagcagtaaaaagagtgcctgaaacctaggaagtattatgtaaataaacatttgctgttctttatttttattttttgatcatgatttcttaattataatatagtcaactttttaaactttagtaacttttagtgttttattaagaacaaaaaggttctaaagttattaagatattctttgtattattttccaagcttactgctttgctttttaagtctacaatccaactggtgttaagtggttgcagcagaagtaaacttttattttttcttatatagataaaccattgtcccacaaccatttatggaaaagtttattttttttccactggtctgcagtgctacctttgccatataatgtacatttatttgtgggtctattttttaattggc

SEQ ID NO: 69172 - DNA, 1063 bp, Homo sapiens
tttaaaaattaattagtgtgagctatgtctattagctagacctgttttttttcctttgagaagttctttttaaatacatgaaaagtttgtgtgtgtgtgtgtgtatgtgtgtgtgtgtgtgtgtgtgtgtaatagatcctgactagcaatcttctaaggctgtggtggttaaatttagctaagagaaattgcatttagatattaggtagcattttaatatgcctggatgggttttgaaggcattattctttctcgtgaaattttgggaaaagaggtagatacagccttccttgaacaattatttataaatttgaagacaagtagctggacaagattttctttcaatgctaatttttattttctaattcaatgatcattttcctgtgaatacatgtttttgcttaagccgaggtttattttccagtttgtataggtaatccttcttagttgatcttaattatagctgtcaagagctaaacatttcttttctacatctggactaggaaatgtttccaatgaacaatcattttaggatcccaagtatcctaaatttctaaagctgtattagttttctattactgcataacaaattacaagaattttgatatcttaaaaaaaaagacccatttattatttcacagttctgtaggtcaaaagtttgttgagacatggctgggtcttctgctttggcttcagtaaaattgtctgctgactattttaatacatttttatcttgagcttggggctctttacaaactcttttctattgttggctgaactcagttccttgcacttatagaactgaagtccccattttcttattgtctgtctcgtagggctgctgtcagctcccagagtcactctcaaatttaagccacatgatttccccccatttcagcaacagagaacttccctcccatgctgcatctactgccactagccagacaaaactctgagcttttttttttttttttttttttgacagagtcccactctgtcaccaaggctagagtgcagtggtgtgatctcggctcactgcaacctccaccttccgggttcaagc

SEQ ID NO: 69173 - DNA, 1035 bp, Homo sapiens
gttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataacacatgtgagtctgagtatcttgtttaatatgttcctcttttccacagatgattctataaaaattgcattctagttctgctgatgataaactcctgctatgttatttctaaattgaaagttgctatttccaaatttccaaattgaaaatgatatgcctaagtaagggatgtgatggataacttagttcttcctctctagatcctcaatttcaccctttctaccctgctgtgcatcctggggtggctgacctatacagaccctaatagtgggttccttttcctcttgattcttgtctggtttcaattatactgcagcaggaaacacagctggcatattaggaagaggtcaagtttggatatttattccgctggctcccttcctgcctggccaccgccatgatttggtgtgtcaccttactgaaggttatatctcttgaaaggtactcctctctgtctcactgcctcaccaggttctgataacttctactg

SEQ ID NO: 69174 - DNA, 1041 bp, Homo sapiens
ttttaatcagaggtgttgatgtattctttttgtttaaaaatacatataattaaacaggtatataaaagtgtgtaaaattaacacattctcttcacctattgtactccatctaatatgatagtcttttggcaaaaacatttaaagtagaatgaggaagtatcattttactatcatgttatttttgtcttagtgtatgctttcagactggcactcctgccttcattcccctccaaccctagcagaactcaagtgtggcatagtgagtgttccacttacttacttgctgttataaacagactattcattcgtctattcattcagcatgtgtttatgaatctctaaccatgtgtctagttcttttctaagtgttagagatatggtgtaaaatataacaatttatggccatttgaaatttactcttagagataaacattaaattaatatttataaaaactattttcaaactactgtgatatgaaggaaattttggaggtgaaggaaatgcattatatcttggttatggtagtggctaaggtcaaaagccatgaaattattagtgattttcttcctatataaattttacctcaataaagtttatttaaaaaaagataaagtaataaaacatttaggaataagttcaggcaaaatatgcacaatacatacattcagaaatctgtaaaatattagagaaataggaaatatatcatatgtattgattaaaaggtacaataatataaagatttcaattctcccaaagtcgatatatagaatcaatgaaggcatcccccccgccaatttcttgtgtttgttttgttttgttttgttctgttttgttgtgttgtgttgctgagaagtccaccaactaataaatctgaaatttatttggaaggacaaaaagcccaaattaaaaatgcttttgaacaggggagaaaaacaggtaggaatttctcctgaattaaaattatattaattaagtcagtgtaatatttgtgcaagtttaggcaaaaagaaaaagcatagttatagatgctattacaagga

SEQ ID NO: 69175 - DNA, 1006 bp, Homo sapiens
aaagaaggagtttcgccatgttggccagggtggtctcgaactcctgacctcagatgatccgcctccctcagcctcccaaagttctgggattacaggtgtgagccactgcgcccagcctcttattttattagtggacatttcagttgttttcaatcttttactatttcaaatggtttcaatgcaaatcctcatatgtatattttttgtgcaaatgtgtaagcgtttctgtaaaactatttcctagaagtaaaattgcaaagttaaattgtatgaacattggatactgccaagcccttcataaaggatgtatgcaagttatattcccacaaactgtctatgagaatgataggaatattttcaatttttcaagtatgttttaataaaaattaatttaatgaaagcaaataaaattgtgctggatttcaagactgtttggacaaagtcacaaaggcctatcaagctggatcagaggacataataatggtcattagaaagtacaatgtgatgatcatggaactcattttgctccacaagcaatagcactgtgatgactaactcccatggcaggtatatccattgtctatattgttagggaaatttaccagagagctaatggattctggctgccttgttaacgtgatccagtctgtcatctgccttcacctaactgcttcgtaactgaagtaacagcagttgtccacagaatttatagcaacatggattttcagtaaggcagaggaaaaataaacctggaaacaagttgcctactgagataattagaaaagaaaccatgaataaatgaattctaagaatgagatatttggggactagaaatggaatcagtaaaacatgaattaaataatctcttttccctaaccttgccaaacagaacaactgcataaataaggctcaggtatataatataggaatgccacttaacccactacttttcttatgaaacagaaagagctggttgtaaaccatgatagatttgttggcacaaaga

SEQ ID NO: 69176 - DNA, 1041 bp, Homo sapiens
caagaaatagagatataagaaggcaagtagtggaaagagaagggaaagtaaagaaagttggcatcagaatcaatccccatttgttgtcattcagttgcttcttgttttattattatactttaagttctagggtacatgtgcaggatgtgcagttttgttacatgggtatacacgtgccatggtggtttgctgcactcatcaacccatcacctacgttagatatttctcctaatgctatccctcccctagcccccaccccctgacaagccctggtgtgtgatgttcccctccctgtgtccatgtgttctcattgttcaactctcactcatgagtgagaacatgcagtgtttggttttctgttcttgagttagtttgcagagaatgatggtttccagcttcatccagttgcttattaagctacacatcttctggtcttcgggtcacgtttctattcatgtctgagcaacagtctgattggaatcccagaggccaagggcataagtaaaaatggcaaacatcagaagaagggaagagttagcttgttggtgtgagaaaccaccagggaaagagaatgatgaattgacattaaagtatctcttaaactcccctgaaaacttttagtgattcctgggggcaagagctcccctctgtgaggcacagtgagagaagaattactgaagtttaaggaaccttatcaagtaaaagtgaatgattctgagtgagatttagaataaaatccattttaaattctttaaaaaaatatgatataaaagaagaggcactctaaccacattatcaaaagagaatatccttttgtattttagaaaagatgacttttggaataacaaaaaaaaagatttcactctatttctaaattgattcctgccactcgagcagaacaaaacacaggtgtaagttagccattacttgctacttaatatctatctatgtctagtgcatataaattatatacatacacacacatatatactatatattcacacacgtacccacatatatgcacacataaagaaatacagt

SEQ ID NO: 69177 - DNA, 1043 bp, Homo sapiens
ggtaggtagaataaaagccctccaaaaatgttcacatcctaatccccagatctgtgaataatatgctaccttacgtggcacaagggatttttcagatatgattaaggttaaggaccttgaaatgaggagcttatcctgggttatccaggtggtcccaatctaatcacatgagtccttagaagaaacttaagagggaaatgtgactatggaagactggtcagagacatgcaaccttactggatttgaaaatagataaggagtcatgagcaggaacatagacatcctctagcagctggaaaaggcaaggaaacagattcaccactagagcctccagggagaaacgcaggcctgtggacattgtgattttagcctggtagatgtatgttggacttctgacctatggaactttaaataaatatagttcaagttaccaggtttaatttgttatggcaacaatagaaaactaatgcactattactattagctaacactgttgacttgtccataactgtatttaaaaatgatttttagttcccatttttccctaatgattgaagaaaatacataattctggagcaagtttggtgtttgtagagagagttagagggatagtctgttgaggagaagaggattcagttcacatttatgcctaaattcctcactttaatgattgagttgctttttccatatttggtttttgctgtaaaaatgaggggtgctcaacatttttagaacattttcattgtctgtttccagtgaacacaaacacacaaacacaaaatcacacagaaatagactatacatttacccaacatataatatataaaataaatgtatagcacatgtctcatctgctctttttttaggagattctgaacttaataatgtggaggaagttcacagacagtaattttggaaactataaaaaatgtagatttacatggttattgggggtatcgttgttgtcacaatctccagaatgcaggattgttgagaatgaccttttaattcaggagtactctatgccagcaaggctatttctg

SEQ ID NO: 69178 - DNA, 1035 bp, Homo sapiens
gggtcaggaatctggttgtggaatagctgcattccaataggaactgacatcctgttacttttgctgtaaactattggttagaaacaaatcactaggtccagcccacactaaaccgaaggggattacacaaaggtatggctagcaggagatagatatcagaggggaccattttagagactgactaccacaaacgatgagtattatatgtagttaattaacccacttcagccaagtacagataaactgtatcaggttgaaggacaagagtagagagagttagagtagtaaaaatgtatggtgtaggaactgtgtgtgagtgattgtgaaaaacccataagctgtcacacatttcttttacttttctttacaccagagctttcatataggtacatggtaaggttattgtccaatttaatagatgggaatagtgtaaatcaatcattacagcacagtatggtacaatttgtagccaaaaaatgtgcagagagctgtggggagctcagagaaggcagtgagtcatctggctgaaacctgggtatggccacacatcaccaactaagtgacattgaaattgaggtttttaaggatgaacagacgtttcaagagagaaagaagtgagagaagacatttcaagaagcaggaagagtaggttgttgtataatagcaagtttagtgtgaatggaattgtaagagataaagccagaaagtcttacagaaaattctaagacacatttatggtttctgaaacatttctgacagtctatagacattctaattaagatgtgcaactttaagtgttaacgctttattttgtctttgttgtatgttatttttcttttttgccaaaaaattgtttgttaaattgatgagacttccaataatcaatgcaggcctagtattaaggtgatatagtattacattccaaagaaggcagaaggttttgttggtgttcttggaactccatgaaagcaaattttcagtgtggcttagtgagagctgattttagaatttttctcaaaaattcattaccattaa

SEQ ID NO: 69179 - DNA, 1077 bp, Homo sapiens
tgatatattttaatgatctttagaaaaatataaatctactgttaattagtcagctcatagcagagctgcaatgccagggaaatgtagggcagaatcacagagtgattacaatgtcacagtgacttagctgctgtgtcctgtatgctagtcctgggtagtgtaagtagtttaactctaccattctttcttcccaatcctagtacagtatttttaatgctttaattaaaaataatgcatgcatataataaatctgcaaaccatgcaaacagatataaaatgaaacataaacacctccctattctttctcctccaaacttctggtttttgtgtttccctccagatgacttttaatgtgtctactcacattgcctgtctaggctttttatatattgtaaatgatattaagcattttcctgaactttgtttttttgttaataacatatattggagatattttcatattaaataaaaatagttgcatattatcccactatatagtttattattttatttcttccctctctaaagatattttgattgtttctaactaatttatacatttgttatgagaaataatattgcaggaagccattaatgcataatcttggtgcagtcttatggcttttttctatagagtaagttgctaagggtggagttgctgggtcaaagactatgacacttttaatattgccagcttttgccaaattattctacaagaagatggtcccagatgttttcttcctttggcaagggagcaccaggtggaagtgctgagggaagcctgaaaacagcacgtctctccgggtttcagtaggtgtttagaaaaggcattggggggcttttgttctctttcccaggcaaccttgacaagaaaatggcaatttatgggagatcttttaatgagaaatagtcaatggaagcccaaacattcttattttaccacaaacaatgttgtctggtgcactcatataaaattgttgttaaattaattgctgctctgcatcttcaataaattccacagatggcataagaatgtattgacctccccttttgtctgatatgaaagtgggttttccg

SEQ ID NO: 69180 - DNA, 1856 bp, Homo sapiens
atgaattggttgtttttccttccttgttgatgccgagctcaatatttagacagagtaaatgcctaacaaatatggtttatgagatttgaaggtgtaaaatttcattttctgccaaattatggactttatttaatataaccaatcaatcagcaagtatttcctgcatgccatgttctcagtaggcatatattactgatgtattgattatgctcttgtgatttcttttattctaagattcggattatgaaattgacaaaaggtggccctttggccatgcatggaatttcgcattaccttggcaaggtctttgctaatagcatttggaaacttgttaagaagtcagttccgagtcttgctgcttcattgagatttcctttggctttagagagaaaaaaatatacagactgaagattttatagattctatttacagtgagttgagggtgctgcagatattttgtacggtatatacatatacactatacatagtcatagcaggaatagtaacaaattacaaaatccgtgagatgctctcaggtttcatatgaacctatcatataagtttctttgtgctatcagatatgttctaaatagatggaagagatttttggaccatcaaatttttcctgcagtaatgtaaccatcttcttctgtcttttagctttaaaataaagaaatctcaacatatactttcccagtgatttttgctcatttaatattgcttttccttgtgccagtttttctccttagtggattttgagatgcatgcaattcaataccttttgaaactcgtaaatttattattatctatacctaataaaaacaaatggaaatatattttaaagtcatatgttttaaaaataataatagcaactatagtatcactaaaatggttttgttgttgttgaaatttgatttatagttgttttggaaattcaagtaataagatgctaaattagattacaccttaataaatatggcttttgatctttgccaattaccataattttcaaaaaaggaatccaggcaattttctagtcatttctagctataatctgacttgcagccacaaaaatacacttattatgcttttaaaaattagaggagtgaatgtagacaataaaaagacctatgaaaggttataaagggttctactttctaaaatctaggaagtattccccaagataatgatcataataatgtttttttcctctctgtacatgagggatcaggaatgagagtatacagaagcaccattctaggactttctagcaatgttagcatgatttttagatctttgattttaacaattaatctggccaggttcccaaagtagataatttcctctgttggtttaatacaatttcttctgaagtgttaacagattttataatctcattaatccatagaagagaagtggataaaatcaaagcatgttttttttacaagttgttaagttgaaaataagcttagtagttatttgtaaaaaactttaaggttttaaagggaaaaaaaggtcgtacgtctcctcttatgccagtgttacgcagagtgaaataggcatttggtaatagaccatggactttagtaggcaaaggtaactgcattgaggaaatcgaggtggcactaatttgtcttcagtatgatggttggtgagcatctgtggactttgaagtgatggctgttggtgcccaaatagtgtggaataacacagtgtttaagagatgcacttagaaacaagatagactgaggtggaatttcattagttgttttactgtggtgaagttacttaatttctctaagctccagtaccctcaattataaaatgatcattgttatgacaattaagcgagttac

SEQ ID NO: 69181 - DNA, 1046 bp, Homo sapiens
acttgtcgcatattaagttatgatgcatataaagggagaatattctattgagaatgtttgaatcaccaaagaaactcttggtctttctacaagataagaaatcagttttatcccaacattctcaagttgtgaattgagcagcatgtatatatcttacatctttgatgttatctattatctaaatatatggatgcaaagaaggaatgcaaaatatttttcaataataggtaaaactgaagggtaaaattgagagttagaagcagggaagaataatttttataaattgttattacgtgttccataattgaacaaaaattatggatgagataatttatgatgttgacattgcacatctgtgagacatatcattgagttccttacagatctgatagaacgtttttactttttatcaaaagaagatgcatgcatgagaatagtggattcagcatccttttcaatttttgaaagataatataaacgtaatcatgactttacagaataaattgttgtagctggttaatgatgcaagattaaagatggagtttgaaaacacagcatcacttaccttgctttagataaaaatttaaaacaaatatcctgagcttgctgtcattttttttcttccatttctgtcaatttgcttaggtgagacaggtttctctattgttattgttaatagaacaaaacatagatgtatgttatcccctgagagtaacattgtcatcaagccaacctagataagttaacaagcaggaaaacaagctcaactattgatatacataatgttcattcaaagtgtgtgtaaagtaatttaatacagggacttgctatttgctttataactttttgttttttatgattatggatgactaaacttatgagcataattaacaattctccattttaatctcctaaatacaaactttcattgaacaatgtgtagaatttctctatttttttcctgttagatttgttctaagtagatgtgttgaaatgcagttttaggtctgttgagtttgtatgtctttttcgtttatttttctaga

SEQ ID NO: 69182 - DNA, 1048 bp, Homo sapiens
cgtgagccgccactcctggcccattaatagtcttttagcgtcagcatccactgctgtttggtgtgtgcagcctgtaaacctcagaacatccctggagccctttcctttcacggcctccagagggcagcctgccgcaacggtgctcccgatccccctagtggtcactaggaagctccaaccttcactcggagatcaacgttcccaggaacattctcaaagccccgcggatgttgcccagggaagcaagggtgtgtgacaccacctagagtcgccttcatagcttccctttaggtgctcctggggaatgtccattagcaccaccccaactcaagatgacttctcaaacctgccagttgtacagtgttggatactacagggtagattctgtcactaaatttcaggaagaatataacaggtatctagaggatgtggcagcaagtccaaactttatttttgtacgtccctcaaaatgcacagggtggcttatttaaattatctcccagaagcagctctggatgtcttatatttccccaaggtaaatatttaaataactcttgtaacaatcttaagttacgtgggatactgtatttgtaatttttctgggatctatttttttgttctatttatacggtatatttaaataacattggcaaaccctatgcagtctaatgcaggaatgctatcagcttttttcgtgatttaatataatcatgatgacatattacagcagttatttccttgttattcatatttttttattttattaattattattttttttgaaacggagtctcactctgtctcccaggctggagtgcagtggcgtgatatcagttcactgcagcctctgcctccagggttcaagtgattctcctgcctcagcctcccgagtagccgagattacaggcagccgccaccatgcctggctaatttttgtatttttagtagagatgaggtttcaccatgttggctagtctgctctcgaactcctgacctcgggtgatccacccacttcagcatcccaaagtgctgggattataggcatgag

SEQ ID NO: 69183 - DNA, 1056 bp, Homo sapiens
gcaattctccaaccttagcctcttgagtagctgggaccacaggccttgtgacaccatgcctggccaattttttttttttttttttttttggtagagacaaggtctcactgttgcccagactggtttcaaactcctgagcttaagtgattatcctacctcggcttcccaaagtgctgggattacaggtgtgagccaccatgcctggctgttcagtactttatgtcagtgttgcctcctagtttagaatgaactgatctggagaatcaaggatagtacatctcactatggatgtcttttccttgtttgtttaagttacagccagcagaaattatttccaaaggcgtgcttgtgtggcaacctgttggcattagagcatttttgcaataggccacttatttctaaagcagagccaacaaccaaccactgaagccacatccaggcagtagtagtgggaaatgtgtggtttgaagcccctgttgtgctggtggagatcacatattgttgcaagcccctgggagttaggttgtgtgctaccctgccaagtgtgcaaaagagtgtccttggctgcttttcgccccctcatcagcggattaaattcagcatctcttcttgttcatgtagaatgctataggaacagcttttgtagccagaatgcagaaatcagattagtatgctgctttattttgtttcttcaattctgttctctgtggtcaagctttgctgaaggaggaaaagtggttccaaaaaagactatcaggaactattcagactgttcagataatgaggttttgtttgtggatggttggttggttgctttgagttcctagtctgtttatggtagtttactgtctgatccccatcactaatggtcatgtatgtcattgaggggtagacagaggacatggtccattacctttgagagataatgatccagctattggctcccttttcaactgtcacatttttacatagacttatcttcccacacccacctctctttccttattacctacttcaggtttaatcacctataaatctgatactagccccagtctt

SEQ ID NO: 69184 - DNA, 1086 bp, Homo sapiens
attgtgatgaaactgttgtattttcacaagtcttccttagtcatattgtgctgtctgttctaagtagggctgtgaataagagtggggtacagtttcctgcaataagagatgggaggcttaacttcagcttggcacgtaagaaagatcaaatgtttactgcaatgtgggaaaaccacctcctgggcataatagaaatccaggcctggcagtaaacaattctattcaaaagcagcttctcagggctgaggaatgacctagttgagtggcatgacatctgagcagaactagcaaggaggcttggtggtatgccgccttttaactccagcacctgtggctcttgagcattctcctcattcttcagtatggaaaatggatattttctcagtcttgtgcaaaaacagcttcaagaaaagtcccctagtcaaaaattccagtatttggaagtgtaccaggagtccaaaaagttgagaactactcctggctttttccttccctccctcacactgacggcattcctgaactagcatgcctgtctgtctctacatttctgggtgactgcctcatcccaggtggccttcctccagctgtgagctgggtgtgttcccaggtatttaatccacccttggggcaagttcttccaggcagcctccagtgccccttccgggatcctggctggatcaggctgactgtccttggaagtgaaagaggctacatatgaaggggagaagggtcctctctgcctcaggagaaggaaattagttacaggtgcatgcataggcaaaatagccccaatcctgttgtgatataacagaatttagaagacatctggctcaaattttaattttcaaaaagtgataaattctgtgaagaggtaacctgtagagtttattgtcaaattaatggtagagctactgtatgtgccactgtcagttgttaattattattattatttttttaagttctagggtacatgtgcacaacatttaggtttgttacataggtatacatgtaccatgttggtttgctgcacctatcaactcatcatttacataaagtatttctcctgatgatatccctcctgcagcc

SEQ ID NO: 69185 - DNA, 1101 bp, Homo sapiens
tcttctaaagtattaaatgtgggaaatcatctgacatttctgtgtactaaaatataatttttagtattaataattgttaatataaatattggaggcataagacattttctatttttctgtcttaaaaaacaaaaaactgatttttttttttttttttgtggggagaccctcaatagactctctcctttccttgggttagtagtgtccatggctctttatagaaaatgtatttgcttgcctgaatctgctttttcactgttttacaggcatttttttttccatctatgtccggtagaaagcagtagaaaggggttattttctgatattagaatgcctgaattaaaatcattacttcactacttactggttgtacaaccttaactgttaaagctttctgagcctttgtttttctcattgtaaagttgaactgcaataatgcacttaaagggcttggtacagtgtgtggtgctagtagctgtttatagtagttaatggaaatcttatgatttcaagtaaaattattgtaatgtgtaaaataacttaattacaggcattcatgaatggtcccatggctgattactatgtctatagaatgaatctgttaattgtaattttgcgtagattctcttgggtaggattccacatgttagattgacattttagtcaaaaaaaaaaaaaaacccaagaacattattaagttgatggagatagcatatggtacattaatattactaataagcattacttatgttaccgaattagattctgaaaatatcaggagagaaattagcttaaagcactgaattgccaagtctgcctgagtgtaagtacatagtatgtctttaattgattttattcctctggtgactttattcagtttataccggggctcacttttcataatattataataggaatgaataaaaatgaatatattcatttaccttctatgataaatagttctgattagaatcattcataagccacagtttggagccaatgagtaaagactgaaacttggtgaaagtttatcttgcggtttttggttttcttgcacttcccagtgtaatcctttttgagttcttcaggatttttttaacc

SEQ ID NO: 69186 - DNA, 1063 bp, Homo sapiens
actgaggtggttcctggtcagtctactatcttagtcggctaggtctgccataacaatgtaccacagtctctacagcttaaacagaaattttctcatggttctggaggctgggagtctgggattagagtgctgccactgtggtcagtttatggtgagggcactcttcctggcttgcagatgaccactgtgtctctctgtttccacatgatggagagagagactgtgtgcatgactgtgtgaactcccctgtctcttatgagggaactaatccccttgtgagggccccaccctcttgacctcatctaatcccaatgaccttccaaaggccccatctctccataccattgtactgggggttagagcttcaacatatacatttggaaggacacagttcagttcatagcatctagttatagatataagcatgaacagatacaatatggatagtataaatatttgatttgctaatgtattgggaaattatgaattttataatctatattgtctcatttctatgagttttgtttcattcacttgaaaatcctgctaatatcaccacagataaaagactgacttggatataacaatgagttaatggaaggaaaaagtttcataaatagtactataaagttaatttcttttcctgacatgcatgtgtaacagtaatagcttcattttgtgtagctgtaacactttacagttaacaaagcacttgtgtctcacttgattcttacaagagtcatataaaaccacccattttatggataaggaaactgacatgcagagttagcctgtacttccattgccctgccccactactcagttaagctttctgccaagtagcacagctgaattttcttctgtgtgcataaggacaacagatgaggtagtaaagaaaatatattttataaaaagtagactttttttttttttttttttggtggggacagagttgctctctgtcgcccaggctggagtggagtggcatgatctcggttcattgcaacctccgcttcccaggttcaaacagttctcctgcctcagcctcctgagtagctaggat

SEQ ID NO: 69187 - DNA, 1054 bp, Homo sapiens
tgacagcacctaataatgtctgaagtctgtgggagtccagagcttgtttttctcatctctctccaagcccccgccactgatccagttgcagagaagagaaaatagaattcagaattcttaaatgtataaagttattcattgttttaaatagtttacaaaaggcatgttgatgccattaataacaatgaaatgtgaattcagggtctatggaagaagtacaggatttgaaatttttaaatatatctaaatctgcacatgactgtaaattagaagatacatgcaaacattaagaacctgggttcaaatgaacaacctcttacaacaaggatttaaggcctcaaaacatgaaaatgtgtaattgagttgttccaccgatgttacatgaatgtgcaggttactttgagtcagttattattttggttgtagatgatagccagtatcatagttcactatctgtaaaatgaggagtttaggcttagattacatccaaagttcttcccagcttgctgatgtcatgattgtgtattactaacccctataatgaggctagaagtgtttggtttacgctttaggtttgcaaaagctcctcagaactctccatgtaataattcaccattcatcaggaaagttcgccacggagtgtggtggctcatgcctgtaatcccagcactttgggaggccaaggtgggcggatcatgaggtcaagagatcgagaccatcctggccaacatggtgaaaccccgtctgtattaaaaatgcaaaaattagctgggcatggtggtgtgcgtctgtagtcccaactactcaggaggctgaggcagaagaatcgcttgaacccgggaggcggaggttgcagtgagccgagattgtgccactgcactccaacctagcaacagagcaagactccgtctcaaaaaaaaagttcgccattcttacgaatgaggaagtttgtggatgctggatggcacagagagaaggcagtagagaaagattatgaattgagttgcagggccaggggaagcttactccaggattctgaagcccagctttgtga

SEQ ID NO: 69188 - DNA, 1019 bp, Homo sapiens
tcagggtcctgagagctcatctcatccagtggttctcagccctggctgcagattagcatcatctggagagctcatgaaagaagcactgaggtcccaccacctgaaacgacctttcagaggaaggagccattctttttagaaggtgctcaggtgattttgatgcacagcaagagttaaggttaactgacatcttagccatcccatgttatagataaggaaaatgagagcaaaaatggtcaaatggcttgtacgaggtcaggtccttgttgttacagaggcaggtctgatgccgcctcctgctctgtctgcagcctaacaccatcccttatattggcctgttgtatttattgatgcctcctcatccttcaggtgatgttcctgcctccaggaggccttttctgactcctcatactcacctcccatccagcctgggtaagatccccttcctttgtatttgaacagcatccttccttctttttcccctccgactgtcagttccgggagaacaggcctgtctttcctgttatttctgtaacagtagtggggtttcagataatatttgttgaattgaagttctgtaactttttattcctcagtccacatggattgctgaaaataatccattcctatatgcatgcttcagaaaagaacttcagaaagcaaaagttattttttttttgagacagtctcactccgtcacccatgctggagtgcagtggtgcaatctcagctcactgcaacctctgcttcccaagtagctggaattacaggtgcatgccaccacacccagctaatttttgtatttttagtagagacagggttttgctatgttgacctggctggtcttgaactcctgacctcaagtgatccacccacctcggcctcccaaagtgtggggattacaggtgtgggccaccatgcccggctgcaaaagttatttcttacctgtctatggctcactgtactatgggccaggatcttaaaagcaagaaggacttcccaccctgccttccaggaga

SEQ ID NO: 69189 - DNA, 1040 bp, Homo sapiens
cctttcactatggcaagccccacccaattcatttttttaagttaaaaaaattattatatgtattttttagagatagggtcttgctctgttgcccaggctggagtaggtggcacaatcatagctcattccaccctcaaactcctagctcaagctatcctccccgctcaaaccaccctccacctcgtagctaagactatatgcatgcaccacacctggctaatttttaaatttttttgtagagacagggtctctctgtgttgcccaggctggtctggaactctaggccttaagtgatcctccccaccttagcccccagagtgctgggattacaggtgtgagccaccgtgcccaacccccaactccattttttaaaggaaaaaagtgtccttcagtttgttttcagtcgtgggagaaaggtgttctttaattcctaatccttttcaatttggggaaatttctttgacagttacttgccttccattttgtctaatccatgaatacgtctgttatttggatattggctatcctgaattggttctccaattttccatgtttcctatttttcacctctttttgcttaactttattgaacatttcctgaattttatctttcaagccttctgtatcattttaatttccaaaagctcttttttttattctttgactatttctctctttctccctctctccctttggtaacatcttgtccttatttcatggatgcacttttctcaatctctgatgatgcaagagttttttgttgtttgttttaagcgtctttttcatgtgatttctccctcttcaccaagttgctttgctgtttctctgttagatgccctctcagtgtctgggaagtcttgtcccttctaatttttgagtagctgtctagaaagatggctggaagttctgtagtagtggatggcatttggcaattatgcacttcactttagggtgacctgtttggctgtttgtttaggaaactctgttagtaattttaggccgtccctccacccacccctccaagttaatcagaccaagag

SEQ ID NO: 69190 - DNA, 1019 bp, Homo sapiens
tttttaattctgaaaaattctgaattctgaaacactaggttttggcatcacaggttttggataaggtcatgtgaacctatagcggctttttttttcctttcatttttatgttctcattccttctaggcagcaaaaactggttttgaaatcaggcctactctgataggttaagcatgaagttatgactcaaatgtacttggagctgaaagacaataggaatttaaaagtggtgtcttctttcatccccaggccatgtgcaatcactataatctgggaactgacaggtcagcgactagaaccaagtttcagctaagccacaaccagttgcaaacccaggataatgttgaactgagagcctgagggtcttaggagacctgaaccagttagactgtgaagcaatagtagtagtgttccaagatgttattggaacatatttctacaattaatactgtttgccatttatagaatatcagctgtctaaaccaggcttttaaaataccaaattggcaaaattaaataatattactcttcagctatctatttttaatggtaaatctaagtttttaaaagtctgtttattaaatgctaaaagttgcagaaatgaaaaagcagatccacaatttcatatgagatggcaagttgtccaaataccaaaacaattctgaaaaagaataaagtcagaggattcatgggttctgatttcaaaacttaatgacaaagctacagtgatcaaaatagtgtggtcttgggtacagatagatatatagactaatggaatagaatcaagagtccagaaataaacccacatgtcaatggcccaactggtttttgaaaagcgtgccagatacactcaatgaggaaagaagagtctcttcaacaaatggtgctgcagcaactggatttccacatgcgaaaagagcaacgttcaatcccacctcacatcacagacaaaaattaactcaaaatggattaacccacgtgcaagagctaaattcatgaagaaaacataagggaataac

SEQ ID NO: 69191 - DNA, 1009 bp, Homo sapiens
ttcattagaaacaagtaaccaacattgcccagaacgttgtagttattcgaaaatgattgctgaattaatgttatccctttctatgcttaaatttattttaatatttaaaaaggaaatgaaggacagggattgtcaagatagaagtcagaaggaaaaattggtgcctaatgaggcaaaggatgataaaacgtattaaaaattgaagtgaaaaattatgatagccaatatttatatagtacttaagagtcttcacgtcagtttcatatatatgtcagcttattctccacagtaaccttctgatgtaggcattataatctgcattttattgatgaggaaacagactaagcgttaagtgaggtgcctgagcctcagggctaaaccatgtagcgctcttatgattcaagtccattgtcctgtgtagcaatacatagccatcatgctcttgaaagctacgcttttggctttgtattttatgttttattactaacattctttgcattaataatgactgagtggctctattttaaaatctcgttgtaatatcacaaggcctatactctgcaagcctacaacctcttgctaatataggaagtagaatttctctcacctcattgttcaccaaaatatggcaaatcctgttaaactgaggccagagaaagagatgttggaaccccttagaacaattatgactaccagagaatgatgcaggagcagcggggcggggatagactcagctgaagtgatgtggggagtgagactgggcaggcccagcaatctggaaagcatgaagcgacgggaaatggtgggccctgtatgtggctgcttttactctcttttttatttgtttattttgttttgtttttgagacagagtcttactcggttgcccaggctggagtgcaggggtacaggggcccaatttcggctcactgcaacctctgcttcctgggtcaagcaattctcctgcctcagcctccagagtagctagcgttacaggcatgtaccactat

SEQ ID NO: 69192 - DNA, 1926 bp, Homo sapiens
aaagcagttagttcaaggaggatgtagtcaggaaaatggtggcatagccagatgttctggaactatgtgaatggtgactatcatttggggacatggatgaaaatagattaggtgcatgatgactctggggaagggaatcagttaaagtgaggctgggaactgaggaccagagactcagataaccttgtagagttccgtcttaaaagtagagacttcagaaataggccatgtgattgaaactgaggatggggaggcgtccacatggtgatggagcagataaatgttgttctgcatgtggttgcatgcaggatatcccacacttcccttagtttgcccaatcccaggtctggttaagagcaaaggagatctaaggggcagtcatggcgggcccattagaccccaggttgattccaagccccaaggagttgaaaaaaaaataactggaggtgcagggggagcagtaatggtcaaggctatttctagaaactctgactctgttgacattgacccaggaactcagatgggccagttgcctgagtacacatgagctgagggatggggtgtgggaaaggattctgatctagcagtagtgaatctgcttgcagcaagctggaagatactgccatggatagaaatcaggctgtggtcaacatgaaaacacaaggaaagagaaggccaaggaattacgttttatgatctgagactgacattttccagcctttctagaactcgaggttatatataaccctactgacttttgagaagctggaagattcttcttgcctctgatctcatgccaaccgaggatgtttttcattgcttagtctctacgaaatttggaataaataataagaaagaatttgggatggcaaaagagtattaggtttataataggataaatcagggaagatgatgagaaaccataggatttagaaaggctaaatagaaaaataggctcaggaagatgaagattaaaggagaacaaatatatgtcccattaattaagtgtcacagatacacagagaaggaagtctgaagagtaattatccccctgagattttgtgtaactgactccctttttgaaggaagatactactttatagaaaaatatttttgattccctgaaattcaatttttgattatcttcaaccatatgaaaacacatgtgatcccaaggaagagttaaaatattaatttactaaaatattcattcgatatctactattttaggtgaagaaacaggaaaaaaaaaatccctgcacttgtgaagctaacattttgatgggggagacataaaacacaaacgtcagataatcctgtagagaaaaagtagggattatttgtgtgtatgtgttgggggggtggtgacagttttaaatagggtgtttagggaatatctcactgagaagttccaagtgaaaaaacctcaaggtgctgctggagcaagttctttggaaatctggaggaagagcattcccagcagaaggagtagcataaacaggtttcgaggtaggtgagtttgttagatacatttaaggaaatggaagaccactgtggctggagtagaatgaaagatcgagagaataatagatatgaggacttcataggccattgtaaagactttggttttactctgagttgggaagtcatttgagggtgagcctttggagggtaaactggcagattttgagcagaggagcaacctgaactgccctgttttcataggatcccttgggctgtcctgagaatagattatggaggagcagagcaggggcagagagacctattagactttctcaggaatccaaatgagagatggtggtgggttggtcctgagtgttagttatggtgatagagagacatactcaaattctgaatacattctgagggtagaagcaatagaatttgttgacagatcaaatgtga

SEQ ID NO: 69193 - DNA, 1086 bp, Homo sapiens
cagtgttcattctacctggttttattccactatttccagaaatcctttgctgtaaaatgtctcatgaattcccaccccacaaagtatcacatttgaaattcagcaagctatttgttatctggggaatgtcaaaattaatttgacaaaaacatgggtgaggaaagcagggagccctggacattctgaacaaagatgtgatatcagtatttaccatggaactcatttgattataagtcatctagaagcataatcacaataatggccaggaaagccacagaagcaaaataattgagttaaagttgagagtttgctggcaaataacctcatcgtatcatgacctaaaaagcagcatggatgtaaaatgttgtaataaaaatttaaagagaaagacagaacttggtgggcatgtacacacaatgtgaattcacaagattcccagaaaattgaaaaggagagaccagtgggatttcagcttctgccatccctcctgtattttgaactcttaattaatttggaaggctgaagggctttggaaagatgatttgaaatctttttatttctgaggtcccattagttaactgtagttttccttattttaacaaataataataaaaagtacatctttactataagtctcaaatgtattcctcaagtatgtctctagtaagaaactataaatatgcttttacccagaaaactcttaatggcttcttcaaaaggaaaaagtgtttacagctccttctcccaagtcactctttgaaatgtagaataatgtgacctgacagattataataactaccaaacagcatctccattaattgtaatgggcaaaccaataatatggatctttatgatgttaacatgtattataatatatcaagtcaagaccatacttgtagctggaataaaatttgattgcaaatttgtgtgttttgtaaaatgcaggatgtgtggaaaaattgtagattttttcctgacttccttaaaataaaaacaaataatgaaaattttgacaggtcattcagtgatgctaatggtatcactaccatgtcatgtactttcatctaccttaagtgtttttaaaaa

SEQ ID NO: 69194 - DNA, 1044 bp, Homo sapiens
gcagatggtaatgcagttagaaaggcaaataacatctagtattattatgaaaatggttttgatcttgcaggttccccagaggtctgtggagcacacatccattggcacagagggtgatacgagaagagagaaagaaacatgaacccaagttggtaggaaggcttggaagttcttccaaggaagaactgagctggaccttaaaggagagttaagatttggataggtggttaggagagcaggagaggatttcaggacagagaaaccatgggagcaaaggagtagagagaggaaggaccatgacatagtcaaaagactaatgagaaagatagttgggttggaaggttgggaatggggagtaatggtttataaaatgtggcctataatcagattataaggcatttgaaaagtttggacttcctctagaggttgctgagagtaactaatggtttttgaccccttctgtgacttgctgagcatattggtttaggaacatctttctggtggcagtgtaaaaggtaagttggtgaacaggagaactggatgcaaggagaccagtgggttgttaattgtaacctcattagtagcggtcaagagcacagactagaacgatggcaatagatggaacagattgaaagctaaagtaactgcctcagaggtagaggcaatatgagaactaaagatgaaaaagtcaaaggtcacctatattttatattgcataaccccaactgcttgccaaggacattgtctattagggaaatgtaaaaaaaattgggtgcttttatatatggtcccacatatgactttatcctcccaaaaaatcagaatgcttccttttttccaatagcaggactatatcattgaacgtattttccttttgccctgctgccaagaggctttgtgccagttttcatgttaagatcacgacaactacaattgtctcaatggttagtacattttcttcctcctaccttctctggctctggttctgtttataattctttaatggtattgtatttattcttcttgacaccagatgtcttacgt

SEQ ID NO: 69195 - DNA, 1050 bp, Homo sapiens
gacattcattttttaaaattgtgttttggaaacatctgtgcatccctatttccacaccacaaagaacagccattcttgtaaactgctttttgagttaaaggaagaaaagtaatatctatataaaacatgaatcaactggtaggaatcgtcacaatcctttgctttgctgggcactaggtactctgatttgtttttcttcctctagctttgaatgaagttgcaaacgttgatttccagagcagtcgtctgagattatggcccaggggtacatgtgacataagcggttgactagggaattacagattatgacagcactcttgagtagctgaaaagctaaaaatagcccagggcagttctaagactggaaatggaaacctactgtaaaagatgagttcaccaaagaaattgtaccaggaaaaacccttagatgactttcaaacatgtgtcactatgggagtgacagattgtaacattaagggaagctgcagaagaattatctgagaacctagtaaagaacccaagacttcctactttggttatgcccccacttacaccttacttatcttcttcatctcagcttaagtctaaatagctatagcttaaaatttgagggactgctaacctgacacaggtgtctactaacttgacacagtcacatgtgacacaggtgacttagaaaaggtgggcaattcacagctatcgatttggtgactgatttggtatttgtgagtcgtgaccagttttgtggtctaagaaccaaacataggtaagctaaagatagttgaagtatataattaagaagaatcagaggatgagcagaggggaacatacagttacgaagtcaagctacatttgttgttccataaaactaaggatcttaaagtttgtggatagaatattgtgaaagttcactaaatcataaagaatctggttgtagcaatattattttggttccaactgattccagaatataagattggagctatttctttaaaagtttagaaatgtaatttaggacaactctcttgtctaagtggaaaacctacagat

SEQ ID NO: 69196 - DNA, 1044 bp, Homo sapiens
catttcctattttgtttttcatgaccacaaccccagattgtgctgggacaccatccactcccagcagctgctgccccttctgaagctgtcttattcagccacctgttcaaatggataccagggttcacagtggctgtaaatcacaccatttctgggtttggattgcttggtgcaagcaccatccagggatgcataggaacctctcataaccagtctctccataactcaggttgagtgcttacctttgaagagatatttggtgccctcccccacttagcagtcttctcttagcagacagaagtcccatactgaaccacatggaatcatataggcctagtctgtattgccctttaccccacttactcagttacctgtgtggttttcaggatttcatcagtaagaagacccaagacaatctactgaaaagtgtttaaataataagattgttcaaataagtgaaagatagtaataagcactccacaaaaaaaaagagtatttcatttgggcagtatccatagcaaagttagagctctctagttaaaaggtgtacatgaaaaaaacaaaatacatattttgactatcatattgggaaaagtagaaaacactgaagtcaaatgagggtggagcaaagcactcataccctctggtggatacgttgattttataaatattttggatgacagtttagcaaccagtgtatcaaaagcttttaaaaaggctgtgccacttaaaatctgcttctggaatttagtaattgaacatgtgcacagatacatatgtacaaagatgctcattgcagcagtgtttataaaggcagaaaattggagactacttctgtgctcatcagtggaggaactgttttactaaattatattgcagctattacacatgttgtaaagctttctataaagctagcaagtgtctataatagatgtttataaaacagtatgtataatatggtatcattttggttagtgtgtttgtgtgctcttgcatgcatgtatgtccatctaagcctgaaaggatgtactccaaaattttaag

SEQ ID NO: 69197 - DNA, 1601 bp, Homo sapiens
tctttgtaaagaactaaaatagaataaattagtacaacctttctggagggcagtacagcaatacatattaaagaacttaaaattgaatacactctttaacaattttacttttaggaccttatcctgaggaaacaataatggatgcacaagatttttcataatagcaaaaaggtagaaaccacctaaatatccagccatttgaaattggttaaataaataatggtacatctctctgagagaatattatcaagctcttaaaatgagattgaagggaagtatttctagtgttttctgcgtctatgatattcatatgtgctatacattctcatcagtgacctaccttataatagacatgaggcaaaagagaagagacaaaaagatatgttcacatccttcagagaaggaaaagatagatatccatcagatatcaaagaaggtagcctgaagatcaggatagccaagtggtgtagaagagtcaagggggagtctaggtgactctcatagtgttcctgtaaaatgacgtactggtgtcccactgcagggacgaagggtcattgggtgcatggtgtagaggcagagtgagtggggttgcctgttttgtcagatatttggtatttaaaacagagatgagcctctaagccctgcagaacagagagaatttctttttttttaaggaataagggaagtcgagcatgttaaaaggcagagagaaggtaatggtgatggctgacatatctacagcgcttatcatatgccaagcatcatgccgagtgctttatgcccatgatcatgcttaatccttaaaacaatcccaaaatgaagctgttttttccctctatcttttagatgaaactgctgatgattatagagttgattatttgcccaaacatcacagagctagtaaatggcagagtcaggatttccattttgactctgaatctagccactatgcccaggagtaacaggaaaaccaaaactgcaagagctacaggggctgtttgttggaacaaaatccgagaagagagagtcccttgaaggtgatgagttgtagcctcagtttagaaactccatcaagaaggtacatgtctgacttgcactattcagcatgttgcattcatagctgatacagctgatacaaccaagacagaaatattttgtgtttggtatgtttgacagaactgccctcgtgtggggctggctcattctgggctgtctaagcctcattccttttgtcatctggtaattcaaattctgaagcgtccaggaatcacttcatgctgtggatgcccctatgctctctatctggtgttggtgtacttcagaattaaactgcatctctctttctacaccatgtcctgtaatagccataagtaaaagtacatggaaaatttggggggctcagaaaatttggggggctgcagttgctgcactgcagccatttacactccttagttcattccggcttaacaggcagtcatcgatccactattcactcagtttattcattcatcagacatttattgtgtgcttactctgttataggcttgttttaagtgttaatgatatcaagattaaaagacaccactgaagtaagggcagta

SEQ ID NO: 69198 - DNA, 1050 bp, Homo sapiens
attacctacctcctagagttgttaagaggattaaattaatccattaaattaatccaaatgttagtccctagcatataataaatactattataagtgttagctgttttcataattactaacagatgttattatcaaccagaaaagattagttctttgtcagcaaaatacatgttagaccttctcatttatcattttctgcaacatagacttttcttcctcatttggaatacgattttcaaactgtcccctggaatatccctgggcttttaaaaaggcatctgtcagggttgttgtgacaatggcagtaccccagatggttgacatttttttaaggactacattctgagaccacagcaacccctcaaattcaagagtacttctctagccgagaacatctctcgtgaaatgaaatttttaaaatgtgaccactgtaaatgcagggacattataactaaagctgtttaaactctgtcattgaaataaattaaatactatattatattgcattattactttgttatattcactatcaatttatctgactgtgtaagaccaaagaaagtaaagactgagattggtaattgctactgtgtagtacatgtatttgtggatagagacgatattgaaatgtactgaataacataataaaactaggacactaaacagcagcttgatacacatggaaaagtagagaacagggagctgggtgaggtaaatactgatcctaagagacccaatgtagccatccagcctgagagtccatgtgttttacttttgtgccccactgaatttagctaattgcgaataacaggacatgaattttgaggccacttgcaaatagctgtcacgaatattaatttgggatgccagggttctctaacagttgacatttgcttttggccatgtcttttccactaaagcctcttctaattgcagtggtcctgtattcaggctaacaaatggtcccatgtggtatttgagagggaggtgtgtgaaggtcagggcctgtgccctgatttggctgggtggtaatctggttctagtgccaga

SEQ ID NO: 69199 - DNA, 1040 bp, Homo sapiens
cgagataaacctcagctttgtacgtctcttaacaggaaaaacaggaattctgaaacttaccctctgaccagggtgggatgatgataaaatgtaaatcatatatctaaaagttgcttagggatcattgtatttgtagatccatactgcttcctcaaatccattatgacagctcataagaggctgttattcaagcccaatggaggctttaaacacagtggaattctaggaactatacctgtttccttattgggatatgcagagtttcactggaaaatacactggttaatacagcaaagactttgctttgaaaagaatcaaatttcatctataagtatgtagtggatacattgaatgatgtatgatcatagatgattgttaaactaggcatcacctttgaaaagaacttcaagactgtagaatagacaaagcatttcatatttactgaatcctaataagtggaggatatgactcatttatatgtcatttatattttccagaaattgtgcatcttcgacagttttggaaccctggtctttgcagtatttatgggagtatggggtaagttttttttttttttttcatgcactcaatttgatagtattacacagttttatgtaggctatcaaagtaacccacttttaggatcttgtattgcccaggcttcaactcccctagaattccatttataactgagggcatttatcagttaacttttactatattaaaatctgcatcaaaatatagtggcttaaaacaacaaactttatttctcatgtttattatttctcatcattctctgggtcagctgagagttcttcaggcatgggttggctcagctgactctccagtaagctggcagctccactggggatagatgatcttgcaactagaaacccggtttggtctgtggggctcggctgggaaggcttctctgctccacatggtgtctcatcttcaagtaggctagcccaggagtcttggtttcagggttccaaagagaagagaggacaagcttcagtgcatatgcatttttaagccta

SEQ ID NO: 69200 - DNA, 1047 bp, Homo sapiens
ttacattggcattcagccatttagcatgttttggctggagaccaaactctgactaatatttgacccatagaagaataaagattgaatgtatgtattaagatcctctgtgctcctccattgtaatacacctttctccgccctccccttccgcccagtaagagcttaggtgctgaacacatgggtcagcattttaactattaaccgtactctcagcgttgaatcataatgtataacattctaacacatctactaaactgcatatactaatggatgctgatagccccaattaaagaagacatttgaaataaagcaaaaaatgttaattttgacactagaaagacaagcctcaaatttactagctaaccttcctttctctgatcattaactacaccatggttatagaactgacttacacattagctgctgattttatctgatttttgaatgcagaaagtatttcagcactgcctatagcatcgtatgtatatttttaaggatatgtatgataaactttaagtgctttgtgtggctttccttgttacttctgctttgagaactactgctgtgaaccactttacagaaagtttgaaattgcagaaccaaacaggctacagcctcttgtgaagttattcatatcaccaccattatgttcctgcagcatcttttttgtgcccagacgcatatggcacttatttttctgctccctagaaattatgaaagttgagagtagaaaaccttttgtaatcaatataatataaatcatatacgtaccttaaaaatgtccatcctttcaggacaaggcagcccacctgttcatactgattcatagagtcctaaacaccaacccatggttgaagtaaaggttctaaacacatcctgcccactcccttccttgttgcatcttgcctacttacacctgattctccctggatcagacttggctgcatgactgcaatgtttaattttcacctttgaggggtgagttctaaactaggcctacttatttccagaaaaccaccagtcatctggctcactaaggatctgggg

SEQ ID NO: 69201 - DNA, 1044 bp, Homo sapiens
tccaagcaccttgggaggccaaggtgggtggatcacctgaggtcaggagtcaagaccagcctggccaacatgatgaaaccccgtcactactgaaaatacaaaaattagccaggcaaggtgtcacacacctgtagtcccagctactcgggaggctgaggcacgagagtcacttgaacccaggagacggaggttgcagtgagtgaaaatcacaccactgcactcgactgggtaacagagcaagactccatctcaaaaaaaaaataaataaaatgtctaggaatacccttaacaaaaagataataggaactatcaaagaaaacataaaaactcttgaaagttgtaaaggatctgaatgaatgataattaaatgaatgattctagatagaaacacattttctgtaaaatatcagtacttactaagttagttttaggcttattgatggaatcatattagtgatgtaataatttagtgtgagttttaatggctcaagaagagccagattcaagaatagcacatgaagcctagaaatagcccctgatagcaataaaaatgtaatatgtcagaaaagaggcattataaatccatcagacaagtggagattattcaataaatagtaatggaatacttgttagctatttggggggacaataaatgttaaagtcttactttaaaccatatactataataaatttcaaaaacattaaaaaaaaaattaaaggccaggcatggtggctcacgcctgtaatcccagcactttgggaggccaaggcagcagatcacctgaggtcaggagttcgagatcagcctggccaacatggcgaaaccctgtctttactaaaaatacaaaaattagccaggtgttcacctgtgatctcagctgcttgggagactgaggcaggcgaattgcttgagtctaggaggtggaggttgcagggagccgagactgcaccactgcactccagcctgggtgacagagtgagactctgtctcaaaaaaaatgttaaaaaggaagttgccaagatggccaaataggaacagctccc

SEQ ID NO: 69202 - DNA, 1053 bp, Homo sapiens
tccaggctagtctcaaactcctgggctcaaatgatccacccaccttagccttccaaagtgctgggattacacgcataagccactgggcccggccatctttaccacgaattcttaaagcattctaatcatgttgtctgagaatgaactcagcaactgtaattagatgtgattcagcttggcctggagtccgtgcaggcacagctgttggccgatacagttctgaactgagtcagttaagcaagcctgcaggagcatgcagcttcgtggcaggaatggtcccgggatgcccactttcacatctcatgcctgcctttgacagcctatttcttctggccagtggtttctgcctggttccttgagtgacttcatggctcataactggcctgaatttggaaccattgtgctggtctggaattaagatttagcacaggtcctctctttcctaaatgccttggtccatttttatattatttgcttggactcttaattcttttcagtagaacttgattttgacctctcagttgcctttaaacggaagcatctcaaaatagatttccataggaaacaccaccttttgtattatgcatgacacgcttatatctaatagatggctaacaatttacatggtttttatctgtgccctttcagctaaccattgcattcaattacagttttttttaagcttaggagaatagaaaaagaaacacatcatttttgttgacaggctttgcatttatgcacagggctttgcatgttggcaaagacacccctttgtggttcctgtttacaagtctgcagttagaaggtggtttttattaaatcacattctatatataaaataattgcttttaaaaatatacattatacatggaaacacatctgcttccttcaatgagtaaaaggttcatcttgtggcttctttagtcaacagtactttgcagcagcctggagcctgttttgaatttcatttttgctttgttatgttttgtgaccaggttttattaagggtgtagctgcagtacatatgtagaagctgtccttagttagttatta

SEQ ID NO: 69203 - DNA, 1429 bp, Homo sapiens
gaacccaccgatgcctctgctgcactctccaggactcaggccttcttcccttcatgctctcatctctgcttggttcgagcccatcacctgccatgaagtctcctaacctttgcaggatgagctttccaaaagggcaactaggtaattgggaggatttgcagtcctccagctcttcatttgttcattcattcattcactcattcatccattaaacatttattaagcacttgctgtgccaaacactctcagttgctggggataccagggcacttggtccctcccctcacggagctcagcgcttggtgcatggttaaggagaatgctaatcagacttccttgagcaggtgatatttgaactggattttgaagggtgaatggaagttagttatctaaagtatggtgaagagaatggacattttgtgtggagaggtggacatatttaaaagtacaatagcttgatcaaagaatggcaagtgaacaaaggactcacaggtgggaatatcaggtaggcaggggccatatcatgatgggtctggtgtgcttagcctgaggacttgaactttattcttaaagaaattaggatccactggaatatttgtaaacaagataactgcataacatttatgtggaataagatcaatcacgcagcagaatggaagataatattttggatgagattcgtggtgggagggagatgatttaggaggctacagcaggtaacccagacaacaagtgataggtgcctaaatagtgggcataggagtagagagagggagatggatttggtaagtgttaaagcggtgaattgcatagcagatgaggaataaaattaagataacttccaggagaccatatatgcagggcagaacataaggagaggagctgttctctaggaaatgcctaagtgttggatatttttagcatgaaaacatctgaaaggcaatgtccattagaaagttggacacaacagtcaggagctcagaggagccatgggtgaggccacgagggtgaatcaggcatgcctagcaggaatatcaagagagatggacagagaattgatgatgaggcccgggggtaaagggacatttgaagagtgaagagtgagggaggctcacaaagaaaaagaagagcagagcagtgggaagaagtctagcagagttgtgtcaacacagagaaggcttgggagatgataacgttgcttcagaggaatttggacatgatggaaaaggggcataatgggaaatacagagggggaagaaaggaagagccagcacctacacaagtcctaattgctagacctgggttgggaagtggaagcagtgctatagctaggtagggcttttttagtttttttgtttttcaatatatattttgactttttaaaactaagtaaaaaagaaatcaaggggaaacaaatattccacagcag

SEQ ID NO: 69204 - DNA, 1027 bp, Homo sapiens
ctgagactacaggctcgtaccaccatgcccagctaatttttgtattttttgtagagacagggtatgttgcctaggctggtctcaaactcctgggctcaaataatcctcccgcctcagcctcccaaagtgctgggattacagagattagctgccatgcctggctgacctgtcagcttttttttcttaaatccatttgggattactaacagaatttacattagaattctaaattattttgtggaaaaaaaatttgatatgtccctgaattcaagtttgcccaatcaagagtttggcacatcctaccactcattcattcatcattatttgttttttcttaagtcaattatcatagtggtcttagttttctcattaatttatttctaaatagtttatgcttttgttgtcattataaatggtatcttttctcttttggatttttaacaaggtttactgataacataatcctaatctctggcttctcttgaacaatcaggagatctggcaacatggagccctcattccaacatggcaactatgagctgtccctttccataggacacacgcttgctagtttaccacagttgacgggctgactccacacatggctattacttgcatgccctgcgggctgatgagttatttagggttgggtgagtcatagggaagttgacatcactgcttattgctgctgctcatgactctgtagcatcaccaactctggtccttgcctggctgacttctctgcatgagtgttcctgcctggcctgtgggacttactggatccttctagccctgtctgctcttctgcaacatgccctttggctctctgaccagaagcaaatgccagctctgcttgcctcgccacaccctccacagccttgcccttcctgacagagtcatccctgccccttgtctgagcatgaggcctaatggaactctatgttttcctcccatccacagttttagttacatatctgtagatgtttcctctgaaggtctgccagttaggagggcagggtctaaaact

SEQ ID NO: 69205 - DNA, 1032 bp, Homo sapiens
aaaaaaaaatcctaaaccacaaatcttctttcaacattctatttcaacactgagaatgaataatatgcttatgatgtctcaagtttattaccagcgaataattctggttgactaaagatgtctaaatatattgttcctattaagtgtatacatgtgaaagaaacaggctataattaatcttctttccagagattttatatttgtgttttgtttgaattctttcactgttgaacactaaattattatttaccacagatgtgttttctctctgggatttagttcgtttgcctttctctttcaagagtaaaggaaaatatgttgtccttccatccaccaccactccatgatgtgtgtccattccattgacagttattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgtgagtagacctaagctttacagagtaaagaccttgaagatgcattagatttgctacctaaggaatcaaatgtttagtgttttttaaaatgagaggaagatgctaagtctgtcatccacataaatgatatagttgctatatataaccacttgttaaatgtattttcattttgtatataattatttttaactgtcaagacctcctatacaggtactgttattgctcatttgctaaagtttttattcagtatgaaatatggtaatgataagaagtactaacacttttaatcctcacataactataaaaggagttatcagaaaatgttttttttataatgtgggtagaaatctgttcatttagagtttgagggccctaaaataagatcattctaccatattttactactacatattccaaagcatcaccctaaaatattgactctgatggtgaagtataa

SEQ ID NO: 69206 - DNA, 1083 bp, Homo sapiens
ttcaagaccagcctggccaacatgacaaaaccctgtctctactaaaagtacaaaaattagccaggcgtggtggcacgtgcctgtaatcccagctactcaggaggctgaggcaggagaattttttgaacccaagaggtggaggttgcagtgagccgagatcgtgccatgcagcctgggcagcaagagcgagactccgtctcaaaaacaaaaaactataacttcattttcgctttgtttttctcccaaaataggccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggcaagttctgctttacttgtttaaaaatgcacttcatctttaaaagggtttttcttgtgacttaattctgtttggtgtcatttttaaaatttttatttctttataacttcaggatcaatcaggtgctttggtgtcatttaaatcaagctgctagagacattttttccccatagctttctcttgagtgaaactcagaaaatgtatatatatgtatatttattaaaaagttaatgaagactaggggtaaaactttcagaccaggggtaaaactttcagaccaaaccataaagatttaaagttgagagtttcaaacgattacagggagattgattccaaagaaaagtcatagaaatagagaaacttcaagaggtccaagaaccaagataattcagttgttaatactattgtgttattcaagcacaatctgaagatattgaatgatggcaaactagcacctcacataacagggacatacaaagataagagatgtgaaatctcagctgaacagtattatctaaaaatattccaaagttctctgcatcgattttaatggctggtgagttcaacagtggacagtatgtaccaggtaaattaccaattgataaagtttgtgaactgtaggtcatcaa

SEQ ID NO: 69207 - DNA, 1075 bp, Homo sapiens
agagcacccctctcctgaactccacccatgaatccaacggcctacctgacctttctgcttggatccctaatagatgtctcacatctgctgccccacatgcctatattttcctccattcactccaaatgttctcctcccaacccagcccaaaatctctcccatccacagtatttccctcttgattatggcaactccatctcaacactgctcaggccagaatccttggaaccctaatgctatatccaatctggttggcttttcctttatcagtgagcacttcagaccaattgtgctgctaccaccaggtcagagccactatcattttttgcctggattagggccagagtctcctagctgggcttgcccttcctctctcactcagagtcagagccagagtcctcacagtggcacacaaggcctcatggatccagccacgccccagtgcccctcagacatcacttctcttctcgtcacctgctccgcaccatccttgccttttctcgaatgcattctgaggctcctccaaaccagctctgcattggctattccctttacctagaatgtcttttcttctgatatctgtagggcttgttccctcacctccttaaagtgtttgctcacttaggcatatccagactaatctacagaagaatctcttcaaagtactcatcactttttaacaccatgaataatttgtttttaattatgcttatattatctctctccccttgctaggtcagagatttttgattgataaattaaaaaatgaaaaggtgtttaacctcattggtaatcaggaaaatgcagagtaagaccaaagggaaagtccatttcataatcactaagttggtttaaaaaaaaaaaaaaaagcctgatccagcctgggcaacatggcaaaacccaaaattagccgggcatggtggcaggtacctgtaatccagctactcaggtggctgaggcaggagaatcgcttgaacccggaagatggaggttgcagtgggccaagatcgcaccactgcattcaagcctgagtgacagcaagactctgcctcaaaaaaaaaaaaaaaaaaaaagg

SEQ ID NO: 69208 - DNA, 1096 bp, Homo sapiens
ctggtctcttgttaatcgtccgccacagctcactagaatgtaagctctagaagagttgagatcttgtcttatttacttctgattcacctgcacctacaaggcctagaacagtgcctggtatatgaacaggtgctcagtaaatttgtgttgcatggataaacttgtttccaagagatttccagcagcgtgtgaaatgaattctggctgtcctcagagaggaacctaacctactattgcagcagtttaggtgaaagtttatagggactatttcaggccccactcaaatgcagaattgaaagatacacacgaggaagattcaacagatatgagcaactgatggcacaaaacagggaaagggaggaggaggagaaaagagattctgacccaaaattatatggctggggtgtgatagtactatcactaacaacaaatggaaataggaagatgagggggattatgggttctgtttttgacatattaggacaggatactagcagggaattcgaaatgaagaatgtgacccaggagagagggtcacctctggagatgcgctttggggactgtctgcatcaaattgctaattaaacccatggggtgctaggaaactgctaaaggcaagagcccagagagaaaagggcctgacagactgaggaggcaagtctggagaagggctgctcagggaggggctggtccagcatccagcgccgccccagggctgctgagcacaaggcgggtcaggggcatgggaggttgtctttgagtcacttcattctctgcttttcaaaactcaagcttttctctactgtaaaagttgttgatgttttctttctagtccatcagcctacagaaactttacctaaacaaacaaacgaaaaaactcagcttttttctacctctctagttcatgtcacattctaatgatcacttttccttgggttttccccttctctcaagttgagtctttttcatagtttcattctgtctatttgtcttttggtgatctgtccactataaaataggtatatgccctcctgacttgcaggaaaaacatgttttctttcttttatttttaaatggcacaagtgataaataaatt

SEQ ID NO: 69209 - DNA, 1033 bp, Homo sapiens
tattttatagtggacagatcaccaaaagacaaatagacagaatgaaactatgaaaaagactcaacttgagagaaggggaaaacccaaggaaaagtgatcattagaatgtgacatgaactagagaggtagaaaaaagctgagttttttcgtttgtttgtttaggtaaagtttctgtaggctgatggactagaaagaaaacatcaacaacttttacagtagagaaaagcttgagttttgaaaagcagagaatgaagtgactcaaagacaacctcccatgcccctgacccgccttgtgctcagcagccctggggcggcgctggatgctggaccagcccctccctgagcagcccttctccagacttgcctcctcagtctgtcaggcccttttctctctgggctcttgcctttagcagtttcctagcaccccatgggtttaattagcaatttgatgcagacagtccccaaagcgcatctccagaggtgaccctctctcctgggtcacattcttcatttcgaattccctgctagtatcctgtcctaatatgtcaaaaacagaacccataatccccctcatcttcctatttccatttgttgttagtgatagtactatcacaccccagccatataattttgggtcagaatctcttttctcctcctcctccctttccctgttttgtgccatcagttgctcatatctgttgaatcttcctcgtgtgtatctttcaattctgcatttgagtggggcctgaaatagtccctataaactttcacctaaactgctgcaatagtaggttaggttcctctctgaggacagccagaattcatttcacacgctgctggaaatctcttggaaacaagtttatccatgcaacacaaatttactgagcacctgttcatataccaggcactgttctaggccttgtaggtgcaggtgaatcagaagtaaataagacaagatctcaactcttctagagcttacattctagtgagctgtggcggacgattaacaagagaccagagaggtaaataaaac

SEQ ID NO: 69210 - DNA, 1045 bp, Homo sapiens
tctcatccctaaagtcagcatcttacttaatcgagaaatacctgccaaattcaggaataagacaaggatggacaatgtcatcattactatttaaaaccagtttgaaattatcatccagtgccagtagacagaggcatatgaattagagaaaaatagatacaattatttctgtttacagattatattatatatcaggaaaactaaaaaaaaaaaaatcattggaaaaactgccaaaacacttaacagaatttagtaaagtgcaggttataaaatcaatatatagaaagccatagctttaaaaaaaaatagagatggagtcttgcccaggctggtcttaaattcctggcctcaagcgatcctgccttggcctcccagagttctgggattacaggtgtgagccaccatgcccagccagcaatagcttccgtatataaaaatagcaactggttggaagatttaaagactccttttataattgcagcaaaaccaacaaaagtacctaggcataaataataagaaatgaccaaaacatatatgaataaaacactcctgaaagacacaaaaatagatatgaacagatagtaggccgtaagtttagataggaagactcaatattataaagatatctaggccgggcgcgatggctcacacctgtaatcccagcactttgggaggccgaggcgggtggatcacgaggtcaggagatcgagaccatcctggctaacacggtgaagccccgtctctactaaaaatacaaaaaaaaaattagctgggtgtggtggcgggcgcctgtagtcccagctactccggagtctgaggcaggacaatggcgtgaacccgagaggcggagcttgcagtgagccgagatcgcaccactgcactccagcctgggcggtagagcgagactcagtctcacaaaaaaaaaaaaaaaaaaagatatctattgtgataaatattatcagttttttttcttgaagctaaacaaattgattatatgtttcatttggaaaagcaactaaacagaaatagcctggaaaactctaaa

SEQ ID NO: 69211 - DNA, 1034 bp, Homo sapiens
cagccatcacatctacattccaggcagcaagaaaggggaatgaacaaagaagaaggagcaaggggattaaccaattacctttattttgtgtatgtgtgataaaacatacatagcaaaatttatcattttaaccatttttaagtgtatggttagttcagtggcattaagtacattcgcactgtataaccatcaccaccattcatgtccaaacattttcattctcccaaacagaaactccatactcattaaacattaactctccattctcccctctcttccatccctggcaaccaccattttacttgctgtctttatgaatttgacaactccagatacctcgtatgagtggaatcatacaattgtttgtccttttgtgattggtttatttcacttagcagaacgtggtcaaagttcatctacattgtagcatatatcagaattcccttcccttttaaggccaaataatgtttcattgtatgtatataccatattttgtttatccatttatttgttgatggacactgggtggcttccaccttttggctatcgtgaatgatgctgctgtgaacatgggtgtaccagtatctgtttcagtccttttcaaatctttttttttgagacagggtccaggctagaatgtagtggtacaaacttagctcactgcagcctcaacctcccaggctgaagtgatcctcccacctcagcctcctgagtagcttggaccaaaagtgtgccaccacacctggctaatttttaaattttttgtagaggcagggtttttccatattgccaggctggtctctaactcctgggttcaagtgatcctcctgcctgggcattctaaagtgccagggttacaggcatgagccactgtggctggcagctttcaagtcttttgagtgtatagccagaagtagaattggtgggtcatatggtaattctgtctttaatattttggggaatggccctgctgtcttccatagcggctgcaccattttatacttccggcaatgcacaagggttccaatttcacc

SEQ ID NO: 69212 - DNA, 1035 bp, Homo sapiens
ataaaatggctggcatagagttagaagctcagtaaattgttgttatctttacaatttataaatgacttaacactaaggattttgcatttcataagaattctgccactttttctcttttaactaaaatttggaaattaatttttttttaatttccaacttttaagttcaggggtacatgtgtaagatgtgcagatttgttacataggtaaacttgtgccatgttggtttgctgcttacatcatcccatcactcaggtattaagccagtatccactagctatccttcctgatcctctccctcctcccacctgccaccctctaagaggccccagtatgtgctgttgtcccccatgtgttcatgtgttctcatcatttaattaaattatttgtgacatctactgacagcataacaagataggtatttttggctcttccagagctaaatgccaaggtactggataaaacacaatatacagacatacttttcaatgtattgtggagcttgcaggaaaataaggaaaacccccaagatttccagccaccctcaacaaaaataaacaaaatttaaaaaaacaccaaactgaaatcagagaagtagctaagtgaagaactgtggctgctttaggcatatatgccaagatcgggaacctagagtcctaggaagcatatggaggtgcaggaaaccaggtcccaaggcacatatacattggaggagttaattctgagacatcttccaccctcgctaaataaacagatactagaggaggctacagcctcagtgaatatgtgatattaaaataataactaatgtagacattaaaatagtggatactaggcttaatacatgggtgataaaataacctgtacaacaaacccccgtgacacaagtttacctacgtaacaaacctgcacttgtacccctgaacttaaaaaaatgttaaaaagacaaaaatcgcatatatatatatatatatatatatataattacggtacatatatggcataaatctttcaaaattgaggaaaacaatatttg

SEQ ID NO: 69213 - DNA, 1002 bp, Homo sapiens
gatttggtatctagctgtaatcacctctggattctatcatggcatctgggtgtctgagcagaagaaatcctggatcatgtgacttatccataaagaatagattctacatttagatctgatcacgtgcacagagtacctaccctgtgccaggcacatttgtgtatggtatttcatctagtcactcacagattattaaatcagctataaaaagataaaatgcttttacttgaaataagattaatgttccctgagaccctgcactataaaataattgttttttccagcatagtcatttattacagttaaaggaaaatgttataaaacatttggatatttctcatatgctccttgcataaagtaagcagatttatatttatttcaatatgatcaaaccctagagcttaaatgctttcttttgtatataatttatactatataaatatttaaatatacaacagtaatagttaatatttaagaatagtaaatatttaaatatacaagagttgtccaaaacaaaaataagagttctggatcttactagctccaatactactttactttgaaatattgaatgagtgatttcatatttctaatattatttatctttaaaattgggaaaaaatatcctactgaatatgattaattgagaaccctaggtacaaagtattccttaaatttgaagtgataactactgaaagtgtatcccagagggaaatggtctaggttggaagatatacatatggtggtcataaagaacattcagcctcattggacttctaaaaatatttttttgctgtgagtgatagcctttttttttttaattaatttttttaactgctccttacagagcagggctactacacaggcagtgtgcccagagtatccaccaagcctttatttaagagctacatttttaaaagcaaatattggtctttagggttctttgcgaggaaataataccgcgtggaggtatttgtgattcttatatattgactccacaat

SEQ ID NO: 69214 - DNA, 1060 bp, Homo sapiens
ttgaggagcatcagtcatttatgacttttcagaagttaaagtatcatctcaggtgaggacagcactttctgccacctaggaagaatatggagaaagcaaaattttttactactttgtcttaagaacagactgcatgtctagaagccaatttggtttttttctccaagctgccagttccctcttcaatattatacagtgttttgttttggtcatagcaccaattactaatttaaatgagatttaacgaaactctttcaataataaataatacataacaaaatacgtgtgtgaccatatatttgcaagaaaggggttgtgccatgaatctttttttctcagtttaacaaataaatttgcaaaggcaactttcaggaatcagaatgttattttaaatattattaacaagacaacaaattattcagacaactaatcagaattatagactttaaacttacgttatttttcacagaatatagcaacactgaaatccaggcgtccaggaagactattttacttgaaataatatttttaaacccagttttatgatatagaatagaattctatttgcttttctgcagctttagggaagaggggacattttccccttttgatattgctggttttttttttttattttaagaaaacagcaattagaagtgtctaaatatcagatttccattagctagcatcaagagagaagagtaggtacaaacttaaaattcagaaaaggacagaaagggccaggcatactggctcatccctgtaatcccaaacttggggaggctgaggtaggaggattgcttgaggccaggagttcaagaccagcctgagtgacgaagcaagatcccgatctctacggaaagatcagccattcctggtggctcgcagctgtagtcccagctactcagtagactgaggcgggaggattgcttgagcccaggagttcagggctacagtgagctgtgatggcaccactgcactccagcttggatgacacagcaaggccctgtatcagaaaataaagagaaaaaggacagaaagataatgctaacaaatggaa

SEQ ID NO: 69215 - DNA, 1127 bp, Homo sapiens
aacattctttctgtcttgctaaaaaaatccaattttcagaatcaagttagttgctaagcaaatatgcataaaaccatacatttatctgaattgtttctaatttaaggagtagtatataaaagtttcaacagaaatcattgattagtaaaagtgatggaaaatcagcaaaataaaaatagaattagagtaggctaaaaggcccttctttagggtaatcggaaaactgagttcaaatatagggtctgggacttctcaggtgatattttatcttaaattagaatctgcatgaggtagggtggggccactcatgcctataatctcagcactttgagaggccgaggcaggagcgtcccttgagaccaggagttcgagaccagcctgagcaacatagcaagaccttctctctatttttaaaaaactaaaattggatttaaataaagaatctgcatgaactttcttgtcacttattcttacatattatttgccagtgtgcgatacttaataaccaagtaagacacttgaaatgagtcttttaaggctacaacttaggtaacattttataaatattactgctacatacataatacagtaactttttttagcctcacaataataccttgtacaatttataactgctaaagggcctatagaaggctacccacctatgtaaaaaaaaaaaaaaaaaaaaaaaggtcctagctctgtctggtgtagcttggcaaattatttttgatatgaattgccaggaatataggggtatcattccttgctgataagagcacatacccttcctttgctggctaagctatgtgattctgtaggaccttagtgtcatggccatcctttcagtagtaagcagatttagagaagttgtcccattgttaccttatttcaatagtttttggtctttctatattgtgcataacctcacttaatcagattgttatgactgtttccccccaggaagtataggaagataaaaaaaaaaaaaagccaggccagatatatatgactgaacgtgagctcagcaaatgatataggtgtcttaaacatactttcttttttttttttttaaagggaggggttctggctctgtcacccaggctggagtccagtggctcaatcat

SEQ ID NO: 69216 - DNA, 2105 bp, Homo sapiens
ttcagtagatattggagattatgctttgtacattaaatccagtttgatttttaagtgataattttcaattaaagactttttaataagacaactaaaaaattaaattttagtcaattacaataatattttttggagaagcattcccagatgtgcttttgacggggagttgatttcattagttgtttgggttgtttaatccagaatttttaaaactgttatgggtttaatttgctacatttgtccattcttattcatttcatctgttttgatcactgaaaagttgtctaaaaactgtgctcattatacacagtttatagtattttaatactttgtttatagtatttaatagcttctgaaaactttaagagaacatactaaaccaaggaactatttattaatggtaatctatatttagtaataaatatatttgtaacttactaaatgtaagtttactaaatgtagattactaaatcactgagtaaatatttcttgaatatttggacaagagatggggggagggagaatgacttgaccctcaagaaacttaactgctacctttaaaaggttataatgaagctgggcacagtggtacacacctgtagtcccagctactcaggaggctgaggcaggaggaccccttgagccgaggagttcgaggctctgtctcttaaaacaaaaaaagttataaaaatattcagactggagggttcctaacttttaatacttaagcagggtctttaccacagagttaaatttaaaattctgtttagaatggtaacaaatttaattatgtacaaaacagcatcactttagtgttaggatcagtgttactcaaagtgttgtaatgttaataacaagcatttaaatcacattgtttgaaaactgggatctacaaaaaatatgattccaataattaactttttaattatgggaaaggcaagggaatgttcagtgaatgtaaaaaaaatatactactgagcaaacaaattgttttaatgaattttgattttctgttttaattttttggtacattgactcttcttgacatggcactttgctattaattaaaaaaaattaaaccccaaagacaaattaattctgtatttaatgcagatttaattcttgactagctgtaatgcttaaggagttggcagtcttgttggcaaaacaataaaataggaattaagctgaaatgtaaaattgtgtaataattaggtttcattaaagtatatatagtttccttaataactacatgagtcagtagtgttgacttaataataagttatttagcttttgcttttctctgaaaacatatcaaactcttcatatatagcatcgaaatagatattcaacctgagccactgtaaattgttgaagcttattgctatacattaagggaaattctatccaacagttcagtgtaaacaattttttaaaggtgctatgattctttaacatgatttgtagtatgtagaactcaagtattctagaataatctttgcatgataatgtatgagaaacatttataaacagtccttcaggtgtacaaaataactgacataatattttgcatttaactacactgcctccaagtattttaaacaaagatgaaatttttagagtattgtgctatatttttataactgaatttccctcttattaacaatactcataacatttagccattaatgattactgatagcttaaataagagtgtagtttctgtttctaatgtctattaattttaaccccatttaaagatatttcctacttatcatactcaaagttaatcagaagttaaataaatgatggtccttctggttctctggaaactgaaaagaagcttctgtttctttagggtatgcaggaattttttttcttcccagtgagctgaatccatcctttacgctgctatttgctaacctcagttgtttttctgctccattaaagttgaggccaccaaaaatagtagtaatatcacaactacaaaaccctgggtggatttgtacccattgcacatacacttcttgctgccaattcctaagagacttttgaaataatagtatattcccagctggacaatatattctacttgtggcctatgt

SEQ ID NO: 69217 - DNA, 1592 bp, Homo sapiens
acttaagatagcaggttaatattgtctcaggcgagacttagaacgtcttttctggtatcccagtctgcagtgggcaaatctattgtctttatttctcatttaagggcagaatggagggatgacatatttttacttttcaagaggcggttgccacttttaagtcactgttgtgtgtgtgtgtgtacatacacaaacatacgatagtgtgttttcagagcaagtatcaaaggctaaagacttggagtgatactagtgtttaaaagcctttttaaaaaaattaagatgtgatgagaaactggagaattgacttttaaaaatttcttttctgtagaagaggctatcttcaaaatggagtcctaaagtatatctgatggatagaatttaaattcttaacactgtatataccctgtggtcaaaagcatcaacgtaaaacttgatgtttatcagattacttatgtttcaattttcctgtggttagaaaaattaagacagaagtaagctattaacggtatttgcttgtaagagtaacgttaaaggtttaaggaaaggtttgttgaaatcgatatgcatcacacgaatcatttattttcaatgttgttttccagttgcagcaatcatttgtgtttacatgactttgaaaaagggtttagtttatgttgattttgaccctcttatttaatctctagtgcagaagtgcagctttctgcaggctgcgcctcaatcgctaagttccactctccatcctctgccgcgctactcctggcatgtggatcaccaagatacaatttctggtcctgtctgttcttattgatgtcctttacagttaataaatttgattgccactaatcagtctgtatctcttgcaaaaacaccacatttagcatccaagtagagtcagagtatgttttttatgagattgtactaaagtaaccttctattacatttcttattaccatattgcatttcctatagtgggcagcatagagcaggtggatcctgacaaagtaatgttagagatgtgctgacagctttacaatagatattctccaactaatttgacaagatataaaataaaatgtagttcgtagttttcaagcattaatggaaagtgttcctattaaaaaattaccaataacagtggaaattgttgcaatccaatttgtatagtttactgttttgatgacaaagcgcttatgatgggaaaaatgtagtgttgcttttgtaactgcaaacgctgcacgccgtaattagaggtttatgttattttatttgaatttttcattcttaccatcagttttcatattagtcaggaaattgtgataaattaaaaattccctcattcaactaaaccttaaaaaactgtacccagtttcaaatcaagcattatcaggtgtatgattacaacagctgaaataaattgaggaattggtatgccaactcagtggagaaattttgggattttaggtcactctaagatttaaaaaaatagtttgattcgttaaacaaggctattgaagttaaattgatatttccttaaagatgattttagagaaaaattccttggcgagcttcgagaatgcgttcatggcttc

SEQ ID NO: 69218 - DNA, 1274 bp, Homo sapiens
cccgctcgcgcgcccccggcagcagcaccatgttgaatcgcgtccccgggctgagctgcctcagccggcggcgctgagaggcgggcgagagccgggccacggggagggagggaaggaaggggtgggggccgcgctcgccccgcggcttcgcgcggatccggcagtcgcctgcccttctagtttcgctccgatttctttaaacttttttagaaattcccctccctccttccctcctctccccctggcctcctgctccctccttcccctcctcctcctcctccccctccctccctccctccctgcgccgccgccgccgccgccgccgccgccgccgccgccaccgccggcccatgactgagccccgccgccgccggccgaggaatgggctccgggctctggtaggaagcgctgggagcggggggcgcttttaaaacaccgatctgggttttttaaaaacctcctttgaaaaaataatggcaaactcgacggggaaggcgcctccggacgagcggagaaagggactcgctttcctggacgagctgcggcagttccaccacagcagagggtgagagcagaaccgggggggcagcgccggggcgagccggggcgaacggggctctcccgcccgggccgggcacggggtcccggctgacaagtgcggggctttttctctcccgcaggtcgccttttaaaaaaatccctgcggtgggtgggaaggagctggatcttcacggtctctacaccagagtcactactttaggcggattcgcgaaggtgagtggaagttttaatttgtatttccctctcgctggcctcctccaaaaagtctcctttgaccccggagtgggcgcttggggctgggggggtggcccgcgggggcaaaaggcgttcttttcgctcccagccggtggcacggaggcggacggcggcggggctgtttttggcctggtggctcgcgtgcgcgcggcgggcgcggggctccggcgggcgggcggcccggcgccggctcgcgccctgcccggtgcccggtcgggccggcggggtctgagcgccgcggcggggaatgcgggcgtgcggggcgccagcctgagccccgcgcccgccccgctcccgcgccgcccgcccgctcgctcgcgagtcagctctgccgccgctgccgctctagcacaggcggagacacacagagacacacagactctgagagcagttttcgtgcaactcaaaattagcgcgggcaggtttaacatcgataatcggctgcgaaataatcccgg

SEQ ID NO: 69219 - DNA, 1139 bp, Homo sapiens
ccatcttaggcttcaaggctaggcagaagctgtaggcctcaaagaagggcctatggagatggatagatctgggagagggatcggaatcggccccagccccggccccccccccaacccgcggacgtcgctgtccggaactgtattgatccttttgaacttttttttttttttttttttttagtgtaaacggaccgcgttgagatttaaaagggggcgacagagggacttgcgattggttattgtccgggcttcaaaaacaaaacaaacccaccaaacccccccacccccaaacaaaacaagtggtattaaatacagggctctctggtgaaaacacagtgattcaagaagcccttgcttagtaactcttaccgatcgatccgaaacacccactgatgccttaggtatctacagatctctgtagaatgggtatttatttcatagttaggttaagattttcttagattgttcacgttcagacaactgtgcctgtgttttaccaggtttctgagaagaatcagtggggagaaattgttgaagagttcaactttcccagaagttgttctaacgctgcctttgctttaaaacagtattacttgcggtgagtagtagtgacttttccatagtatttggaaataagggacttatggagagatttgtttttagcaaaaacaaaagcaaaccttgcacaccaaacagttcttaagctcttgttcatttcagactgagacacatttaatataaataaagtgagattgtaggaaggtgaaagtcttcctcaccaatttcaggatcgtttacatttttcatacaaaatcattacaggtgacaccccagccccaatcttggtaaacattcttttgtgacattgttattcatcgcttgatacccactgaggggcagaaaggtgatgcttagtaaaagacttaagatagttaatgaaactttgtaacctttgggaaaatttttttctttgttttggaaactcctttagttttaaaaattctggctttaagaattttttttttttaatgaaacttcttgtttggaacagtgtcattgaataggtttttcagtagaatattcctacatggcataacatgttggtggcttaggtgaccaggattgttttgataattact

SEQ ID NO: 69220 - DNA, 3885 bp, Homo sapiens
aataggaaatgcagtaatcgcacaggtgtactttctattggctatcttagattgacttcaggcttgaagctggagttcgcagaactttgtggagtagttattgagttacacaggaagtctagaaaatattaaatatggttgtcatctattgtgtgtgtgtgatggcatttgtgtcagagtacattttaaattaaagggctaaatcaaaaagcaaaattaacctccaaaaccgttgagttagtagtggggtgagaaacaagagagttttatattcatcgtgacattcatttgctcatttctatttatgatattgagaggaacatgttaatacatattctggttttatgtttttatcagtttaaagcatttgaattttggactgtttgaaatacatatttttgaagttttgcttcatatttgttagattgattgacttaagttttataaccagaaagtactatagaatatacatgattcatgagatgtatatttttctgaagagtttacattcatactaatagttttagcataatcaaattaatatctaggcttccaattttttttaacaaaagttaattataaatattgtttttccagttgtcatttttatcttgggaggatatcattaattataggtactgtttttaactatatagtttcaacattgtaagtatttacatggtcttcagatcaaattgggctttttgctcttattagaagctgctttttgaactatgtccttagttaaacttgtttttcctccatatgtcactctctaggtttgtttttgcagggttgtagctaggctactaggaaaaaagttgaagcatttgttttggaaaataaaaccatgtgaagatttgcatggcttgtaaagaaatacaaaagaaatatgctggtcaaaacttaggtactaccaaccttgaaagaattttttcctggtggtctaatattgcacagtaagaggatatatatgatgctagcttttacaccttcctctgaaaaatcttaattggcagacaagatgccaagtaacagcaattctattacctacccataagattggctcttcatagtaagaaatagtaatcgagtgacttgataagttacctctttgctacgtcagattgaatatcatcattactgatgagcagataatgcagtgtgttttttaaattacaagtggaataattttttaatatgaactgctttttcatttgacctattgtaagactgtcattatatgtgttattcctcctttacaagtttaatatttgctcacattcccctgtaagtttgctattaattggatggatggctgttagcctagtgttttatgatatatcttcataatattacagataatttaaattaggaagagcaagctagtatgctggccatgtatattttaatagtgttttgttatttttgatacaaatattgacagtcattaaatatagacttgagtattaatggtctgccagacattaacttaattttctcaaatatacatttattcagttatagcttgtctacaaaaatttcttagagtctaaaattgaaaatgcaattgattattttaacattggcatttaatttttacaaatataagtgcctgcctgtatcaaagtttctcacctactccagaaatatatacacgtactgtgtacccacaaaaattaaaaattaaaaaaaagtaaagtgcttacagataatgtgtaaaagcagtctatttaaaaattggaggccaggtgcggtggctcacgcctgtaatctcagcactttgggaggccgaggcagacggattacctgaggtcaggagtttgagaccagcctggccaacatggtgaaaccccgtgtctaccaaaaatagaaaaattagcctggcatggtggctcatgcctgtaatcccagctacttgggaggctgatgcaggagaactgcttgagcccgggagtcggaggttgcagtgagcggagatcgtgctactgcactctagtctggccgacagagtgagactctttctcaaaaaaataaaataaaataaaataaataaattaaaaattggatactaatcatctgtgatgtttatgcactttattttcatgtagttccttttcttggcatgtacatctcaatgtgttccaccaatgtttattattaggatattcctatagtatgaaaggataaggtatagtttcccacattttgtagatggagatattaaagtgcaaaaaaaaaaaaaattaaatggcttagggaacatttcattaattggaccaaaatgttgtgttcatgacgtgttcaataatatttggaaattacttatggttaaatttatgcccaagtatctctttgcctaatgtgttccatatttacttggtggattttaattttttgttctgttttgttgttgaaattgggggacagtttgctggtcttatctgggttaagaatttgaagttttggtatgaagatttaggtaaatatttcaaatattttaaaattttgtttttgcttactgatgccaatattacagctatagtcaaggttaacttgatgtttcctttataaaacttgatttttttggaaagggggtgaaatatcttggacattaaaaatttattgtacaaaactatatgttactagttttctggcactgaaatattcatttctatttatatgtacctacctttagaatagtcagaaacttaattgtagagttatgtttaccatagtacattttcaatcgcattgtgaatttattctattttttttttcttggtgggtaaagctctttcttaaattacaccatttgagggagtttacatttgttagttaaattgaatgaatacactcatgtgttctctagttagtgtccaccatatagatcaattcttttaagagaaagccttaggtatataagcactgagtttgtaaattgctaaacggaactgaataaactgattgcccttcttattcaaggaaggaaaataaaagtatatggagattggaagacaaatatatcaataagttattcatgcatgtatttcaaatttaactttataaactgtatcgtgtgtgtgtgtgtgtgtgtgtgtgtgtgtgtgtgtgtgtgtagacaggggtcttgctttgttgcccatgcttgtcttgaatgcctggcttcaaggtatcctcccgcctcagccttccaaagtgctgggatacaaaagtgagccactgtgcctcagccttccaaagtgctcggatacaaaagtgagccactgagcctggcagtgtatccattttaaaaaacaaaaaacctgattttgatattttctgatattctgttacgtttttaaaggacatgcagacttgttgaaaggaagagcagaaagtggagaaagttgaaagacttatcaaagctcagctaggttagtgttatgtcttagaatccatgtttttagagcttaaattgcccaaagtagaaataaattgagttctttctaagacagatagttttcactgaggttacaaattttcctgaggatacaaaatgagaacattataattcccaaaaatgtttatatgctttttttttgcagttaaattttctaccttagctgttaactaaaaatgtccctgaatagaagcactctttcataatcctatctctgctttgttgtggattcagtattttcatagttgatcgtgtgaaatctataacgtctttgatagacaagtatattgtggccgggcgtggtggctcacgccctgtaatcccaacactttgggaggccaaggcaggcgaatcacaaggtcaggagaccaagaccagtctggctaacacagtgaaaccctgtctctactaaaaatacaaaaaattagctaggcgtggtggca

SEQ ID NO: 69221 - DNA, 1064 bp, Homo sapiens
cactccagcctgggtgacagagcgagactccgtctgaaaaaaaaaaaaaaagtatattgctactagatattttatattctcaaactgaatgaaattagaagttggaaaggaaggaaaaacacagttttaactgcatttcattagtcagtgagcaggtacttaatatatatttttaggtaaagtatttaaaagttttaattatattgtgaaggtgcttattgggtgttttccagacctactaaagtttaatgataaaaatggattttgtctgaattgggaaggacatagaggataaatggagcagacggatggggttgaggggattctccttttgctgctttgatcaccacagtctttggtattcagggccaactagagtttgtactctagaaacactagttttccagaaatgttaatatatttccatgaaaagaagacgaaatgaacttgagcaaaaggctaaacttgggttactttattgcaggacttcttagagactttattttgctaatgtgtattgtggatctctagacattttggggaaacattactacttctcttcccttccccatagtaaatagtgtttcaccagtgtttcaccccacagtaaatagtgtaacaccatcgccaaaactgcaattacttgtgcaccaacctaagagatgcacaactatacattttctactgtttaaactataatgtgataaaagaaataacaaacttttttctgttttaaaacataaatttcacttgtgcttggatactttctgtgtattcattatgttgtgaattgataattcatttgactaaatacattgcaataaactattgctggaatggaagtctcttagtgatgtccaggaatagctatcacattctgaattgttgaccaaaaatgatagacccatattccatgaatatctaagtcagcgtttacagggcttcactcccatcttactgccatagaaatttttggtggagccccagggagaatgtgctggttttgatgttttggctgctgccttccctctccccccgccctttttttccccattataccattg

SEQ ID NO: 69222 - DNA, 1413 bp, Homo sapiens
atgaagtactaagatttgtgatgcttctggctatatctgatgtcatttctaaagcaactactaaaaagttatttttaactaatagtatcattgaaatacatttatgatttcaacaaggtgattacttggaaaataatgttcattggaatgaatacattctggtttagttgtttcaaaaaacaaactgttgaatcttatagaagcatttcattcacttgaatgcataagtaatagtatcaggcaaaaaaataataaaaaaagagggctgagtgatgcaggtaagtgcttacatttcttcagtggctctctattgctaaagaagaaagtccaaatatattagtaggtcgtaaaaggcccttcattacttttccattcttaatctccttgccatacccttgcacatcttttgaagacagatactatgtctttttttctgttttaaagcttggttaatgaacagtcagtacacgttggtagaattagttagtagaattagatccagccatgctgatccatttatagttctccaagcatgccaagtttttctcacctttctgcctttgcatgtgccattttccctgtctggaattcctttccttttttcattgcctgacatactcctacctatctttgaaattgaacacaaatgtcaccttttctaaaaagccttttcttatctcatcaagcagcttgaagtagatccttctttataatcccactttcctcctcatttatatctctattacaaacactactataacaacttttttattgtctgtttcttctgtgaactgtgagcctgaggaggtagggacttagtattgtgtattttagtagccctaacatcataacacaatactaattagtgcataggagttacctaatgtgtggctaatagaatcaatgaatgaatgcttgcaaggataattggaaataagaaaagtaggaaatcacttttgtttgagatagagaggggcctatggaagagccctcaagcttgacattgaaagactggttggattcagatagaaacaataaaaaggaagatgggggactttttagatatgaggaaaatggaaaatgagagtctgtacagtgtattttaaacatgtaaatgaactctgctgcatcggaggcgttaacgcatgtgattggtggaatataagacctggaccaaaaattggttttagactgtggaggattttgaaaatcaaattaacatatttgagctttattctgcatatagtgaggatgtgagatttgggggaggttttgtagttgttatttgtttgttttttagcagaacactgttttgatgaaagtgatgttttgggaacattaatcttacattggtatgtgggataggtttgagataggaggaagtagtggcaggaatggcaaacacacctgccc

SEQ ID NO: 69223 - DNA, 1037 bp, Homo sapiens
aacttccctacctgtaacattcaaggcatgggtttgcttttgcttagaagagtggaggaggctgggcacagtggctcatgcctgtaatgccagcattttggcaggctgaggcgggaggattgcttgagctatgtgtggtggcatgcgcctttagtcctagctacttgagaggctgaggtgggaggatccctggagcctgggaggttgaggctgcagtaagctggcatagtgccactgcactccagcctggtcaacagaatgagactctgcctctaaaaaaagaaaaaaaagagcagaggcggttgtaatataaacaaaatgtggagctcttttcatggtattcacagcaagttcaggaatagtctccttgcaatgcaaggagtattcatctttgtaaactgcagcctgaattaagggaaaaatctcagcttgttcctttctctgaatcattattataaggaaaaggagtttaagctcctaatgaagtatcaaatcccctttcattgtacaattttggatgattgactaaggactggttttctttgcaaagatccctaggccagcattcccaaactgttaagtaggtggactgtggaaaatgtgttctgtacttaaatactatttggaaaaacagttaaacatcgttcttttctgcaacacttctcaaactaatatgcttataatgtatcttctgactgtccacagaatttcccaaacacatttgagcacatattgtcccatctcttcccactcctgacctcaccagcccctagcatacgtatcactcacagggtaaatgtgaagttttaggaaatgttgccgtcagtacacaaacttgctagataaaatggacccaactgggatagtcttgaaaaatgtttaacttactgagacagatgtgaaagcccattgcccttctagttctgggatgattgatcatgatcacagagagcttgattgagaaaaaaggagaagccaagttttagtggaatttatttagaatgcactagaagagtaaaaacagttaacattcatta

SEQ ID NO: 69224 - DNA, 1064 bp, Homo sapiens
cgatagggtctggctctgttgcctgggctggagtgcagtggtgcgatcatagctcactggagcccgaatctcctggatttaagcagtccttccatgttggccccacaaagcactgggattacagatgtgagccattgttcctggcctggattgttgttttacacttaaactgagaatatgtcttctgagtttaacctattagaatttaatgtgattatttctatgttagaacttagctctgccattttatatcatatcccttcagtgtccaagttgaatctttctcttctcccttccttgcccaacaaattccaagaagtttagcatactctccacactgcacccctactttcttgaaatagggtgatgtgatgttttaattatttattcttatgaatacacttgttttaagataacaatacatcttctaaaattttttccttcccatattttgttgttttcttctggatatatttcttttttgactagattacatttttcaaatgttctttgaaagaaggtcttttttttgtggtaaacattgaggcattgtctgcctataatatgtttaccattcacaattaagtgataatttaccttgatttaaaattctaagcatggatttgtttttctacctcaatattttgaggatagggtaatgttttattgtcctcttcctgtcctggtggtgttctgaaatctggtatcagtttgaccctgctcttttttaggtgatgttgcccctgctcctcttgctagaagcttttaaaattttgtctttgaaaggcttacattttactccagtacatttaggtatggacttttttttttccttatcttttctccttagcactttaagccatttcaatctgagatttcatattgtgaattctgcaaaattctgtcattttttcaaattcttcttcgtttattttctttgcttatagaattccttttgggtagatatttacactaatactactttccccaccatattttaactagcgctttattcatctttttgtcgctttctgagaccctttggaacatttcctagattaatt

SEQ ID NO: 69225 - DNA, 1097 bp, Homo sapiens
catgtgctctgtgcatccctaaagatgccctaccattatcaatgtcttcaagtgttgttgaactggtttttgagatccagcaatgtttatattacctcagcgtcatctgtagagtgggattcataggaataagccagcataccagcagatggtgctagtctcttaacttttcagaaaccaaaacctatatcttacttctaaaggtaatagctataaatgattaaatttctttggaattctcagaacatcttagggtattaaagtggttttatgaagagataagagaacaagtttatctttaacaatttctgtctctttcctcatgcatcaaattgtgctattctggttacagtatatttaaaaaaccttttgtgatagaaatataactgacttttaaagtattgtgatctataacagctactatttattgggtgcttattgtgtcttggatactgtgctaagtgttttatgtatgtaatgttgggataagaccaggattatttctccaatgagaagttttaacttaataggtttataagaattgtgtattactattcttcaaaacaaaaattatgttcaatatagtttagtaatagtaaattccattaaagtcataaaatgtgaggcaaggtgcggtggctcacgcctgtaatcccagcactttgggaggccaaggcgggtggatcatgaggtcaggagtttgaggccagcctggccaacatagtgaaaccccgtctctactaaaaatacaaaaaattagccgggcgtggaggcaggcacctgtaatcccagctaccggggaggtggaggcaggagaatcacttgaacccaggaggcggaggttgcagtgagccaagaccgctccattccattccagcccaggtgacaatgtgagactcagactcaaaaaaaaaaaaggtcataaaatgttttgcctgtggaagagggaaataattggaggagattgttactgttgttattgttttcagacacaaagtctctgtcacccaggctgcagccttgaactctgctcaagggatcatcccacctcagcctcctgaatagctgggactacaaaaaaaaaaaaatttttttta

SEQ ID NO: 69226 - DNA, 1118 bp, Homo sapiens
tcaggaggctgaggtgggaggatcacttgagcttgggagattgaggctgcagtgagctatgaaagcgacattgcactccatcctgggcaacagagccagacatgtctcagaaaataaaaaaagtgcagctaggtcaattaaaatactgattcaaaaatattttggcaatgatggccaaatggtatgtacattttggtattttaataccttttcaagaatgtaattttaattagtaaacctaagaagttttaaaagttgaacgttttgaacctctaatcagtttatattttatatatatatatatttatattatattttatatatattatatatatatatttaaagctgtgttctgtattcaagggatattcaccataaaggtatctgatctttgatatacttaaggtattttttttctttgttagattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacagtaagttttaagctgaatgtattatataattcttctgtaaaagttttttttttaaggtttttaaggagaaagtactttttgtttgtcaacataatagcattctttattttctgtttttatattatgcattatttaagataatgaatgtttggggggttttaaccttaaatatttgaatagtaattttgtctcagtgtttttgaagtaaaagtcctggtttttaagttggagtaatatatagatttcctgagttgagacgattgcttgctacaagattttgacaaagaaaactaggatctggaagaaattgttttctgaagtctattactgctaatgtgtggctataatttttaactaaaacattttaggtcaatgcatttgaaaatttgtcttctaaatcatcaacgtaaggcttatcaaaggcttcatatcatttttacttgtagggtttgctagttgtgggttttgataaat

SEQ ID NO: 69227 - DNA, 1080 bp, Homo sapiens
tttccttaaaggagatttatgggaattgtgggaattatttccatggagtgccttgctctctatgttttttgaagtgtgaattatgcaagtatttctgaaattaatatgaagattttaaatgataacctggaaatttaatagcaataacctcagtttgcttttttaagatttttcttctgtataaatgaaagccagtgtggagtaactcttaagtactcttcacttctttattatctgtataattattatgaaaaagagtctatattattaatttgtaggaacacaaattttctttaaatctaaaaacaatgtatttcaaaagaaattatcatgactatcatttactataaaataatttttagtacacaagatatattaagatgtagttttgttgtttttccaagcctattattaaataattaattgaaagaatttattgcattttattgaatgtactatttatttatttgttttttagctttaggatccttttccactgtatttggagaagaatggaaagagaagactgatagagacttcgttaaggtaaatcattttaattaaaatgttgattcattgagttacatgcagctaagccaacaatagatcagtggttgcttatttaatatacataatactacctatacttttatctttacctaatacatatgccatacacaacgattttaaagttgtgattgagttgagtgaaaaatcttttagaatacccacgaacagacataaaattttcattgatttctgtgaatagtaacaacaatagcagtaaacaattgaatgaccctcttctcaactgggattctgagaatgggtttcaggaagttttcgtttttatgtgtgttctgaaactatgcaattcagaaaggaatgaagggccagacctgccatcaaatcctcaaaaagaataggtgtaaaagattagtaagtgtccatctagaggaaaatttctgggaatatatttctgaaacaaaatatagttgtgaatttcaagtgagaaactacaaaaagacttgaacaaattgttttctcacttaacacttgtctaactttgctggctttcaa

SEQ ID NO: 69228 - DNA, 1186 bp, Homo sapiens
ataattttctgcccttacattgtcacatattctgtctgcccattctttctcttcttcaggaactccaattatttgtatgttagaacttttcactgtgtgccttatgtctcatacactttttttctcttcatccttttgtctctttatacttcaaacttatttacttgccctctcttcttgctcataaattcactcttgggttgtatctaatcagttcttaaacatatccactgaattcttaattttagttatgtttttcagttgtagaatttctttttagttctttcatatagttttaattcctttgccaaaatttttagttttttatttctttgaacttactattcattgtcattttaagttttgtgtctgatatctttaatatctgaattcttgtggcccttctttcttggttattgaacattgtcttttaaaaaaatgtgcctacttcttttttattgctaccaaacattgtttgtcatagattttttgtgcaatggatttctttgatgatcacatgaagccagtaagcctttttccaactaatggttttaaatgcctaagaactttgattccaaaaaaaaaacccagttgttttgaaatatacacataatgtcacagatactgctaatattactatagttcattgcttaatattcagagttgaagaaattctaaagaaatgtcagatttccaggccgggcgctgtggctcatgcctgtaatcccagcactttgggaggcagaggcaggcggatcacaaggtcaagagattgagaccatcctggccaacatggtgaaaccccatctctactaaaaatacaaaaattagttgggcgtggtggcgcgtgcctataattccagctactcgggaggctgaggtaggggaatcacttgaacccgggaggtggaggttgcagtgagccgagatggtgccattgcactccagcctgggtgaaaagagcgaaactccatctcaaaaaaaaaaacaaaaacaaaaaagaaatgtcaaatttccagtagtgtttaatgtacatagagatgtcatttttcccccatccaagttcacagatttctgatttctttcacagtccctttagtcgtctgtggccctcaggttaaaaagccctaaacataaaaagatgcctttttatataagtatctgaaactatagacaatcaaatatt

SEQ ID NO: 69229 - DNA, 1381 bp, Homo sapiens
agattgcagtgattttgagaaatctttcctttgaggagggcaatgttaagctcttggcagctaatcgtacctgtcttcgtttcctattactttctgcacatagtcattttatttctttaaggcaattaggccttgacacattaggaaatattgcagctgaggtaagcatgtgactgtaccttaaactagtttttatagttagcaacatttatgttacaattttaggatgtggcattttatagttgccatatttatagactattaaatgcttacatgtattagttgctaaaaatggtgatgtagaagtatcacatacttttatggaaaaaagtatttgaaatgatgctttaaattcagaaatggctatttttacaataacattttttaacgttatgcaacattgtcctgtttattttttatttttattaaatttgaagtatacaactctggaagaagcatagctcaataatagtgttgtttctttttccagcttttactggaccctgttgatttcaaaactactcatctgatgtttcatactgttacaaaatgtctaatgtcaagggatagatttttaaagatgagaggtgagttttcactgaagtatttactttctaaagtaaacaaactatcatttcttagtaatacatatttgtatgtttttcaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcataggtaagactggaccaaaaaacacttattttctttattgagtaaaagtgtttaatatggtactgtacaaaaccctcaatttatatttgaggtttagtgttttattttgaagagtcattacctcctcaggcatacttgtttccattattctttattatgctttaaattcagtgatggctatttttacaataattacattctttaacgttatgcaacattgtcttgtttattttttatttttattaaatttgaaatatacaactctggaagaagcgtagctcaatgagcaagaagcatctataatttagaaaccaggattacatggctatcagtaattcctatttcttctcttaatttctgttgttacgtattaaatttgaaatggacaaaactgctatatctaacttatctgagagcaggtctttctgtttcatatggccagctactactgttaaacaattaaagctaagtgaaatatgtttccttctgttcctagaagttgctggt

SEQ ID NO: 69230 - DNA, 1050 bp, Homo sapiens
tcagtcttcagagattgagcctaaaaatgttttgtttttttttttttttgagacagaatctcactctgtcgcccaggctggagtgcagtggcctgatcttggctcactgcaagctccgcctcctgggttcatgccattctcctgcctcagccttccgagtagctgggactacaggcaccatgcccggctaattttttttttttgtatttttagtagagatggggcttcaccatgttagccaggatgatctcaatctcctgatctcatgatccgcccgcctccgcctcccaaagtgctgggattacaggtgtgagccgccacgcccagcctaaaaatctttttttttaaagatgcacaggtaattctgatgtactgtgattcatggactagcatttattcacattgataagtattctgtacaacatgtgttcaccagtgatggcattcatttataatattattgactaataactattgctttttatttattttagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccaggttagtgttttcacatattctttttcagtgtggttacgagtgtataagatttgatcctaagaataaatttcaatgtgcagtatagagaactgatattttacagtatagtaggccaaagtggaatttggatatgtactctaatttcttagatattatacattccaggagtagcaggatcaaggtgagctcataggaagaatagtataataggaaaattaagttcggcaggatttagagtaatgtgatgaattagatattcataattacgatagctataagtgccccaataggcatattatttgtgattttggtcatgggaaattgacatgccaggaatagattattcatatattaccttatgattttctcaggtgatcatcaggacgcg

SEQ ID NO: 69231 - DNA, 1057 bp, Homo sapiens
tcctctaagacagtgcctggtatgatatgtgctccattatatattaggtttgttctcaaatgtgtatactttcatatgtttatacaccttttaaaaaggtattcattgtgttaatgggttcaatatccataaaaaaaagtatggcaaatagtgactaacttttaagaaatgatgtagctaatgtatttttttctttagcttccagagcagttgtagcgcagcatgttgctccacctccaggaatagtggaaatagatagtgagaagtttgcttgtcagtggtaagtggtttatttctattaaggatttatccttgggaggagtaaagcaaagaaaaaaaggaaatgtattctacagacatccagaatgttttgttctgtattcctttttagttagagtagaatatcatttacacaaagaaaggacactttaaaatccccttgtatattggaataatttgaaagaaaaatattcatcagaattttcagaattaaaatagtatgactagaatgtcattaaattacaccatttaacttttttcagagtaaaatttgtgttaaaaagttatctttcactttgtagaaagtacagtttgtcaggttacaaaatttgttcttctaaaattaacattttgttaaaactgaattggactgaccttaagaaaataaaagcaggtgttttaaaatgtctcttctcttccatctaaaacaaaacttcttattctttaataatttttgggtttgtaatagtagacggacattaatcaaatgatagaacagaaataagcagcttgacaataatatttccttgaaaagattgtgtagtcctatctgcaccactttctgaaaaaaagcaaatgaagagttttaaaaatttcacttgttatggatagttgcctcaacattagtatgaagttcggcttaaattctttagaagattaacagattgaattacacaatcactttccaatgatatatcactttaaaaatttcttgatcacttttctgccattcactaacattatttgtctcccatttcatgctcctgtcactctttgt

SEQ ID NO: 69232 - DNA, 1053 bp, Homo sapiens
cagattgttctgtttctcgagcagaaatgtattctgaatacctctcgacttgcagtaaattagctcgtggtggaatcctaacatcaactggattttataaatgtcttaggtaggatccatagttctttaaataaagtccatttacgtcacttacaacatctcttgctctttaaagaaaataccaaatatcttatctagttttaaatatttctactactagaagtttcgtatggataggttatagtgtggtggaggtttaaataaaaagcagtttcagaaatcacatctagtgtttgtgttggaacattatgagatttatcaaagaaatgaagtttactttctttttcctacctacttttacatgttaaagacatgactgtatctttttaatcttgaataatagaatataatattattatcttcaaatacaaagactttttgatattttgcaaagtacataaaaataggtatcttttattagttatatgtgggtggaattgtttaaaacccagcgacattgttaataaataatgatgttttaaatgggatgattaatcttttatatttctttgctttccatccttgcagaatataactgtgagtcatactggttcatacataagcaacagtaaacatactgctgttgttcatgtaaacataatgttagaagtcaatgtgatagttatcaaaacttactgattatgtatgtactttacagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggtgttaatttttattgtatttttaaagtattactgatttaataataaaactgaatgaaaaatatatattctatgcattttaaatgtataacttttgtgtctccagtagcattttcttacttggtctattaccatattc

SEQ ID NO: 69233 - DNA, 2573 bp, Homo sapiens
tttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaa

SEQ ID NO: 69234 - DNA, 1141 bp, Homo sapiens
aagccctatcgtgaactgtgcatgcgaaggatctaggttgcacgctccttaggagaatctaacgcctgatgatcggtcactgtctcccattccccagatgggactgtcaagttgcaggaaaacaagctcagagcccccaatgattctacattatggcaagttgtataattatttcattatatattacagtgtaataatagaaataaagtgcttaataaatgtaatgcgcttgtatcaccccaaaaccatctcctcactccctggtctgtggaaaaattgtcctccatgaaaccggtccctggtgccaaaaagattggagacttctgctttgagggatgttatatacatggcaataattaatcctgagttattgatggaaaatactgtatcatttttattcaagcttccacatgttgagctttccacttaaacacaattttttaattagtgcaatgtggagtatatagtagatattccatagttaggttttttctcttatatttaataatttcccacttcaccttgattatgtgcctgttactcctcttagagacctttacaatcctaaatagttataacagaccaagccaaattagagaaaaactccatctccatcattatggaattgtttcaccaacactcattttttgtacccttaatcttccaatgtggttgtagtcagtaatatcacaattacaaagaatgaacaataatactagctaagacgaggacatgtcatagggactttatactaaagcagtttctcatttaatcctcacacaaccttattaggtaaaatttattataaagatgaggactcaagatggctagtaacttgcccaaggttaccaactaatatgaggtggtaccaggacagaaacctgggtttgtctgaaaccaaaactcatgctcttaacccattaacctttcttctttccactgttctagaagatttctctataaagctctagagagcctttttttaatctaacatattgattatttgagctgttgtgttagaggatgttctattaaatgatcattttaggacattattgctaaaactcattggttatttgagctgtggtgttatgagatgttctactaaatgataattttaggacattaatgctaaaatgct

SEQ ID NO: 69235 - DNA, 1062 bp, Homo sapiens
tttgctgacttagcctgttggcatcttgcattttcaattgtcaggataacaagttgtcgtcatcttgctgtttctaggttgataaaatattttgtgtgagagcgctaaaatactagatattttgctaatattactatccttataatttgaactaatgagccttcataaatgtgagattaatttcatttaataatttatttttggtaacatcagtttgagaaatatgtgttccttaggccttaactactgatttgccataaataatttttttaactaggaaataccctgatttctaccacacatagtagtagaatttttaccttgctctattattttaaacattgaataccaaagaatttgattacttaaagatgttatcaaatgccaaaaggttacataacaatgagaagaatttgccaaatcatgttgaagacatttttgttatcaaatatttacaatagttgggaaaagaatttcctagggtgagaatctagtatgtacttcagcaaaaacaaaaacaaagaaacaaaccttatttattccttggaaacttgtgcgtaaaataaggagaattatataccaatgctaacctcttatctagtatgctttcagaatttatttgccagtatgatatcacagatactgtatataaaaatatacccccatttttacctagtaatacatctatgtgtagtatttgagtaaacaattatgtagtatcacatagaaggagaaaatcaggtcttttatgttagacataccaggtttcaaatcccagttctgttacttagctgtataactctggaaaagttactttttgaaagcccacttcctcagcagtaaagggataattttatgttcaaagagcagtcatgggaatcaaataagatgatatatgtgaatatgccagatacatagtaagttctgagcaaacagaagttcaagtggagacgtactttgcgctatgtgcagctttgtcaagaacagtgtgaactgatgtgctagcatatctttcaaagagaagaatgaatgaataagctagaatttaaaagtttaaaatta

SEQ ID NO: 69236 - DNA, 1027 bp, Homo sapiens
ggaaataaattaatttctctttaatagtgtagttagtactttttttctattttgaacttttgcaactagataaaataaagttgggttagcctctcaccaaggttgttggtatattttttccccagaattttagcagcttgttactaagtcttatttgaatatataataatgcttgcccttgatatttcttttgtcatagaatatatatatctaaaacagatgccaagggttgaggtacaagttcatggttctgcaaccaataatagagccttttttaaaactaaaatatgtttgcagtatgaattttttggatgtatagtctcacatatacatttatgtgcatttattaacatttatgtgccatctttttaactagaatattcctgcaaaaaaaaaaaatcccttgcattttaagtcaggtgagtttgtttgtttgtttgtttcagtaggaaggctataaagaaggatatggaatactctttggccaccaaagaaaaatagcctgccaagaccttgagtaaataagaaaactccaaatgaaactatctgtattgtccattcttatgctgctataaagaactgccagagactgggtaatttgcaaaggaaagaggtttaattgactcacacttctgcagggctgggcaggcctcaggaaacttgcaatcatggcagaaggagaagcaaacatgtccttcttcacatggcagcaggagagagaagtgctgagcaaacagggataagccctttataaaaccatcagatctcatgagaactcactcagtatcacaagaacagcataggggtaaccccatgattcagttacctcctactgggtccctcctatgacaagtaaggattatgggaactacaattcaaggtgagatttgggtgggtacacagccaaaccgtatcattctgccctggcccctcccaaatctcatgtcctcacatttcaaaacacaatcatgcctttccaggagtcccccagagtctgagctcattccatcattaaccaaaaagtcca

SEQ ID NO: 69237 - DNA, 1045 bp, Homo sapiens
aactgttggattggatatgcttgagttattatatgtaatatgaaatctagtaaatgcttgagaaatttatgaaagtacagtagagtatggtatttgtttataagataatgttctatggtgtttttaatgatatttcattcacttttaagagatttttagtcagccttcattgaaggtagggaattatgaataagggatgttaaaacaatttaccaaaagtgttcagtacaactgatgattccacttggaaatataagcagagaaatttttgaaatagtttcaaaatatacttgaatacatccaagtgtctactacttttattttttataggtggtttcagacaccctcacaggttttctaccatgcagcaactgaacatggaggaaaagatgtatatccagggcagtgtctttgggaaggttgtgagccttttcagcgacagcggttttcttttattacccacttgcaggtacactttttaaatactatttgatcagtaactcatttgactgcattaaagattttgacgtgccattctcttgcttcctcttcctcaaaaaggataagcactgttcaaaggatgccctacttgcaggattaaaacaagatgaaccaggacaagcaggaagtcagaagtcttctaccaagtaaggaaaatgagtttacttcctgttgtacatacaaaaagaaactaggcaaaacacaagaaaatgaaacgcaacttagcatattaggagaccagaaacctgggttctagtccagctctgccatgaaccagcaatgtgaccctgttcaaattgcttagattctcttggcatcacttttccttttggctggacaatgtggtctgtaagttacctttcagctctaacactgattctgttttgtagactagtcagtcattggaagtaatgacagatgatatatgagaaatgctttgtaaactaaaagtactgtgtatggttcttttttctgtaaaagtaatcatctatttgataatggcaaagagatttcatatcttgtcattatcatatatatatatata

SEQ ID NO: 69238 - DNA, 1185 bp, Homo sapiens
agattggaaaataaaagacttgaaactttaccttgatactaagcgcccctttgcctaggctgtcacagagcataaacgttaatgctagaccattggacctttagtcaccctgtaaacacgattttaaaataaccagcttaaaggggttggcagggtggtcatagttgtcagtctgtctgcagtatcacgttaattctctctctctctctctctctgatcaatttaggcagccaactgtagggggcacaagctcaactcctagagcacaaaaggccattgtgaatcatcccagtgctgcacttatggctctgaggagaggatcaagaaaccttgtctttcgagattttacagtaagcatgccttgaaacccttatctgtaaaagtctgagtcctgtatgatttagatctttattcttttttttcctttctttttaaggatgaaaaagagggaccaataactaaacacatccgactaacagctgccttaatattaaaaaatattggtaaatattcagaatgtggtcgcaggtgagtaatatgttttctgtagccaaagtgaatttagtttattttatttttacatataagttaataaaattagataactgtattttcttcattgtttttctcatcaattttgcaaatacatccaaaagtttatgcctaggtcaggccatgatgagctcttaaaagtcaaaaataaatagaagttaaaacaaccaaaaggtggtctcttaagttgttttattaagttaatttgtcttactgaccatataatttagaacaaaaagcagctgtactaaagaggaaacttaggagtttattggggaaaacaaaggaatttgatcatttgaatcacgtggagtccaaatgaaattcagtttgacacctggcattttcatgtacccatcaatggcataaataatgttaaggtatgtgtataatactctgaagttttaaaacttaactttccaatggatttaagcaaaagaaaacccaggattttgtagatctacagaaactaggagggataactcattaattcgtgagagagcaaatatagaatattctgtcaataccttgtcttccttagttacttttctagaattcctcctacatcttcaattgaccagtcttgggccgcctctctgcgaaattgtcctcagatgcatcttgtgttcctga

SEQ ID NO: 69239 - DNA, 1002 bp, Homo sapiens
taatcaagtataaatgaacaggaaaatttttaacacttgagccaagttttttttagaaaaaaaagaaatataaaggtttagtaaccatatgagaataccagtatcttcatgatttagttcataacatttctttttacttttcttactttatttcccttctaacctcttttttgtttcatagcctacatttcagtgaaactaagccacatgcaagttcctaatcacattgggctctctcaagtcacacttggtacctttgttccaatgctcatactattctccctgcctagaatgccctcctccctgcgttgcccacctattgaatatctgcttatccttcatgattcagttcagacatgagtttctttgtgtagcttttcctttgctctattccccttccctactgagcttgttctcctctatttttataacatgtctgtcttaaaacttttaatctcattgttttgaaaatgtttttttatgtggctttttcccttacagaactatgtgcagagacttcctctgattaatctttgtagcttgaacacttagcacagtgcccaacacattataacctctacctcctattcatcctttaagattcaactcagtggttactgcttcctttcctgatgtcttccttactaccttaaccctgacctggagcacagtacatattccctaatgccccatgtgttgcatgttaccaccttagatgatgagctctttgaaggtagggattcagtattttgatctttgtatctttagtgcctagcatagtgttggcaatatgatagtcattcagtaagtatttgattgatagacaggtggtgggaaattcattttctcctagagttctgatctggaattttttgagacagagtctcgctctatcgcccaggctggagtgcagtggcacgatctcggctcactgcaacctctgcctcctgggtttgagcgattctcctgcctcagcctctcgagtagctgggattatcggct

SEQ ID NO: 69240 - DNA, 2385 bp, Homo sapiens
aatcccagcactttgggaggccaaggcgggtggatcacaaggtcaagagatcgagaccgtcctggccaacatggtgaaaccccgtctctactaaaaatacaaaaattagctgggcgtggtggcacacgcctgttgtcccagctacttgggaggctgaggcaggagaatcacttgaacccgggaggtggaggttgcagtgagctaagattgcgccattacactccagcctggcaatagagtgagactccttctcaaaaaaaaaaaaaaaaaaaaaaaaaggtactatgcagaaaaggcaaacagtaatagtcagcctcagtttatccttctagttgtttcccagatgcttccctctcttcctgcaatactatattaacatttacggggtgtggagctatgtattgtttctattttagtttttaaacttgcaaaattcatgataaagagtcatcgctgtgaccttggagactgacaatcttctatatgtttttttgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgccttttttt

SEQ ID NO: 69241 - DNA, 1331 bp, Homo sapiens
ctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaatgttttggataagtgacttctgtcctgatcttaaccactgctgttaaataccaaacagaggaaacatgatgcaaagcagaagctgctaaagagcagaagtggagctatggggttaaccacgtgggacacctggcactgtcactgttaccaaatagtaagttaaatgagaacaaaatccagtatctattaggaaattttagccgatcactttcatactgcttgactcttctcagactcatacagcagtcagtcatacgacaactacactagccttctccagaggcaacaaaacaaatgaagacagtaccactgtctaattacattac

SEQ ID NO: 69242 - DNA, 1013 bp, Homo sapiens
gctatataattgaaatgaaagagttacaaataccagtgtagtaatgtaattagacagtggtactgtcttcatttgttttgttgcctctggagaaggctagtgtagttgtcgtatgactgactgctgtatgagtctgagaagagtcaagcagtatgaaagtgatcggctaaaatttcctaatagatactggattttgttctcatttaacttactatttggtaacagtgacagtgccaggtgtcccacgtggttaaccccatagctccacttctgctctttagcagcttctgctttgcatcatgtttcctctgtttggtatttaacagcagtggttaagatcaggacagaagtcacttatccaaaacattctcattttaaaaatcattttattgtcatttcatggttaaaaaaacatacatgacatgactataaagtaatgagacgagttctcaggtgtgggttggattactgagtctcattaatatatagtcacaatcctgacttgagcttggaagaaaaatatgccttcgctatatgattatcaattttgttacttaaaatttattgagtgccaacagagcactaggcacatatataacacagaattatacagtctctatgttgtagactatattatttacatagatttctcaaagataacattaaagcatgtatttacagaactttagacaaaaataacaatactgtaaatcagcaagtttctgtctagcaaggagcaccttttcatgaatgagagggttttgcagaacttattgtgcaaaagcactttaattccattacacagcaagtccatattattatatagttctataaagctataagaagaaaaacctaagtgggaagccatgatcagtttcattaggtcaaacgcatttaggaaattctctgctgagactgaagcttaaaaggctacagtcatatttacatattatagcagaaaagctagaactacagcatgcaattcaatgaggtggaagaatggtgaatatgaa

SEQ ID NO: 69243 - DNA, 1779 bp, Homo sapiens
atgcctgtaatcccagcactttgggaggccaaggcgggcaggtcacctgaggtcaggagttccagatcagcctgaccaacatggataaatcccgtttctattaaaaatacaaaattagccgggcgtagtggcgcatgcctgtaatcctagctacttgggaggctgaggcacgagaatcacttgaacctgggaggcagaggttgtggtgagccaagatcgcgccattgcattccagcctgggcaacaagagcgaaattctgtcgtctcaaaaacaaaaaaacttacttaagaagtgttcaagcaaaaacattaaacaacagtgttttaagttttgtcgaattgataatttccaattatggcaagagtgccacgatcaaacactactgtgggcagaggggtgcaaatatgtacaatttttctgaaaggcaatttgaaaatatgtataaagaaacttaaagggattatatattcttttcataatataaacatcctggtccacatatttctttccagtattagtggaaaactggagagggatggttaacataaactatggttcattcatatgaaagtattttacagctattttaaatgtttccggggggcgggaaatggaagaatgtactcctttaatactaaatggagaaaaaataataggacacaaattatataccattatcctaactttctttaaaaactttaaggcaaaaaaatacatattattaatagaagttgtttctgggtaatagaggattttttcccctgtatgcttttgtctcccaaatttcacacagttaataaaaattgcatgatcagaaaaactatcttcaaaattgcaggcctcactgcttgtggtatgagggtgagagacggggtgaaggctttgctctaggctgaagagctgaaagtttcccacaccagaactggtctgagttctcagatgcttgagcatctgactgtgatgggcaagtgtctggtggctcctcacactcagctcctcagggaggagcttaacttccctggcaactgatgagttctagtctaagtagtcagcacgcactggctttgtggggtgagaaatgctttagtcatgaagcagtggacttcccaaaccataactagctgagcatactgcccaccaatcctgtgagtaccacagaagataatccatttctggtgataagcaggggtatcacagagggccccagtatgctatctctgaacctgaattgcctataaaaaggggtgctgcctatctaccttgcagggttactgaggattgagataatagatgggaatgtcttgaaatttcctccacatttacttggggaaattcctgcctatataaccaggactgttttctcactgctttcatccctgttgcatccctgaaatgcaacttaacttctagctgcctacttagggtcatatagagagttttataaaaggccatgcacaagcacaggcccaccccagaccaattatatctgtctctggggatggggtattttaaaatctcccaggtggagtctaatgtgcagccaagaagcaaaccatgtaacttttttagatcccctgcagatcacagctgtttggttagaataacataattaattagattacaacttgttctctttttgagacagtcttgctctatcgctgaggctggagtgcaggggcatgatcacagctcactgtaggctcaacctcgtgggtttaagtgatcctcccacctcagtctcccaaatagctggaactacaggcatgtgctatcatgct

SEQ ID NO: 69244 - DNA, 2007 bp, Homo sapiens
aggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaactaatgtctttaacattttattattaaggttccaggggaatggtgacttttcaattataatcccttacaaacgtattgaagtgttacttggatttgtaccagtcattcgcatcatggttacgtaatacccaagctctaaagcaagcttagagttagctataagcatatattttaatggcattttcccctgattacataattattgtaagaaattagaaaaactttagtaaatgtgtaaaagaagagactgaaaaaggagaaaaatcacctgtaatcctaccaaaggtaataactaatgccaagcaaactgcacataatatgttgtaacctttcattttcacttgacgtactgagaactttccattttagtaaaaattacagcatgatttatactggctgtataatattctctttttttttctttttttgagatggagtctcgctctgttgcccaggctggaatgcagtggcgccatctcagctcactgcaccctccaccttccgggttcaagcaattctcctgccttggcctcttgagtagctgggattacaggcacctgacaccacgcctggctaatttttgtatttttagtggagacgaggtttcaccatgttggtctcgaattcctgacctcaagtgatctgcctgcccagcctcccaaagtgcttgatttacaggtgtgagccaccacacctggcccagtggctgtatagtag

SEQ ID NO: 69245 - DNA, 2277 bp, Homo sapiens
ccctttagatataattacctgaaatatgcatttttctttagtactaaggttggtttgctttgtgttttttaatgttatttctaatgcatcactaaaagacttctatcgagtacaagtaattcattaactgatgataactctttaaaacagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaaggcaagttcaaggttgagagcaaccttcataattctgtatatgataaaggagaaaaaatatcagctttttattgtatgagtggtgaagggaatttcttattggctgtctaaatgccattattatttgaaggattctctctagatgtgttgatgtccagtaaattactggtaatattttataattgtttttagaaatgtttgatatgttttagtaaataaactgttttatatttgtcacgttaatagttggagagtctcttattgtaaatatgaagtattttcaatttcttgtttgggattttgtgagagcagtatgactggcaaataataaattatacattttcttctcatcagaaattgcaaattcaagaaaaagcagcacaagaggtaaaattggccatcaagccattttaccaaaataaagatatcaccaaggaagaatataaagaaattgtacggaaagcagtagataaagtaagttatggctttagtggagtatgtgcacgttgttttgaaccacctctgttttaataaatgaatgctgaagtttaattaaaataataaaagctagctcctactaattcctgtctacttttttgccttttgattagtttgtgtgagataatgaaacatgaaaataagtctggttatctctttggggttgtttttcacaaagctttctattttggctttaatccctttaagcatgaaaaaagtttaccccccaccccttttttcttaggtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatgtaaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagc

SEQ ID NO: 69246 - DNA, 1105 bp, Homo sapiens
ttcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcaggtatgtttttagcaactcaagtttaatcaatatagccattgtaaacatttagctgttcatgacagatgttcaaaaaaaggcatcctggcattcaaaaacaattgtttatttgatttcagttatggtaaaccttcataatccctctttcactatccttctcaaaaccccccaactcccaaattagaaaattaattaaatacttattaccaaatccaagctacatatatgctgttacttatatctgaacaggatttttttattcatattaagtaaaccaaattataagccaaattagaatcgagtggtgggtgctttacatttttcccctgttttgcactgtttagggggtatatggggacggtgggaactagtgattaagtactgtgatgaagcttttattgtcttgttcagacaaacactggataaagctgtttattatccattaccatctgtgtttcattttcatgaatttatcatgctaaaaagaaaggagaagtgcctctgtgagacatagaaaatttgaataatttgcaaacaatttgttgcttataattttatgactgccttttaaaaattttagaatcctaggccgggcatggtggctcacgcctgttatcccagcaccttgtgaggcccaggtgggtgaatcacgaggtcaggatcagcctggccaacatggtgaaaccctgcctctactaaaaatacaaaaattagccgggtgtggtggcaagcgcctgtaatcccagctactaaggaggttgaggcaggagaattgcttgaacccaggaggcggaggttgcagtgagccgagattgcaccactgcactccagcctgggtgacagagcaagactctgtctagaaaaaaaaaaatacaaaaattagccaggcgcggtgatgcattcctgtaatcccagctactcggaggctgaggctcaagaatcac

SEQ ID NO: 69247 - DNA, 3435 bp, Homo sapiens
atattactcagatgttagtagctatgcatttattaatagttttatttataagtatttagtttcactctgttgcagactattttatgctaaaattagctaaagccaaattactatttcttaaaacatattttttactttttttttttttttaaatattattaggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacagggtaatgtattcttgttggtttattgatactgttttatttgaagaattataaatttaatatgttatttgtatgagttgaaatgatccttatttgtagtttttataataagctgaaccttagttgtttacaagtcacttagcattatataaatatatatacacgtacgtttatctacataagtatattattaatgctacctctgctccaaaccttgccaaagacttaaatattttcagcactgtttgctacaatagaagagtttgggatattcctatgcaggatttaacctctaatttgtttatttcagatatgtacacttttaatttttttgataattgttctcatacaaataaaataagccattgttttaatagtaaagatttatatttccttgttttttttcttgttaagaacattgcaagataaaggctgttgaagatgtaaaaattgaataaccttataatttagtagttaaattttatgtgatttttttttttaactagtcagtttcttgagctactgattgttgatgtatgttttgcatgaacttattct

SEQ ID NO: 69248 - DNA, 1047 bp, Homo sapiens
tctaaaatttatcttttagtacagaatttatagaagccagtgaaatcagtgcattgattaggcagaagagacatgaactggaattgtcatggtttcctgatacattacctggaattggaaggtaaaaataaaaaattatttactcaggtgtttacatgctaacatgaacaagatagcattagtacttaagtacaagggtaccttattcaattgttattttcctaaggaagttttgtgcaaattaaactttggtgtttcaaatgcccaataaagattgctatataaaggaccccttagaaagtaaagaatccttaatttatctgtttaacaagtatagctgtgtatatgctagatttatttaaaagggagagaacccgaatattaagatttattgttagtaatacatctgtcatcattcctctactcttctcccattccagtcttacctgcgtgctgtccgctgaatcacgcttttaccatattcctctcctcaaaaatgtttttctaaataactatttgatcaagtgcctactctaccctgacactcatgactttctgtaatctagttttttatttcttagtttattcttgaagctactaagatggtgctagataaataatatatacttaaatcaagctcctaagtaaagattagggtcgctgcctgagttttatattaattcctataacatattatgactttattttatatgtcactataatatagttctgtatagggcattcaccctctaagaatgatggcagaacataatagaagtcagatgaagaattccagatgtatgtactatgaaacccttccttatagttacatatttttatacatgtacaagttacattttttttcccatgcttctcctactccagaatcttaccttatattgaatcagatagtcttttgttaggagacctaaatgaataagaaaaagaaagccaagaagtggtttgggtttgaatggagaaaatttgaaggagggggtcttaacaggtctctagggacactgagaactttgaagagccatcaccagg

SEQ ID NO: 69249 - DNA, 1053 bp, Homo sapiens
cacccagtttctgtattgtggccttttatattttacttgtagtaatagcttaacaaggtaagatgaaatcagcatttgggaaaattgtgtaaaaaattgtgtattatttgaaatacagcttttctacgtatttcaacccttgccaatgtgctggtatcgatgctggtttacagcctttttaataaaaattaatacaaggtaaccaagtccttttatgtctttgtacaggaaactctttatacagtgaaacaggaggaaagaaaaatgcagcaataaagataaataaggtttgttgaaaccaagaaaaatctttttcttagatgataacactttagggttatttagtccataaataaccagtgcttcaggtgtatcaaaatatttaagtataactattatttacctgttatttatttgctgtttcactaactactttttacttttctagcctcagagatcaaattggagtacaaatcagtgcttcagaaattttttctccaatatgttttcttctgttagccactctggagaatcttcctttacctatagagcttattggttagtattttctacttttaatttatgctgtttatacttgatgtttaataattattaacttttgctagaaatttaaactctgggcccaataaaaactgaaaggcccacctggttgttttgctttagtttttttttgggcgggggggaaggtaaactagctctagcaaagagaaaacctgttaattttgggagcttctctattgtgcagtgattgcctatgccagtgtgctttgttttcattaataagttgttctatataagctgtttatatgattgagaagtagcttatttattagcttgtggggatgttacctaaagaagaacccttttacagctgatccattcatctttgaatcctagtgactggcatgtagatactaagttgatatttatggaatttgaagattaaattgaggttttaaaatcacgtacagttagttgagccagcagcacagaatacgattgtgtgatttaattttagaacttggcaaggta

SEQ ID NO: 69250 - DNA, 1035 bp, Homo sapiens
tagagaagctcccaaaattaacaggttttctctttgctagagctagtttaccttcccccccgcccaaaaaaaaactaaagcaaaacaaccaggtgggcctttcagtttttattgggcccagagtttaaatttctagcaaaagttaataattattaaacatcaagtataaacagcataaattaaaagtagaaaatactaaccaataagctctataggtaaaggaagattctccagagtggctaacagaagaaaacatattggagaaaaaatttctgaagcactgatttgtactccaatttgatctctgaggctagaaaagtaaaaagtagttagtgaaacagcaaataaataacaggtaaataatagttatacttaaatattttgatacacctgaagcactggttatttatggactaaataaccctaaagtgttatcatctaagaaaaagatttttcttggtttcaacaaaccttatttatctttattgctgcatttttctttcctcctgtttcactgtataaagagtttcctgtacaaagacataaaaggacttggttaccttgtattaatttttattaaaaaggctgtaaaccagcatcgataccagcacattggcaagggttgaaatacgtagaaaagctgtatttcaaataatacacaattttttacacaattttcccaaatgctgatttcatcttaccttgttaagctattactacaagtaaaatataaaaggccacaatacagaaactgggtgaagtatgtcaaacctgctatgtttacaacatatgagttaaaattctaatcaacattttctgctaccttatgcaaacttaaagtatcttgtaacaaaaggtatacacaagaagtcaagctatttaatatcaataatacacttaacatttcttttccagctatcatctagaaaacaggtagctatctcaagcaggggctgactaggtggcctggggccatcagctcttgttaaccataaattaccatttagccactggcacccacttcaggtatgttct

SEQ ID NO: 69251 - DNA, 1041 bp, Homo sapiens
gaaacagccaaaggatttgatgagtgctttggggaagcagaaatcaagagtgggtatttccataatttttctttataagtttggaagtactgtttgacatcttaaagtatgtacatgcattactttgataaaaattaaatgaaaaggcgtatcactgcccaccaaaaacagacaagtagggtggatttgtgaaacgatcttcaggaaaccacaatttagacaaattcaccagtatcgaatactttagagattgccattgaagctgttgagtaattacctgagaattacccagaaatatgtgaaacagcttttgaactggattttcacatgtagcattgctcagagaaaactaacagttctttcagtagagagcattttatctaatgatggctttctgagataggtttccaaatgaaagaatgctatgtaaacactacatactcgttaagtgttgagtgaatgcaacctgaaacaaaacaactcagcatccttagggcataaaagacactatgtaggtatagcacagcaattctatgtctagctgaaggaacatggttatttctaagagtgttatctgtgtacctaccacacatttttacttcttgcctcttaagccattttaaaaaatcagcgtatcatcttttagatacagattttcaaaggggtaaggcagtaagttccggaactcagcctgttcgtcttccactaacattgaaattacatttgttacagtagttctgagagggacttgtgcaaaaccaaacagctgttgtataataactaaaaaggaaattagtatgctattaagtagaaagtaggctattaccaactgaactaacagaagtaaaccaaaatacatatgatcttgcagtgcaggaaacaagcctcctagttagtgtgatttattttgaacaatgtcaataggccctttgtgaggcaagcaagggggaaaattaaaaggcagttgtcatatgcactgtggacaagtcataagcaatgcagccaccaacgttgtaacagaaagctgtttcagtcagcaca

SEQ ID NO: 69252 - DNA, 1049 bp, Homo sapiens
tgaaggagtacttcattttcttcatatctttcaaatgtttttattgctggcacaactgcctatttaatgtaactaatttggggggaaaatattaagtcatagaatattaaaatttgtgaggaacctttcggagccatttggagtggcccaagtttagtgtaacagccagctttacatcacagaactactgctgtcagcccaactcatctttcactatactagtagttctcaaccgggcagcatatcttaatgggattttaataacagattctgtctcgttcatcattgtattccaactatctagcatacaggaggtattcagtaaatgtttgaatgaatgaaacaaatttaaggtataaaaatatttttttctttcgaagatagagataaaaataattttatggaaaatttataattgtatttataattttgatctaaagaaacatttgtaaagatataatttgttaatcacttttcagacactggcttcatgtcctattgaccgtaaaccttttcaggcagtgtttaaattcagtgcattggaaggttatgttaaggtaagtctttttattctgcaacatgaattatataaaaattaattgaagctgtttgactttgatttccagtttgtgtatatttgaaaattgttcaacttaaggtttaatatgttattttaatcctccttagcatgataaatttatacctttcaactaatatacttaaattctgaaccttttattcatttgccccctaaagagggcatatccataatgatcaccttgtagtataccacaaaatgtattagatctctgataatctgaaggacgttttgtactaaggcttaattataaaatacttaacattttagaatatcttgaatgcgaggacttcttcccatatttcaaagaatttaattggctagcactttgaatacatgttttccattgaaaaaatgtttgaaatgaagtattagattcaaagaccaactcccacaaaaccttaagtccaaaataactgaaaactgtgttttcctgaaaaacaataatttt

SEQ ID NO: 69253 - DNA, 1043 bp, Homo sapiens
aggaattatttattcccataaaaaccttagaggtaagttattttttctcattttcacaaataaggttactgaggcacagagagactgtaacttgctcgagtttattaaaaagatacgaaagtagcacagtaaattcatggcctctatacatcttagtttttacgaaaaaacaaattttcatttattaccacataacctttttttaatgtttctctaaatttacctttaaaataggaataaaaaacattttgaagcttttgtaaaaataggaagcactagaaatattacacttttaattttatttatctatgtttcagagatgggatctcactctgttgcctaggctgcagtacagtggtgtgatcatggcttactacagcctcgaactcctaggctcaagggatcctcctgccttggcctctcaaagtgttggcattacaggcatgcaccaccatgctcagccagatttcaacttttaaatatttttgaaaaccataaatgtagcattaatataatctcttaagaaatttcatacagggtatgccactgggataaacagcaatggttatgatgttaagttcttcgaactagacaatgcattattaaaaaatatatgaacttctttgttgctgaagcaaaccttcttaaggtcaagttttctatagggaaagtaatagcctcctaaatccatagtacttaaaagtaggctgaactggcttcttccagtctgaaccaatttaatatagtaaggtcacatttcctaattcagatgtggtaaagcttttttcccattgaagcccacttaaaagagaaagaaaatagtaactcagcccatattttggctgctcccaaagtgacttgtgagctttgtgaaaatgtgttaaatgatcaaggaccatacacaatctgctctacttttacttgtataagcatgtcttgatacgtggtaaaacccagaaaggcaaagatcacattttttacataggaataatatatctagtttccattactatctttgctctttgagactattgctattagat

SEQ ID NO: 69254 - DNA, 1028 bp, Homo sapiens
tctttttttcatcattataaattaagctccatcctctcatttccctcagtcttcttccatctaaaagcaaagtttacagtttacttcggatttcaggatcaggaataagtgtcttcagccttctaacaggccatgccttatgcctaggctgtcatacacattctaacatttaatttcatttaattcactatgttaatatttatttgctatacaagacaaggattctaaacttacgatttttaagtacgtcaagggatagcctgacgttaaaatctttttaaaaaattggtttgtggtgtacaattttatgcatgttcacttctttttttttttttatttgagacagagtctcagtctgtcacccaggctctagtgcagtggaaccatctcggctcactgcaacttctgcctcccaggccaagcgattcttgtgccacagctcctgagaaatctgcataagagaacagtacaatttgcagttaggatcatctttctagatttctgtatctttcaaaatttctgtgctttctgagatttgtacccaaggttcactgaaatatgattcagaaggaatatcaagcaccaaaaaaggactcatttatttactttcaccttaatattttaggcattgaacacattcttaaaaacactggtctgtaagaaactggtgttttgaaaaattaaagtgtgtcgtagtctagtatatttattttggccacatagatcaaagttagtttcagtcttttcaagctctaaaattttggttctgtggttatttaaacaaaagctatgtaaggactttaaagtgattaagtaaaaagtctttgggtatgtcagaatcctctttacttagggcaaaatgtttcagggtgaacctgtggtagccttcatggcccatagcctaattgcctgcccttagggacactagaacaaattgaaattaatcatgtccactatgattatatttagtttcaaggaattcatagatggtaaacctgttgatttataaaataatgatgattatatag

SEQ ID NO: 69255 - DNA, 2296 bp, Homo sapiens
tgggagtttaaagtagtacaaatcctaaggagaataatttgttaatacctattcataatacaaatgtatacacacattactctagcagttccatttttaggaacttacactacagatatacttttaaaaatgtgaaataactaaatttttattgcaacattgtcatagccaaaagttgaaaacatgtgaatgtccatcaatagatttgaataaagaaaaaagcagactagtgtgtatagtattcttgcatttgtgtaaagaaaggaatgtggaagagtttgtattagcatttgtttttctgtacattaaaaattcctaggaagaacacaaaagaaatttaacagttgttacttattggattggttggaactggatggggataaatttgaatgagaaatttgctcttaaatttttgatccgtgtgaatattactcactttaaatttaattaatgaaaagtttgtttcagtcccccgttaaaaaaatttaagaaagtaaatgttgggcacgttgggctcaagcagtatgtttgctataatttatctaagatctatttgctttatagtaggagggtcctttagagtatctaatccactatactcctagaaacacaagatttttggtctggagaacttgaaagcacatatggctgttttactttaacaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggtaagtctgacacattaatgtattttaatttcctagcatgatttcatttcacctaaagagttgatactgcctttcataaattatttcacagtaatgtattttcttcctactttggacaaatttccttgtattattcaaattctgtcagtcattttcttctaattttcttttatcaggctttgattttgcaaataatattttaaatgcatacttttttaaaaaaagttaataaccttataggaagaacagatcaaactttttttctggtagaaatgcagtaattaatttttcagtgtacttgactctgtgcttaataggataatatctgtttaccactaataacaccttctgtctgctttttgttttatatttttcagggacttttcacataggttatttgatttcttctttatatcagccttgtggaataaccagagcagatacgatagtgtccttccattttacagatgaggaaacttggattttatgttctatgacttggtcaagatctcatagtttaagaggcagaagtgaatttagaactgattttctaattcctgtttttaatttagtgtggactaatttcagagtctgaattagagatattaccgtcatagacagtgaataagaaacaagacattcgtgacttttaatgtattatgttgactcaatttgggccaaatactttgaagtaaatattaatttaatataagccttattgttatgaaatgttaagtaaaaaattattgttcatattatgctatattttctaagttaatatttgtcagtctgtaaaaattagtaaagaagataatatcttaaaaatattttaacattagctgcattccaattgttaatgttcttaaatatgttggaattaattgcatattacataattggggttttcaaagcgctatgttttgcttaaattttcattaatagtgtggaaaggagaatgtaactgtatagtgactctggctgagttctcaaaagaaggaagagaagatttgttatacaaattgaattaataatagtatacatataaactattttaatttagtaaaacctaaactggtctttaacaagaagtgacaggataggtgaaaatgtattttggggaaaagtattttgagttttgctgaattaatatggttggtaaatctctctctgtgtaggatcactgtttaatgaaataatgcatattttttttctgccacccaaataaagatttttatctgtgttgaatttagtgcacatggttgctttgtggttaaatttttttagagattttgctttgggtaaagaaataatattgttggatgggtggaaggtttcaatacagtgcttttttataagattgtatttggtgaccacataattgtgaatttcaacaacttaatcggagtatatgttttgctctaagaaaattataatgtgtatgtaataagtagataatggttctccatcctttct

SEQ ID NO: 69256 - DNA, 1053 bp, Homo sapiens
tctcactgtgtcccccaggctggagtgcagtggcgcgatctgggctcactgcaagctttgcctcccaggttcacgccattctcctgcctcaacctcccgagcagctgggactacaggcacctgccaccacgcccggctaattttttgtgtttttagtagagacagggtttcaccgtgttagccaggatggtctcgatctcctgaacttgtgatccgcccgcctcggcctcccaaagtgctgggattacaggcgtgagccaccgtgcacggccaaggcttttccgttcaataagactgtgcattttgatagcaaggagtataaaagagtactggattatccacaaactggcttggctcgtactgtgttcttttatgtgtaaaataatttcttacagtttaggatttttttttaattgatattattgggagaaggcaaacataaaattctctattataatttatcttataggaaacccttttccaaagagaaatgaagaagaaaactgtatgtaccctaaatatgggagataagaagtatgaagacatggaaggtaacttttcatttttataaagtttgtttgttgaaagcaaaacagttgtttccaaactgtccacttgtatacatttcagaatacacaggagttttttgttattgttgttcttaaattccaaaataagctgcctaagtatacacatttttttcttcccatatcttattttcgactgatcaagttttttgatttgttaaattgtttacttttcccttttttcttaaaggtttactctctactggtttaggaattactgtttatgtttttgtccctgtctttttaaaaaagaaaaaaagttagcgttggtactgtcctctgcttctaaagctaatttaattttcactaccaacagaagaagaacccaagaatgctttaactctgatcatcctaatctcaatgtataggttatagttccattatttgagttcttttatttcagacaccaccagttagatgatgttttatgcaatgtttgcttgagtttatttcctcttcatttatt

SEQ ID NO: 69257 - DNA, 1036 bp, Homo sapiens
tctttctttaaaatccagtttgataatctcttttaattggtgtgcacgattatttacattatttacatttaatataataatgtttgttcctctattttcttccttttttgggaggtatggggagagacaaggtctcactctgtcccctggctggaatgctatgggatggccatagttccctgcaaccttaacctcctgggctcaagtaatcctcctgccttagcctccagagtacctagtactacaggcatgccaccacactcggctaattttttaaatttttgttagagataggtgaacagtctagagttaatctgtaactagaataacttggggaaatgagataaaaaacaaaaacgtatttattcaaggatgacggattatatttattcctcagaaaatgggagaatgatgtttcggtttttggatctttttgggagacaggaatctcagagctgtaaggggctatttgtttagagattattttgatacaactttaagggacttggattaatatcagggttatttctttggcatggatttgtaagactgttctctacatcatcacatcatttagaatagtttgttttagggatgagttcattcatcgtttttgactcttcatccctgtttcctttctcattaacatgtcttactgatatacttttatggtgtcgaacaaatcatatcctgtgttagtcatggtgaacatagcagaagactggccagttagaaatttcacttgaaaaggtagttggcagtttgtagcatttataataagattacatttaggtgataatccgaatatcactcaatctctaacagcattattttggtctgagttgtctcttccaaaaaccaactatatatactctttgacaatatttctttattttgttaatttataaatcacctgccctgtttccctaaaacaaactattctaaatgatgtgatatattaggttatgtcctaagacattgataactagtatcttactaatatcagtttagtttttcctattagtgtattttggga

SEQ ID NO: 69258 - DNA, 1011 bp, Homo sapiens
cggtgttttaattttttaaatgtatcgtgttctggtattttgaggattaaatgtggaaaggcatgccagaatgtgtagttcattacgtagtatattgtaggcattcactctacccatagttctgaactccaggtttgttgatatctatgtgtctattaggtctgtgccctaggggagcttagtcctaatcaggccttcttttttgatatctagtcttctttccattttctcctaactagtttctcgtactttccatctctccaccactgccacctttctgctactacattaagctcaaaatccccaatttaaacatcttataaaccactttcaaaacaaataaatgggagagagatagacttgaagtccacctaaggaaacacaacgtaagtcctaattggacttaagaacattaactttttgcactttattatcattatttttctttacttgcctcagtcgttagttactcccccactggtacatttaaaaaaatgtcttagaaactctttgcctatttctcacatttggcacttggcatatgctatcttgttcatcttctgtatcctatgtctccaagtctactccttgtaccgggaagtgatacagtatcttaatccgtctttatattccaataccaggctcagtaccctgaccacagtagttatttagcagcttaaagtaaaccaaaacagaagtacaaacatgaaagacagcggccaaaacaacactgttataaaaattctctgggatcaatgaaacagtctacaaatgataggttttgtttggtttgttttgagacacagtctcattctgtcacccaggctggagtgcagtggtacaatctcggttcactgtaacctttgcttcccaagttcaagcaattctcctgcctcagtctcctgagtagctaggattacaggcgtgtaccactacacccggctaatttttgtatttttagtagaaacggtttcaccatgttggtcaggctgatctcgaactcctgacctc

SEQ ID NO: 69259 - DNA, 1063 bp, Homo sapiens
gtcatggagaaaattttacggataattttttaattttttctgttaataccttcatgtggtaatagggctagtgtgttaagatcgaaacttttcaggagttacttagctctctatcgtcctttggcaccaactagagcttagacagttttctggaaaacctgtgcttttattcagcagagataggatgaatcagtgcagttacatgatactgttgattcatcatcagtaacatcttttagtaatcagaaaatacagtactatactacccatcaacttaatactgaacttttaaagtatatcagagatagttgtagcaccttaattaaagagagtagcaggcataaaagtaataaaaagaaagtcaactgtagaataattttcattgtaacttccctttagcaagccctgctatcacctgcttttgtcttttaagatgtaaattgtaccttgacttaccttgcccagtgaaataaacttaaaatccagatttttaattatactctgtcccccaaaataagttaataaccttgcaccttgtcttgcttctgagcagtaataactgttagtagtgctgagtagagcccagagttaaaatatccagtatcattctcttgctattcccaaaactcatctttgcattgtatttttttaagttgtgtctatgaacttaatgtatgaaatcctagtacatagacacataaaaattcaatacataacgtaaaaacacaaccactattttgctttcaaaaatatcttcctaaaaagtcactgtgacctttgctgatctacagtctttaacactccatagccagagtgatcctgataaaatgtcaggtcatgtaacttcttttctcaaatggcttcccttctcagtcatagtaaattccatactcctatggtctacaaggctctatgatttaagtctcttcttcctctctgacttcatctcctcaccctttctccaatctcctttcccctacgctgttgtggtcttctctaactactgtgtataaaacaacagccttcccccgatattttgtatctgtttttatgctagattttt

SEQ ID NO: 69260 - DNA, 1049 bp, Homo sapiens
acacatataccagagcacaagagcttgcttattctaagtattttaacgcctaagaaaggggtctctatagatgtttgattgtaggagaatgacagtaagcttgacaaggcaggagatttctgaacccttctactacttatttacttatatgtgctgattgtgggtaaaatgagttaggagaaaacttggcttcagatctcttttttattttaaaccgtatacctacattacctacatctaaatgtacagtagcagattcctttaagtacccctgaaaatttgaaaataatactacctaattttcaaatgaggagtaattaggcaatcacatgactgaattaatatttcagtttatgttttctttgtatttggcaaaacaaagctggttttttttgtgtatgcagatttatgttttctttccctttggtactcttttattaccttgaaaaagaagactcatactgtatatttgtggaaaaaatatttttaaacttggaaccttagtcctttcctttttttattttgctcctatcggtctgttaagtgatttaattcttatacttatcactggactgaatccaaagtactgggcctggcctgggaaattgctttcatgattgaagaggtataagttattgtataaaataagcaacctacaaaaaggaagaagtaatttttttacataccaaagaggagttctgacttcgtatcagaggcggggcagagaatggtcccctttaagaatgtcaccatcattatcccccgttgctttctacaggcaatgacatgtgaccatcaggacaatgcatccttggcgatatctattcaggattctagtttgaaagagaactgacacaactagcaactcacggatctggtaggaaagacacctaagcagatgtggaatggactgaaacaagaaagctaacaaaatcaaggatttcattcaggcttaagagttcttcccagtgtgagagtggtggtctcattaatattcatgccaaatcttgattgtactaagctcccaccacttataaggacactcaaac

SEQ ID NO: 69261 - DNA, 1045 bp, Homo sapiens
aacaaatgaaacaatacaaagcatttaattaaacaatataaggcattcattacctccccccacccccttcctccatgcccacttccccaaggaacagctgaacagcctggttaaatgatgtaaaaaatattttgctaacatttctcattactttatggctaaattggcttttattagctggtttggagcttaactatatttccttccacactttctccatcaaacacagaacacccacaagggttttatttgcttacttttcatttgcttcactttggtaaatatggaatcattctactcacattattcagcaactttctttttttttttaatttagccatctacccaaagatatctctcttgctcaatgaatatagatctgatacatttttaaataactgcataatattgcatatagtggaattcattcgatcatttccctattgtagaacattcagtttgtttttattccttttttccctcccaatacaaacaatgctttaatgaccactttcttgtgtgtatcctgaattttgtgtgtgtttatttttatgggacagacttctaagtaagtatttgttgagtcaattactatgtggactttaaatcttaatagacaatgttaattttatttcaaaaagctcctagtaattcatacaccagtaatgcatgacagcatgtatttcagtcagatttattttttaaatatatctatctttctctttagacagtgaatcccttgaaagcttctctgacattaaatgccatcactttttaaaggctttgctaatctgatggctgaaagatgatacaatttaaattttcccggatatctgggaaattaaataacatttcttatgtttgttggactttttgagttcctgttctgtcaattttctcttcatatactttgcccatcttcctatcagattttttatttgtcttactattttgtagaagccctttatttctcaaatgtaatataaatattttttccagtctataatttttatttttattttgtttcattttcatgtagtcaagt

SEQ ID NO: 69262 - DNA, 6823 bp, Homo sapiens
tctattttgcttttgtatgttttttttccactttttcaaacagaaatgtttgcttgccagtgataagctaagttggtaggtaatgaataacaaaatgacctggatattttctaaggcctttattcccccttggttgtaatcttagtttgagagaagccataaggatacccagttatttgtagaatggatacatacacttgaggtgaccatgaagtcaaagaatgggacatagaggactactctgcttagctagttttttttttttcctattttcccatccttgcagaatcagattcataaaattttagaaagattctcacagttcagccatggttgtgacaaactctgaataccagaggacacaaagggagaggaaaaactgttctattttttttccccaggtacatgtggaaaaattttgctgcactgaaaataacccttgcctttctcttgctccaggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgctggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcatagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcaggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaatatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatctgcactgaaatagaagtctctaggatctgcatataaacaataaatgtttcctagaaattagtggttttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagtatttaaaaatgttgtgtttgttcttttgcaatgcaatactaaaatggggcagttgtgtactatatacactattcaggattgctggagaagggttatacatatttgtcagtgttctagatcatagaaggttatatatttaagcaccctaacgtaaatatttttaaaaatacttctgatagaaatctatctggtctgaaacatataccacatttctccattcttcataatcagagtagattcaccataatattttcttttttaagtcaagtttacctttataagtattaatttctgccctgtgttgtaggaaggagttgagtcttcctctacccacattgctgccacctataaaagaa

SEQ ID NO: 69263 - DNA, 2265 bp, Homo sapiens
atgaagagagaatataaaaagaacagaaatgaacattcaagtcttagataaaccaaagacagaaattacaccccccaacaagaaaactctactactcataaataaaaatactttccctcttaagtcaagcccccgtacttccaaaactgttaagctatctataaattcactaggcattacaaaacatttcatgaattcctgtgcaccaataaatcagttactctgcagagaaatgtcaatgttggcatgctgtaggcacttacagaatctttgttttcttttcttgcaggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggtatggcttcatgactttgtgcttgtcattctacagtagctgtttgcagggaaattttcacaatagcaatgctaaactttctcttttgtcttattttacaggagttacatctgctaacatgcttattttcattcttccttcatctctttatttaaaaatcacagaccaggatggagataaaggaactcaaagaatttgggtatgtctcttgccagccactctaacttttctgattagttttccatttaaatttacaaaataaatagtccacctctctatcaagactactttcagttgccttgaaaggaggcagaagccctgtagctttgctacttgggagatatttaaaatatcatatcagaatcttctcccatccctccaaatatcttttctggttttactctttttttttgagatggagtctcactctgtcgcccaggctggagtgcagtggccagatctcagctcactgtaagctccgcctcccgggttcatgccattcttctgcctcagagagtagctgggactacaggcgcccgccaccatgcctggctaattttttttcttttttcttttttcttttttgtatttttagtagagacggggtttcaccatgttagccaggatggtctgtatctcctgacctcatgatccgtctgcctcggcctcccacagtgctgggattacaggcatgagccatcgcgcccggccctctggttttactgttattgtgcctcagcttttgttctgatccagggcatggccagtcagaagaatggacattcatcctcctgtgtctctataggacagtgtctagtcttcagcaagagaggaagtgacgagggactcacagatgttatgcagtccactgtttccatatgatttctagtcatgtaactcctccctacagcccagggaacatgcaatgccttaattaaaatgtctgagttagcttaaatagtcttttttattatttgacagatatgctttggaacaacagacctggattcaaaaactacctttctatattgggattcttgtttccaggtctggtgaagttcaagggcatcttgaacgtggtgcacttggagacagtgagggaagcaggggtgaagtggctgctacctgagtcccttctggagctccattttgcttggtcttggagaaggcttctcagctgccctcccagctagtgtaagcactgcaattgtacctgttacctgagtcaacagatccagatgagaggtgtaggcaggagggtcatctctgtgcatttaggaaaagcagcactgatgctagtagagcatccagttccccaacatgatcacccctgaagccttaattcccaaatccttccaagccttatctgtaggggcttaatgaggacagagaggaagaaacagtcactctggcacaacaggacaatatattcagattaaatctgaaaatggtggaggcctgctgcccatgaattctgagcctctccaaccctggtcccataatgaaactagtagtagggtcttccaaatggcattagacaagggttccatctgtgtaaggaccactgggagttagactggacccaggatggtatgccatgtgcagccatgtcaacccccaatttgctcctctccttccttagctctttctcttcctccagtttccagtccagccctgttggctctcagaatgcatcatccttctccctgcagcgctctcactgaacatgctcaagcgcaaggaacttataatcttgtgttctctggattctggatttagtaatctgtattagtctgttctcacactgctaataaagaaatacctgaggttgctt

SEQ ID NO: 69264 - DNA, 1123 bp, Homo sapiens
tcagcttttagttttagtttttaattttctcaagcgtatacttctcaatttttctttatttatttttttttttttgagacagagtctccctctgtcacccaggctgtagtgctatggtgtgatctcagctcactgcagtctcaacttcccagggtcaagcaatcctcccacctcagcctctcaggtagctggaactacaggcacatgccccatgcccagctaacttttgtattttctgtagacacagagtttcaccatgttgcccaggctggtcttgaactcctgagctcaggtgatctgcctgcctcagcctcccaaagtgctgggattataggcgtgagccaccgcgcggggcctacttctccgtttttcttgttttccatacttctatggcatcctagattccttgacataaccaaatgttatgactatctgtggtctgttatttattgaatacaagtgttgcagattaattgtttgggcagttaaagaaacttagagggtcatcccaaccccagagtgaacttgacctgagagatggagcccttcatcattccagctgtgatctcttgggcacttgctgcgctggagacctacagacttccaggtgcatccctgaggccacccaatgggaaaatcagaacctgaaacagcagctttagagacagaacacctgaggtcaagttccagctctgccactaatctctggagctaggagaacagcattgatttttttctgccttttttcctttgcccagctagtgtggagataatatcaagcacaaatattaaaaaaatgctgtctgcccttccgatgagaactcgatattcttttaaaagaatggggaagaacgctaacgggagtgtagttccacagatctcaccctcaataccaattcagtataagagaggttattttcaactggcataactgccaggggtaatttcagctgttcagatcttccctaacctgacagaagcaaagttaaattagtattcttcaatgttaacactggtgcttaaattcagtcatatgatttttaatttttaacatttatttgtttttagccgatcacagaaaaaaatgcagatggtttcaaacatctcctttttcgccatgttt

SEQ ID NO: 69265 - DNA, 1166 bp, Homo sapiens
cctggcatagtgcatcagcagagttagggcataagataggttagttttcacttctttttgcataggaagttagattgagtgtgagagtttcaaagagccttatctaagaaaactaaatagatcgcgatctttctccttctctctgattgtaaggatatagccaaagtagtgcaatatggaacagattttcttttcagagggtatcttttaagtccgattccatgcacctgatgtagagcgaagagcagtaaactagaggtgggagtgctgggccagtcgcctgacctgttggagggagccaggagaacagccacagtctgcctactgcttgggattgctgtggggacccagcgagctatcctaggaagagtgccatgtaactggctcatgctgtataaacagggggtgttgtatacctggagtatataaaatacaccataggtgagccaaatccgaagtccctctgtgacaagtggctaatggctcgagctagacaagctgtcttagaaaagctgcttctactttagagatcaaaacctccctaataaccgaataatccagggattctgaagagctgtcagataaaaagacagctcagaaatactggagctatgtcctttttatggtaaaagtgtttttcctaatgtctattcttttctctcaaatagaccgtgtatgctttacccaccattgcatttgcatttgtttgccacccgtcagtcctgccaatttacagtgagcttaaagagtaagaaatttgtttaattttttatcttaatcgttttacatcccctcattaataggcaagtatgcaattaaaataaacggacttgtctaatgaacgtcagcggattcatcacccagcttcaacatttactcacattgtgccattcttaaacaagcattgtattttaagaaacaagaaagcaagaaaaatcagaaacttgcagtattttggggggccataaacataaaaagtagccaaccatgtgggctttttcattaatttggtttttcaaatattgtatcaccgaggaaagtttaagtatttgtgttgctttccattacgtatgcgtattttgcaagtgggtgataatcttcagatttatctgtaaactgctaaatacatcgtctctgatttgcctgtgggtttgggtgaaaaggct

SEQ ID NO: 69266 - DNA, 1311 bp, Homo sapiens
ttggagatctcccaggcattctaaggggagctactaaagagccccagatactcaatttaccactagaaattcgcttcatctactctctgtcatctggggagaaaagtattataactgacattcagtatgcacacaataagtgcataataaagagctattgaggggatcaaggagtaaatgggtttgcccataggactccatcagggtccaccaacacagacttacagcaaaaattggaaggctcttttctgctggattctgggaatctgtgttctctagtgtgccagggagagttggaatcaaaacacgtaatataatgtttctattcagagccccatttttttgccaaataaagtagcactgtcaaataataaatcttgtattcacttgggcatgtatgtttattattggatctctaaaatatgcttcaaataatgcactgaaataagtgaggtgatgaattttgaaataataacagtttatgatgggtagctccaaaatttttaaaaatggaaaaaaatgaaataatttattttttacttttttttaaagggtatcttggctatactagtggattttccttgagctgtatggtttttttcctaattgtggtaagtgctgattgcaatggttggtttggttttgtgatagtacaatggcatgtaataattattcattggctttactaaagtccatattgcttctactatacttcttaataccaggttatttacaagaaatttcaaattccctgcattgttccagagctaaattcaacaataagtgctaattcaacaaatgctgacacgtgtacgccaaaatatgttaccttcaattcaaaggtaagtttcctgatcctttgcagatgaaacaagcatttttattaaggacattctatttctcatgcttgtaattgcactggtttgaatgtattagttctcaaaagaacacatgataccattgcttccagattacacatctatgtagagatccttgagaaatatacaaatattatattttacactctctcttaccattaagcattctctgtgaaaatcccattctggataattgtctcagctttttctgtgtagagtgctaggtgatacttcaaaaacagactaacaacatccttagctcccttcttctggcgatgacagaaaggaatactgcagacttcctcaggttgcacagttgaaatatagatgccaccacaaactggcacttaaaaaactctcatactattaaaatattgttgatacaatgggaaacagaggattatggagtcagtcaggcttggatttgaatcct

SEQ ID NO: 69267 - DNA, 2259 bp, Homo sapiens
ttgctaaaatggcacagggaaagtaaagcagagacagcagtcacttatttaaagccacaaatcctgctagagtagctgaagttgcctttgtgtcttactgacagttggtctaagaacgggctgataactttttatgtagcttgcaacataagccttcgtatcttctttctaaaaatgttctcattttccttcagcaatgctgagctacctcttcatcgtaaaaaatgaactaccctctgccataaagtttctaatgggaaaggaagagacattttcgtaagttatagaccatttttttatgatataactaaaatgtttttaatttaaatatgggccaatcaaaattcttgcttgtgaatattgcagaaagtttttcctaggctgcgttttgtttgtttgttgtttcaacaataaatttctttggggctatataaaggaaaaaagcaggagagccatttgcatatgcacatttgaaaagtagatttgtctgtcatgctatgagcggtagatactgcattttccccagagcctgaaatctatatctagtttctgtgaaatagaacagatatgcagtatttttaacacaaaagtggaacgtgcaacaaaaattaagaccctagcctcttacttaaagaagggacatagcattttgggggcgaaatttacatgagccaacctcattaaagatgtagataaccctggaaaatgttgcagctacatttggcacaattgtgttttgactccctcttgtttaacagttcttgtcagtcttagtttctctgttttctttcaagggagaatcgtagaagccagagtctctagtgttctcaggattcaaggtcaaatccaagggatcagggagagagaaatgtctacctgtagtgacttgtttctcactgatactagcccagcaaaacaaaaaggagctttctctttaaataattgataggacaagttgtaatctgacagaatgaaatgtgtgcattcagctttgaaaccatgtaaataattcaaaagaatgccacatttagccaatgggaaaaaaaaaaaccaatattccctcttccattacaggggagtgaagctgtagtatataagtaggggctgggttaaagtgtttggataagacctgaataatgattttaaaaattaatgcatatagtaaaaattaataaaaatatatatcatgatatcatgaaattttacattggaggggaaaaaagtcactttctaaaaaaatataacctaatcacttaaatgcctttcagagcctggtacgtggatggccgcgttctggtggtgatagttacctttggcataattctccctctgtgtctcttgaagaacttaggtaaggacagattttgcttttatcatattctgcagtgcccaagtgaatcagaaactgaataaaaatggacagtgttgccctctgcttcccctctgcatgcactcaaagattaagtacatgataaattgcaagtattaatcggtcccaactttaatatgggataaaaataacagtcagtatgtgacctcctaaacaatccctctactgagctgtggaggggagaagggaggtcctggggccaggacagacagggctattttcagtagtacaacttatatgctactctaagaaaagtccagaaaatgcaattctcttcatacgaagtcttaaataccctcattatttagataaatacattttcaaatctaatatggagacagaaagctgcctagatttatacccacaagtattataaatttagagagtctgaccagcctcaattatttctcttcgaagtgggagagagaaatcaaaagtcagaaatggcggataatctccaagtcatatccatttggctttgatctactacttgtttttatgcttgtatttggagacaaggatgcctgatgttaagggaatttcatacattgaataatgtgaccagactgccatctagtcaaaaacctataaaatgtatttactttaattctgggctaattcaaacagaagtttggataaaagctctccaaacaataattatgagccttagttttttgttttgttttggatacaaaacaaaacagctctgtagttgttctgtgaggtttataaatagatttttttaactacttaattttctggtttctgcctctgtgttttctgtacctatagaggtagctcttttcagttaagtagagaaaagctcttcccctgggttgaaaataatgcagtcccgagaggctacttaa

SEQ ID NO: 69268 - DNA, 1492 bp, Homo sapiens
aggttccaaaatttggatactattaacaaatagtgttaaccatacaaataaacctttgcccttctaaactgtaatgccagaatatattcttttctagatattacaataagatttattttctttgctttagggtacttttgacttcagtgacattgctgtctatatattcaataaacctcctattgatctgttcaaaagaaacaggtaagctgaggacgtgtttgattttgttaaaaccagggtgaattatttttatggtagcattgtggaacaatgatgttctctctgtacagcaatttgattattaaaaagaaagactattttgacctagagtgattggaagacctatagtagtatttatctagagaaacagttgcagcaaaatataaattaaattgtcatggacaatgagaaaataatgttgtcacttaaagtgaaccctcaattatacctgtttttctggtttaaaatgacttcattttaaaagcttgtttttccttaggtctttataaatccagaacaaagatcccatgtttttatattataacttccaaggttttaaaagtaaacagacctgtcattctcttgtgcatattccaaggagaaagtgttactcctgaggcaatgtgggagtgagcaagctatgaagagacttcaagtactctgggcagtgtaatacctgaagtgtttattttctatttctgggacactggattatgtttgtaattctttgacttttacattaactaaaaccacattggtcaactattattgtatatacatgactccatttaactggaacattttataataaattgaggagctaaccattgtctagtttaaacaccagtcttatgagagattaaacaaaggtttaattatagcctgtcccatattgctctccgtgaaccttttgaaaacatgaactgaacagttataaagaaatataaacactttttaaaaagtgaatgctttagagtttcagtatttattgagatgagctagtcgaacactttcaaattttgctacagacaaattatgcttttgacagattagtcttctgctctcttttgtgagttgcatgtatttgaactacattttatgaataattaggttttgtatgtcgtggctattaaaatgtttctaagcttgttattacatttagaacgtggaggcattgatgggatgttattaagataattccttgtttgcctaatcagttcaggtcattaattcaaaaggaatctttttgtttcaactattaggatctttttaaatcaaatatgtattttaatggtgtacaccagacctgaagaaaaagatcacagaaggaatttcccctttgtaagatagaggtagttaaaaataagccttatgacctaataggttaattgtaatgctctggtagccaacttgaaaaaggagaaatgatggttgcatctcacattttaaaatgttaagaatttgttttgtaatgaggataccttaaccc

SEQ ID NO: 69269 - DNA, 1043 bp, Homo sapiens
gtgtttgttttgcctctgctgagctctgcccctcttttgtttgctggccagtttctggcagttcatctgttctgctgttgaccattctgtactcctggtttatctcctcatggttgccccgtatgcaggagaaacaaaacactgtaggatcatagacagctgaggagcagtcattctgcctggggccagggaaggcaactgaggagttggcatctgagctggggcctagagcagccttcaacaggtgtgctgggagggggaagggccaggaggaagcagcccacgcagagcgaacggcatgatgtgccaagtgcctctcaacagcacttggtggaaaaataattgcctttcatgactcaaacatagagtcaattgcagttatgtattgttctagggatatattttcccacatcaggaagtgagcggtttcatctggggactggattttttttcttcttttttaataaataggctttattttcaattatcatgtctgttttaaccaaatgtttcagaaatcatctatataatctcccacatcattttaactgcactttttcttgagaagggtgtgataatgacccagatgtactaaaacaaaaacatgagttcatcattcaaaaaagtcttttcattatacttgattgtcaaattttcccactggttaccaagtggtgcttattcatctaagaggaaccaggtgcaaaaaaagtgaattacattagtagcccaatatatagattttaaaatagccatgaagtaatagatgaaaagaaccctagacatcatttggcttgtatctttatattatgggcaaggaatccagagatgggaatgttaagcaagttgcccaaagtcaggtggtcattctcctaaggtcactgccagcctttccctccgcccctcccaccccattctcacactttctcacccggatgtaacagagagtgcaacatagactacaaaagccttctttcataatgttgttttaaagtcatctcaaccgaaatgctcccagagagctatttgggcttcgaattaca

SEQ ID NO: 69270 - DNA, 1024 bp, Homo sapiens
tgagttaaagagcacaatcttaaaatgagcaccctcaggactgttaggtaggagaggtgttagatttcaagtagatacaaataggtccagaaggtaaaatgaggacccaaggatagaagtagcgacagtgatttcagctgagcctcagttccaagcacagaacttttcagaaacagaatgggttgcataatatgtccccttttaaaagacactttgcagacctggatgcctgtgtgttggcatggagcatagaggtttcctgtcctgggtaaacatgctgtgctggactaggttctctctgaaagtctctccctgcttcaggagtctagaattctaagtttcttctcaggagactccaaaatttactagaatgtcctgaaccacatctttcataatgttgctgactcaaagactcttgaaggctcctgaccacattattcgcaattctaactctcttgccaccccttccccatgacccatgtacaattacatgctctagatcttctcctcaaagatgaacataagtctgaaatatcaacaccttggcagccctattatcaattgctgatctgtagtccccatgtaagtacgccttttttagcaaccagtttttgtcccagccatattaatacttgtggtcagtggttaacaatgttgaagcttaaattatatccagatgaaattttaaaaaggaatcacttgtgttcctctgtgttaacacaggaatcccagcatgtgtttctcttccaggaaaccataattatatgtacaaatatctacccggacaattaggggcataatcatgctctaaatagaagtgttcaaacaagtcaacaccttctctccagttattcctctttcttctttctcttagatgtcatggtttctgtgtctcaagacatttatgatttgatttttctaaccctttctaggttctattagagtcaattagacaacatattccttctttctaagaatctgaacaaggaggtatacttttctaaattttaatcctattaatgcc

SEQ ID NO: 69271 - DNA, 1075 bp, Homo sapiens
tcccactcattgtttttagaagttgagcagctattgctagtttatgagtcgtctgtgatgcatctgataagggggttctaagaattcaattctcttagccccagaaaggtaggggtgtgtgtgcgtgtgtgtgtgcgcgcacatgcgctagagtgtataccctgagttcactcagtcctatttatgctgagttgcctcaggtgccttggtcctatccaaggacagcagtgtgatctctgttttggtacagtgtatttttcttagcctgcaacagacaacttaactatactggctatggttttacagcattatttacctccatgattggtagaatgccttctctgctcactcatctggtttacagtaggccaggttggagttatcacagtagagcaggttaagtgtggtgcagagagttggattttcaaggttagcttgaacttttattactcacagagtggtagttggtttaattagaaaactactcctttgtgggccagttagttttgctttgttctctggccacagactttaccttatgtcaggcacatgatttcaaagatctgcatctatatcaggggtcagcaagggacagcctgcagaccaaagccacccgcagcctccttttgtgtggctggctaggtaagattgacttttaattttataaaggactttaaaaaagaaaagatagttgtaaagtgtacattgttccatgagatctttataacaaccctgttaattacccccattttatagataaagaaactgaaactgcctttgcaaaattataaccaaggaaattatgacagtgaaagaaatcagacctaaccaactctatcttgcttctaacccttaagctgtccttgttcattcctgggcataggccgaactaactttgggaaggaattcagttcatggtttgactgaaacaaaattggtaacagcccttttccaaaaagacccccttcttgcctggggtccagtctgcctttgcaggactaacaaattaactacacgattagaaattacagtttaggggtcatgcagcctctggctccaagagtctgaacctccc

SEQ ID NO: 69272 - DNA, 1036 bp, Homo sapiens
attttacaggaaattaatctctagaacacatctcatagtactaggtaagtatgatgtttattacactacacagaatctgataaagcaataaatgctttttatttttccataacttcttaacatgtattattatttttattttaataatgtagtccttaagttgaaaaccatgaaaaacaaaagtagaattcacgacacttctgagatatcagtttattattaacactgagtttgtgaacaatctctttgaaatgttaattgtgaaacaaaagtacaatgtgtgtaaaacaatagtttaaattttatttggttgattataataccagaccttttggattctttttttccattttctatctcatttgtgttgtggttgtgggagtgaaaaagataatttatctaaaaacagactttgaaaagtggcatgcaaggagacttttattagtaccaacgcatagagctactaggaagaataaatgagtggggtgtgtgtgtgtgtgtgtgtgtgtgtgaatgtgagagagaaagagagatggagagagtgatagtagtgcgtggtgcatagtacacactgtagatatttgttaaaatactacagttagtattaggtagtcactaaataatggctaacatttactgaacagtatctatatatgctacactatcttaatccccaccaacaacattatgaggtaggtattagccccattttacagataaagtaactgaggcttaataacttacctgtgatcacacattagaaagtaggggagccagcgtcccatccaggcttgcttgactctagagccagcgtgatctaaaacaccataccgcctttggtgatgccttcttcagacaccaaagttgcattattactctacaacttgagaaaaactttatttttatcaacggatgcttgcaagttagtacttaccttttactttccaatataatgtacctttaaaatcaccttataaaatcagccagtgttcctgaattatcttgctagtgttccaccaataaccatcccctttac

SEQ ID NO: 69273 - DNA, 2376 bp, Homo sapiens
agctgggtgtaggggcgggcacctgtaatcccagctactcaggaggctgaggcaggagaatcgattgaacccgggaggcagaggttgcagtgagccgagattgtgtccaacctgggggacagagcaagattccgtctcaaaaaaaaaaaaaaaaaaaaaaaaaggaaatccatgaccttcagtttgggaaatttttttacattattgtgttgatgaattcctattacccccagattttggaccttctagactagtcctctaatttttttaatctttcctttattttcatttctataacgtttcactgtaatttttgggatatgtcctcaatttttcccctctttattgaattttttatttctgttactatatttataggagcttaaaaactctaagaatgtttctttttaatattattttggttctgtttcatgatttcaatatcttctctgaggattctaatgatagttttttttctgcattatgaaaaatttaaaacatgaagtagagagaatagtagaaaaagatttgtatgtttccttccttctatggatggttgttttagtcagtcccccaccaagattgtcttgaagcaaatctcagctattttattatttcatccctaaatattttagtatatatctctaaaacataaggactcttttaactcaatatgtcatacctagaaacaagtcaacaacagttccctaatatcatcaaatatacaatcagtatttaaattgctttgattatgttatgtttttaaacatatgggttgttcaaatcagtactcagataaggttcacacagtgcaattggttgatatgtattttaagtcttttttaatttatattttcccatttctttccttttattctgtgccacttatttaagaaacagggccatttgtgtaaagttttccacaatctggattttgctgtttgtatccctgaggtacaagctgatttttgtttgttttggggtctttcaccttagactctttgcccagatgtcagatagttcctctttatctgctgtcttcaagaatggggggaaaacaaggctgatttgagcctggcgcacatgagtggggcttgttcgcaatagcttcacttaagatgctatttacttaagatgttcctttacttgggaaccaccagggtcatttgtctaagaccctcttctttggctgttcagatcacccagagaacagctcccaatcccctgttctgggggcctagacctcaccgccatctttctgggaaccaagtagggggaaagggctggaatgattatcccagcaggcatgtgttcactcagttcccaattttcattagagtatgcctcttgcccacaaattgtgcctagtctctcacctagaaacatatattgtatactttccagagaacatatattcagattgttgccaggataggggaggaccaaccagtcagctttatggagtaggacctggtctggggaatctagctatttcttgaaaaaagttcaacagatcctcactattttagctcaccccttccattatccccaactttcagtcatgccagcagtgccttttagagattctctgaggtaaactgagttggtcttggctttttccactgccgatttatggttcaggtctgtctgctttccagctttcaaaatttcattattgtctactattatattttatcctagcagctttacgccttaaaaaaaatctttttactgggatatcaagggagagggagtaagtccttgtattcaatctactattcctagaattcaattgatttttaactatactggctgagggataattgacctcctatctcatgacactttagtgtctgattaaagcggggaagtggaaaaatttacttttgtagttgaaggaagatttttcctggatgaaactattatagatcatttagttatttgtaagattcatggataacaagcgcaacacaccaagtcttcagctaaatctcatgaaggtagttgtacaaaggctcaaactttaagtttctcactaaacttaggactctcctacctcaggacaaggattcactctgtgactcttgtaaaaccagctgctcctacaactgctcaaagccaagaagcagttggcaggatcaagatatttcatctggtacagggctccattccagactcacattggccaacacaggaaaggagtccaagactgtccaggcttctttggaccagcagctgggaaggctccttagtgtctccctgaggctgggtgtggagccttctctgcagtcatctggaaacttgttggtgcgatttctttttcttggatgagtttgcagctcatttttttttaacctatccataatggctgtcatc

SEQ ID NO: 69274 - DNA, 2223 bp, Homo sapiens
gtgacttgcatatagcaggcgctgaaggaatgtctgacggtgaaacagttcttttcttttctgcaagggagagggaatttctatttaacaattttgtagtccaagaacctgagctcaaaagaaaacttgcctctagtatccttttaaataccaggtttatagtagtcttgatattatctaattttccacttagggaaaaactatacaaaaattaatttatgttgcatatagtgtttaaatttattattaaaatgattcaaaatgtatagctgtttttgacttacggttgtctttcatttcatctcaagatgagcacctgttattggcattgttttgtacaaggtagagtgcaggatataaaaatgaatgaggcaaagtgcctgcccttggggcacttatagtttatttggtaaaacgagaatatagacaactcataatggcaaaagaaaaaaaggtggggggagttggtggttgaatagggctgtaaactcttagagagctgattggtaactgttcatgtatgttttgatgagtaacatatcatttagtaaagatgtcaagcttcaaatcattatcataaggttaaatatattacgcatgtctttacagcaagtttatttctgatcgtgaaagtagaagaagtctcacaaacagccatttggaaaaaaagaagtgtgatgagtatgtaagtatcattataatgaagtatgcttatttttttaatcatataaattgggacaaatctttttaattcaagtagcatagtaccaaaagcataactacctgtattcaccaggatattcctcataccttatgtattttctcttgaaatccattcaaggaaataactagataactaagaatggattttcttgaattttacttccatattggttcctgagagtgcattaaaggctttggcttgatgaactttcttggggattattttgcttagtgtcaatgtttgtttctttgttcagattccaggtacaacctccttaggcatgtctgtttttaacctaagcaacgccattatgggcagtgggattttgggactcgcctttgccctggcaaacactggaatcctactttttctgtgagtattgacgtgccggtactttccattttaaaactgaactttttgtatgtttctgttattacatagaagaaatgtgaaatatttataaatagtttttttattaacttggctaagttacaagtacatactttgatatttattgcttgagtgattttccaaactgtacctaatgcttacaacaaagaggaaggagaaaatctttttattaatcaaaaatactgaaataagcatttgtgaaaaggattaaaacatttgaaaataactttttttggtatttttggagtctacctgtgactttaaatctcagttaaaatattaagaggtgtttaaccccagccagtcaccactttggcatttggattgctgtgaagcgtgtactacatcaaagggcaattacaaatttgtttgtaataaatattcaagaagcatagaaattttcagtgttttgaagatgagaaattagcatgtactttcccactgagattcaatgaaaagaaaatgggcaattttctttttaaataactttatctcaaactgttgaatgggactttctgcaaatgtatggagggcttatttttagttggaacaagattaagagagatgatagaatttgtactaagaaaattctcgcccagcctgattccctctcaaatgtcacacgagtgtcagtggtgaggtgagggagaaagcacttctccgaggatcttgccttttgttccctgacttgaaactcacgcttttcattggcctggctagatagtccttgttgccatgtccttttgacaggagcatcatttccttacaagcagtgaccgaaatggttactaatcctacaaactgtggatatcctttcaaaaaagacatcaaaaactgagataaaagaatattactgcccattccattactccaggaacagaaatgcccatccatgctgccctgtgttaggcattaattttgtgtgtgtgtaaattaacatgtcctttctaaaattaaaagactgtgtaagatggtgaattcgatacattgtcttccatattgtcagcctaattcagtgaacctaactctagcctcctctcttgatcactctgaatgcatctttctaagttgcctttccgcttgagctg

SEQ ID NO: 69275 - DNA, 2082 bp, Homo sapiens
tctgagcctcaatcccatccctttaagatggggataataataatacctttcctcatgggattgttggggaatgtttaatgcactattatctgtaggttaagaacataggctctgcacttagcctgcttatattcaaatcctgccacaacaggttagttagcccatttatgcctagtgttccattattggaacgctaagcttgtgggacttatttatatcctactgctcaaggtcattgccaaggtctaatttttcacacataaaaaattgcaacccctggcataaatgggttaatagtaatgtaacttaggtcaagttacttaatttttccaaactggggctaaaaataataccaaccacatataattattgtgaaaataaatgaggaaattcatgtaaagtacttggcacagtgtctggcaatagtaagcctcttagtatgagaaaagtctatcggtaaaaatgcagtcccctttctttggcaagcacttctttcttcttcacctcaagaagcaatgacattgctctaggttttggatgattgctggttattgccaccttaaatttggtgaaacattagtagattattctaggtgtacccagacaaatatgcttgtattttaatatttatctgctattgttctttctgtatacttattgctattatgacccaggaactatttaacaaaatttgagattttttcattaagatttgtttttaaaagaattcgaggcaactcttgtcactacaccctgaacccacttgtctttatatatcttttggagtttgtgggctaaatttttatcacttgagagcacccttgaaaagttatccctcttcttctatgttttctataccttagggaagaagattccataacttctttctgtattcaattttcatgtcagaaaattcttctcttgctttcatttctcctgttacaattaaagtctttttttcctattttcagtggaatttgtccatcaaataaggctttgcttacctctcagtcttctcttctctttagattcctgtttcttcaattctcccttttcatgttttccaatatctttgttacttgcttcttccctttcattttattctcctttttaatacaatgttagcatttcagagaaaggagtaggaaaggtcatttaagttcaaccactcatctcttttatgttatgaattctcagaggaaacagtataatctagtaagaacctgattaaaataggaagattatctttctgttgtacaactcatccttaattagattgttactgttgatttgtttctggttttaaataacagaacctctctgtttcttgcctctctgtttcttgcctctcttcacaatgtaccttagtataacagcttacatcattttttaaggctttgtctgttcagggtcacccaatcacccattgtggagtttgttttgttttgtttgttcacagagcaattggctacctaatggttaattaaattctgttttatgggtacagacacacccaatgagaactctttttttaataatattttatcatcctgagataacatgtcaaaggcaccttcttccatagcatatttaaagtcaataaagagaaatattacatcaactattttgccagaggtcgtgttttttaacaagcaagtgcatcttttaaatggtgagacagcagaaacttgtgatacgctgcttgacccagttattttgaatggaattttccattacaaaaagttagttagttttatgtattttttaaatgtatagaaatacaaagcaaacactttgggaggccgaggcgggcggatcacgaggtcaggagatcgataccatcctggctaacacggtgaaaccccgtctctactaaaaatacaaaaaattagccgggtacggtggcgggcgcctgtggtcccagctactcgggaggctgaggcaggagaatggcgtgaacccaggaggcggagcttgcagtgagccgagatagcgccactgcagtccggcctgggcgaaagacagagactccgtctcaacaaaaaaaaaaaaaaaagaaagaaagaaaaaaagaaatacaaa

SEQ ID NO: 69276 - DNA, 1086 bp, Homo sapiens
gataaagtatgtgattaaaagcccagcataggatttagctaccatcatttattaacacagatgttctccttttttcctcctttaaatgttcttaagaggttaagtccccaactcagacacttttcctcattattatccaagtacggtcaactgtgctaggtgatgtttcttactatggggctcaagtgtacttacttctttcatcttttttgagtaattcttaataataatacccatttcttgagtgccaggtattttacataagctaccacatatccttaataactgccatgcacaagtattcttctgcaagtgagaaaaatgtaaagtttccgtttacaaataaggaaactaaggttcagaggaagaaaataacttatccaagggtacacacaggtctgtctaaaatttgtgtatttttactctaccctcctccctctggttataatgcttgggcattggtaaaaagctagtctttaatagttctattaaatgctaccagggccattttatgtgctgtactcctggacagttcagtagtccctgctgacctccactgaacagtggaaggaattctcaccacaagtaggacattgtggttttataaaattatcaaagcaatccattatcaaagcaatccaaacctcaagggccttaaaggtgggagtcatttataatagtcagtttagaatctgaacttgatttttaaaagtgtcacttactaaaaatgtcaagtttttagatgattaccacttgcagtagatgggagaaacatctattctcacccgcaacttaggcaccttgcctggatgagctcacttccctataggctccaaccagggcaagcgttggtacagagggaggtctgttggcttttggttcctgtattgcaaatgcagtgtgatgagtttttgtttgtttgtttgtttttctttatttcccctccttctctgactcagttcatgactcttgcttcatttctcgctctaacacaattaaaaacaacatgttatagcatgaagctaataaagaaaaagacccttgccaattttattgaaggtccctactgggttatctggcttactg

SEQ ID NO: 69277 - DNA, 1549 bp, Homo sapiens
ggctgaggcaggagaatcgcttgaaccagggaagcagaggttgcagtgagccgagactgtgccattacactccagcctgggcaacaagagcgagactccatctcaaagaacaacaacaacactgcttcatatcataaaagggggtctctgttacctacagctaacatgatattcttataaacctgatcagtaagattatggggcatgattcactgtatagttaaaaatggaaggaaatctataaaaggcataaaatttagatacacctccataacttgatagacaaagattgctttaatgcatctagtagcaacatgtaaaattgtataatcagtaaattaactacttgtttatttgtggtaatttatttttaatcagtagcgtttcatatgtttagttatttttttattttgctatattttaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaataggtgagtatttttccactaacatttctatccagtgaaagaaatggctcgtggctcacacctgtaatcccatcactttgggaggccgaggtgggtggatcatttgaggtcaggaattcgagaccagcctgaccaacatggtgaaacccaccaacatggtgaaaccccgtctctactaaaaatacaaaaaattagccaggcatgtggtgcatgcctgtagtcccagctacttgggaggctgaggcaggagaatcgcttgaacctgagaggcggaggttgcagtgagccgagatcatgccactgcactacagcctggatgacagagtgaaactctgtctcagaaaaaaaaaaaaaaagtaaagaaaaagaaatggttttaaaaattattctggtttttagttattctgttgaattattcattactaaagttatgttccatttgaagatataatttgaatttcttatgtgacatctgttgggcatagtctgcaatagcaaatgaagcaaataggaaagtaatttattcatcttttaaaatctttcaattgagactaataaaaatgtatgaatacattgaaccccaaccaagctctgtgttatgaattaaacagactactggaatttcactgcatcccatatccaaatgtgtactacagtcatctgtacatattttaatcaagaaatggtcaaagttgcatttgctaatgaatctgtgttaaactacaagtgtgtcatccttataagcatcatttgtagtatggattttaaataataataatggttgagcccaaatgactctgtgaggaactataatagagacatagtacataaaagaaaaagagaaggaaagcgaccacaactgaggagagaagcaatggggaagaagtagagggtcagggtaggaagagtgctg

SEQ ID NO: 69278 - DNA, 1783 bp, Homo sapiens
tgaatatattgtctgcaggcaggtgatcatagctttctttttaaatttagtcctcatttttattgttaacatgtgtttactgtcaccatatactagacctttgagatgtatggtccttgtccccaaggaattgaaattgtaaataaaaagattactgaaatatgagcccccttgctataagccagtgagtaatctacacgaaactgctgtaagaattcatcacaggtaaacagtcaagcaggttctcaactggaacaattatgtccctctccctgcccccaggaggtatttggcaatgcctgcgttggtcattggagaaaggcatcacagaagagttggcttgaattttttaaaaaagcaagcaagctgggctttgaaagaaaggtcatacttaagttagcataggcttcatgggaaggtggagagggtgtgtccaggatcagggggatggtgtgaacaaagcagaaaactgcataagagtagacccattgcaggaatggaaaattagaaggaatatagtgggagcataaattaaagagaaagctgtctgaggttctagagattagacctcatcctgtagagggaacagttatgattggcaaggcagaaagaggaatgtgcaagactgtcttttcaggaagaatctgcctctataggtgggagagggcaagaagcaggaggtagcgtggcggagagtgactgtggcaaagttcaggctgtgaaactgtaaggaataagggaaaggaaaaggattttgtgaaggaatgttggcaggacttggcaactgattagatatgaggttgtatgaaagccatactcaagtttcaagtctgagtgacaaggagaaggtgcattatatctttaacagaaatagaatgctggcatgtgaggtcaggtgatgcgttctgcttcaggcatgtggaatctgaggtaatgataaacatcctaatggagcagtccagaaggcagcaggagtctgaaaagaatttatggaaatgtttctgagaaggaaagaacctgagagataacctctctttcatgccctctcattttacagatgaagaaacatgtgacatgttaagtggcatgatcatgatcaagttgtatttatgagggagatcctatttcataacgcaaaggaattctagttttataaagtgaaaaagactgggaagaaagatctgaaagatgcctttgtagaatgaaacttgacactacagccctgaagccctaaaaaggaaagaatttggaatatgtggagcaagaagagtcgaggcccaaagagctacttctacacagaaagttgggaggaggagggatctggcagaggagaccaagaaggtcttgggaggatgcagtgtggagttatttgggagaagtcagaaaacaggaacaatggtcacaataatttacaaaacccgggccagacgctgttctaagtgctgcacatggaccaagtcatggaatctttatgactgtatcagatgggtattgctttaagtccattttacagatgaggaaactaaggcaaagagaagttaaccttctttcctggggctacacagcttctaagtggtggagccagaatttcctaatcaggcatgatttcaggggagtggtggcaggagcaagtagtttagagactgctagcagtaaagagaggggtgtgatgatagttcaaggttctagacagagttatgttccagataaagagctctgaggatgatggatgtcaagaagggaaggcagagagaggaagtagagaaacaaggtcctagcagaa

SEQ ID NO: 69279 - DNA, 2185 bp, Homo sapiens
gattgggtacaatgtgtactactcagatgacaagtgcactaaagtctcagatttcatcactttcaattcatttatataaccaccaaaaatcactgataccccaaaatctattgaaataaaaaaattttaagtaaaattaaaagattaacttcaataacctaaaaaaagacactgaccctagatttaaaataagattttaaatttaaaaatattgttgtacttatttctgaaaattgatcacatatttgttttctagtgataaccttactaataacagaggagttcccctaaccatgttaccttcccaatcactgaattcctctactattagtaagtaactctgtttcaagtgaggttacaatgtgtctttggcaataactagctgggtacccttgagcaactcatttcacatttttatgcctcattttctcatctgtccaatgctaataatagtatcagtgctgcgtacctcagagttgtgaagatacaatgagagcagagctgagaaagtccttgaacaagtttaaaaaaactattcaagatgatagtcatctggcattaagcatgctgctaatcttcagggtcaggtgatggttttagattagtgagtctcagagcagacttcacattagactcatctagggtgttttaaaagctgtcagtgccaagacttcaactccagagattcagatttagttggcctgggatggagcccaaatatgggagcttagaaaatatcaggggtgattttgatatgcattggtttagatttaaagcaaggaaaacaaaacaaacatcagaaattaaatgaggacctccatatgttgcttgacaaagtcttagtcttagtagtgtgaaattatgagcttgactgacttttccccctgattttactaaaccaaccatttgttgacatcatggagccacagcctcaggttacagtttataacctgaattttcccaggcatagacgcctgtccagtgatacagccagagccacatgaagatttaatgtgtagatctcagtttccatctcttaggaatggcgaaggttggaaaagaaagcgacaatggaaaggaaaaagaaagggataggctatggaccaaggtataggagaaagaggctctgagcaggagacagacaggtcagagcacagagaaaacactgtgtttaatttattgaaccggttttgtttaggttgcaaactggtggctagagagccaaattaagcttgtgggcatattttatgtgacttacgctttcttttaaaattatttgaaattagttgccaactcttaaatatcagaatttcacttagaattttgatttctggcatttattgaaaaacataaaaataaaaagaccaggctcattcctgccactagttggagggaaatagatgggacatgtgttctctagttccttatgcccagtctgctttgcccatttatcttacctacctgagcactagcttcttttgttttaacttttattctcaatctggggatcttaacattggctgcacataagaatgctctcctctggagagcgtttaaaataaccatgcttggatcctgtcctataccaattaagtcagagactgttgtgtgtgtagtgtccccttatcacttttatttttttaaagctccccagtttgttccaatgtcctgttagaactgaggcctattggcctacaaaggcaactattcaagagatttgtctacaagtccaccttcttatctttggaagtgattcattaagaaatagtgtatagaatcattaattcagagaactgggagaggtctttgagagagcagccattaatccaatcttcttattttaaggtgaggagacagagacccagagaggagaaaggaattgttctgagactgtaaccatcatctggtattgaattatatagtgtcttttattacattttctcttttcaaataaaagtctatttttaagatttctttttataaatgatcctctttatatgcagcactttgtgatgctttaaagttcttattatttctgtttttccttgagtattttgttaggagtcataacttagctagggcttaaaaacaaacacacaaaactgtatccatcttttttagtacaatagcaatccttgatcagaaatatctttagaacaaaaaacatatatgcaaataaagagat

SEQ ID NO: 69280 - DNA, 2352 bp, Homo sapiens
ggtgtaatttgtcaccttgataaaagaaactgtgcagcaactcgtgctttttctgacgtcagaaggacaacggaaataaaacctgagctcggtgcatggctggcctcgttgtcaaatgtctcatgccaatttggtactcccgaaatcttgcaaaacagccaattccggggtactgacctggtgtggaccccctggattttggttcgaccccagcctcaaaatggcctttctcttgagagtcactcgatttctcagtatgtcgctgtaagcaattggaaactggaatagtttggtttgaggtcttaatcttgaggtttattcgctttttaaaaaaatgtggccaataaacattttctacagagggcttactgtgcgactggcagcaactaacaagatttgtttcaccttctatgaagcttccgttctcagggggaaatagactatataaatgtaggcatatacatttcaggtattcttagtgcaatgaagaaataaaacaggatcatgtgatgggggaggatgcttgaaatagagtgactcaccgggaggggcggtgtgagggtataacatttgtcctcagacccgaatgatgaaaagggatcagctatttccataattgagggaagaaggccagcggaaggaacaggaagaaggaacagcaagtacttattgcactcttctttgactgtaatataattgaacagatagatgaatagattttaaaggtgttttggagctttaaacctatatgtatgttgtttatgtatattttttatgatgcttcatgaattaaggccatttaatgaaaggagcaccatgtttctgatatctgactattgctactcttttctttactctgggtgatgcttgtggacaaaaaccgattttactcattgttcctctaatgtccagcacatagtacctgcttaataaatacttgttggatcgagaccttgagaccttgatcaggccatcttgttcatctctttgtgatattattggccatcccttccgttctatatctcatctgttccccttctcctaagtttgaaaatgagagtctttttcttctctgcttctccttctcgtactgcccttcccactttgagcagtgaccaggcccttgaaaatacccctcacacttgtcctcttgtctccatttccactgcccaagttcaggtccctgtcaccttacctagacttggagacatatgaaacagatatagaggtgccttgaacaacctaggggcagtgggagtgggcggtggagaaaaatgcaagcacaacatatggttaagagtgaaacagccagttactgaggtggaacagctttcctgttggtctctcctccatatcaagttatgctcccctaattaaatctccattctttcatgaggtttatatttctaaaattcagttcacattttgttaaaggaccttgcttttaaaaacctctgagggtttccattgcacacaaatacagtctaaattccttagccatacacttaggacccttcacaatctgccttctcatctctttccaattttttctcttgatattttctttctcacagttcaccctattccctccctatcacttttctgcttcaatatctgtgtggattggattccagtccagaatgcctactgaaatcctgtgtacttgtgatggcctatccctgatgccacttttccacctcttgggagaagtgttcactgatcacctcactggcattttcataagtatttgtttatccttcacattttggactgttgttactccaggtgatggaaggtggtgaataggggcttaggctctgagtcaaatataaatatcaggcctcagcttactcacccaggaatcttgggcaaggtgtttggcatctctaagcctcagttttttcttttgctaaatgggaatgatgatgctggtggtagtgttggtggtacccactttactgagtgatggtaaagatttaatgaagataatgaatgtgaagtatttggtatagtgttagcattccatatgtattgaattaaacatatctaccagaggagggagagaaagttgatcagtaaagttccctttacctctgaaattctgtgactatgtaatcttttaaaaatacttttctgaaaatatatcttgatggaaactacctggatctttttagtctctgggagaatatacatctatgaaaggtggtgaggaggtaggagaagtatgtgcacagaagtactttgaagaatgtgtgacagacttcgaaaaagacatcttgtatgcaaaggcacacagagtaatataatggactgtggagactcagaagccagaggttggaagggaggatgcca

SEQ ID NO: 69281 - DNA, 8441 bp, Homo sapiens
aataagggatactcaacatgtgccagaaaatgtttgggcatgctatagaaaccattttcttctagcaaagttactcatcccagtgaactcacaggtatttatctaaagtaaacatggggaaggataatttacttcccaccctatgtgcagctcattacgtcaaaatagagaagtgctgttatctcagatgtggctttagaaatttaattttttaagctgatctttaagtgttggtgttctgcagagtgcttactgctgaagtgaacagaattcatgaggcaattagaatttgaaaatagtgatttagaagacagtgcaattcatgatttacctaaaaagaaaaaggcttagaggatatacataatgttttctaaagttcaaaagggatatttttggctgtctttggagttaaaggtgggtcaagatgtcacaacatactctgataacctggaataagtcctggtttgggggactgagttttataattttttttatggggggggcagtttgcctgtgcattttatgaaaacgtttcctcattgaaatatttaataatatttgctaacgcatctggaaaaaaacttgttttaaaattttttagtttccagcattagaaattacatgctaaagctgtaccaaagttggtgtacaatttttctgaaagtgcttaaagataagattactggcttaacaaacaagctttgttccctgcattagtatcaagtctttgagaagcattttgtgttatgaatcagctggcagccttcccagagcaagtagtgggacaaaagttacactgttttatacccgacttctaacctgagtaaatgttcatctagcacacaaaattaaaaagttattcctatcttgaacaggggaaactttttccaaacatgtcttttttgtgtgtttgttttcatggtattcctatgaaatgagtcctgttagaagatgtgtatatttttcagaggatatttgtgactgttttgaccttgtttctgttttctttagattgtggtatctgaacgggaactatttggttctgttggtgtcattggtggtcattcttcctttgtcgctgtttagaaatttaggtgagcaaactcatctctaaagagaattgaaatgagcctctcaccagttagttgggctttctctgaatagaaattaatcagaatgaaaaagccctagaaagtagaaaggtatatctttgggacttacagcatgcaaaatttaggagccaaaatatttaattgacactatatgttgtgctttgtaagaaataatgcaaatgatagtttttattagcttgggttatgacaagtatatttaaataaatctataatttagtatcataagaattagaaatttagtgctatacacatactttagtgcctaaagtcttcccagcagaattgagttattcagtgggaaaaagatatttgccttaaatctgtttcattaaactaatactgattcctgccacccctccttataggatatttgggatataccagtggcctttccttgttgtgtatggtgttctttctgattgtggtgggtatgattttttttttagaaaaaattttttataagccctgccatgtcacttagtttaacacatgcaaaataatatatttttaggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacaggtaactaaatatgcttattttctcaaaagaagagtttagggaagaaaagagggaagctattcactcccagggtaaagggaggaggataataggtgctttatagaaaacatgtgattagctaattattgaggactgtgaagaaagttttggtttacatctgaaaatagattgagaattgagataatcatatggtgctaataattgacacattcagaagtgaggatattgatcatacttcatgaacagattagaagaatggaagctaattacacaaaggaaacttaggctttgattctaagattgtttacataaaatatatgctgcggaaatgtgacagcatgagttcgttacatcagattaagtagatttttacgttttctttcagactgtctatgctgtgccaattctgatcttttcatttgtctgtcatcctgctgttcttcccatctatgaagaactgaaagagtgagtatttcatttttacataaatttgagaaaatattagacaattgctgtaactgctgctgaaatatatatttgaattttctcttgaattacatagccgcagccgtagaagaatgatgaatgtgtccaagatttcattttttgctatgtttctcatgtatctgcttgccgccctctttggatacctaacattttacggtaagtaacgcctcctttaccaaaacaaaaacaaaaacaaaaaaaaacgcttattgaaatgaagctgctagttttctatgtgtagttccatcactttaaaaatagtctgttttaatatatttcatatttgtgatgagaaattaaatttagagcttagaattttctgtagtgtatttaatcagtaatttctagaatccaggtttgaaaatatcattaatcatttgatggcatatttgtatgatatgccagcctctgagttcatattgcctgtctcctctcccatcaccttcagactatgtaacacaaacacaaattgcaagccaagccaggagatttagctgcttaactcctgttgtttttaatgggagtcatgtggctaaatctctgtggtatttagaaaaattttccttcaatgttactttaattgcattaactataattccaaacaaatcttattagcctcttagtttatagtcgttttgtgagtagctaaataactggtgcacattttgctgttaaattttctacttggtgtccaatgaaaacagccaatcaaagtttttttggtctttccctgtagaacatgttgagtcagaattgcttcatacctactcttctatcttgggaactgatattcttcttctcattgtccgtctggctgtgttaatggctgtgaccctgacagtaccagtagttattttcccagtaagtaatcacttgctctgctttcagtaggaaggagtttttagacatgtgaatattggtgagattttcatcttctggaagaagggaaacaccagtagaacaatactaagttggtggtggttttgaaggggctttttaaaaatacagtgtatattttcaaaataccctggggacatttttttcaccataagatataaaatgatctttaagtgttcagatgttcaggaaacagcagagaaagaggcacagttttatttagaaatagttactattttggatagattccttgttacttgggcattcttttcattcattgaagctggatttttaaattttatattgctgctatttttaaaatacattttatttattttttttgcagatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtaagttttagaaagtatccaagtggattcaaacatcagggattttaagatttaaagaatgaatgacgagtggttcattgaatcctcaagaaacataaatgttgttttacaggtgcatctgcagcttctatgttgatttttattcttccttctgccttctatatcaagttggtgaagaaagaacctatgaaatctgtacaaaagattggggtgagtgaaagattataaccatagaaacagtaataatatcataaatttccccaactgattttaattttattctcatagctgttatttgttatggtttcacttttaagtttccagcaaacatttctgtaatggtatacttcacagatggaagattgcagagggaaggggaaagatagtttgccatctaatgaacacttaaattaattgcaataaagttattagatactttggagataggaatagggatgaagactagatgagatactcagctttcaacatttgttcaaccagttttcactggactgcctactgtgtgacaggcacttaaatgggcattgaatatataaaagagaaggaagggctgtttagttgaatgagactgaccatcttcagagcgaagctctcagggaggccgtctcttcatggtgtttactattatgtatctactctaaagtgtagtaccagttggtgacagagaatgatgtgctaaccacaaatgatgtggttcctagaaccagaatcctggtggtgatatttaggaaaaagactgctttttagtcattattttctccttcattctgctctgattaaagtactagaattgtttataaaccaacaactgtcatcttgttttactctaaattacatagtggcagtattgaagggtaggatttaggaattagtatttcctggaaagacctctggctttgacttttgctgcattttaggatgatttgggtttgattttgtgacttgactttcattctaaaaaattgcaaaaaaaaatccagtccagttctatatgaagcagtttgtttagcaagaaaattccctgtcacttgagacaaaggaatgaaaaagtgaaaaagttcagaaggcctcaaaggtagttattgtgtactgcagataacatactgatcacttaggagtttatatttagcaagttaaatattctttctatagattatatagtggatagattttagtaattaaagcacatttcaaaaaatagaagaaatgtttagcatatatgttttattacttgctgatcaattttctctatgctctttgcaggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagacttttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctgagtagcagtgttttttgttttgttttgttttgtttttttcaggtaatgggataggcagtgtctaatgcaaattgcattgtaactgcagtacctagcacctagtaggtgtccatatgtttgtgatgaatggtcaggaaaaaaagtttaggttcccagagattctaagtttccaaagtgagaaggaatggaaagtcttggagagttgggggaagatgctaaaatgcatcataagagcccaggctcagccctgctgatggaaataaataggtcaataatgtatcagaatcaactggagagccttttaaaaccacagctttctgaaacgtgcctagtttgtctgattgcaaaggtccagctgtagggtagcccaggatctggttttttacttaagaaggccactcgggtgataatgatgcacaaactccagga

SEQ ID NO: 69282 - DNA, 5434 bp, Homo sapiens
atgctagaaacggaaagccgtgcgcctaggttgcatgcacacgagccagggtcggggctggatgtgtgccctgagtgcctgtgcaagtttggagcgactgggaaaaagcaaaacagaaccccccctcgccccctccactccgacgagggacaatagagagggtgaaatactgaaatctgccggagtagggggcctcgacggccgcaacacagcggtggcatcatctttgttctccccgcggctccgccgtctgtacttttccgcccctcggcgcgcccccgcccctcgcgcgcggctggtacttttccactcgcctggcctgggatgaatcagccgcgctgcgcctccgggcggcgtcacgtgaccgcggcgggctggcgctgcggtcctgacgcgccgcctctactttcgcaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaaggtgggagaagttgtgacacttttgaaaaaacggcttgcatgggttgggttcagggagttacctaggactctgcttccattgctttaatttgctatagcatttagagaaggtgcgtaatctctgaaagagtatccgattatcttgttgtaatgacaagatagctggtgtgaaagtcaactcctagttaatatttatacattaagtaaagatgttgtatcagagctatgctgttggagggtattttatgttaaagcagtcttgtgtgtaatgatagatatttcaatccagtttacaattatatatgtctatattttttgcagccattatgcagatgtagatcctgaaaaccagaactttttacttgaatcgaatttggggaagaagaagtatgaaacagaatttgtaagttaaaaatagtaatttgtctgtcagtggctttatggagtaaaagaatagttttacttttagaattcaaatctaacttgcccaaagctggttttctccatttaattattgttatatgtttggttatcgttttccctctatgtagcatccaggtactacttcctttggaatgtcagtatttaatctgagcaatgcgattgtgggcagtggaatccttgggctttcttatgccatggctaatactggaattgctctttttatgtaagtatgtgtaagtagtgagtctgccatgcagggcagttactatggtaaaacatattttggctccagaaactgaatttacagttggagtagctgactcaaaagttacttgcttaaaattaaaagtatgagaaaccccaaaaaatctctttattctactacatactgcacaatatcaagaaagccaactagaaaaaaatagggcagtccttaaaactgacaaattaagccagaagtcttctaagtcagtgggaatagttaaaacaaaattgtaacagatggtagatattaaaaaaactatggctaaagccagggtaggtataaattttgttttggcaaatcagaagctgaaaatcctaataagctccaaatcattttggtaaatcgacacagttcttaaggacctgtggccccttacgtgaataaggaaaagaaaatttctctaaacatacaaggtgtggtggtatttacccagcctggaacatgtttgttttaagacgaggaggtcataattttctggaccctgaaaagcaatccatacatgtttttttaatgtttgcttttgtcagacctgttcgattgccacatgttgtggcaaaaaatgaatactttagtaagtacttatttttaaatggttccccccacagttgcacagttagacttaattacttctgtgctttccagcataaatacgtggatagactcttggaggtacagaagacttcagagcagtggttcttagccatttttgcgtcactgactcttggagaatatgatagaaaaatgtggatcttatttccagggaaaaagcacaaaacaaaaatacatgcaatcttaagcatgtatttttcagtgatgtttgtgtcatagcccttaagtttaagtacccgtggacccctggctaaggcaatttctgtggaggattgtgtaacttaataccttcattgtacagataaggaaaccatatgtatatagcatggaattgtccctttgtgacagatgtgttttacttagctgattggtgccttctactcaagttattttctccagcacgatagaatgttcatgaaaagaaaagcagacctttgcaaatctctgctttgtgaaattccacactgaggttaagcctggctttgagtactagatgctaggattcactctggcttgcttcaattaggatgaggctttttgagagaactcttactaaggtgaaggaccagcgatttacgtagaatcctagaatctcaggagttcttagtggagaacctgaatggcatcactgtcgaatatttgaaatccttgttagcacttggtataaaaactggaggcagttttagagtgcagccagtgtagttaaagtaagaattgaaatgatactaaatggcacctctgtttcataagtgaaggtcaaattctgatgtaacccttgtactcttggaattatactttaataggtgcttatgtcattgatttaccattttgcttaatggctaaataagattgctaaagtgtgattttattcatcagtacttactttatatttagaggtatagaggaaaatgggccaaaaaccacatggctgccacggtgcacttcagcaaccctgtagctaacctgtttaagtagaatcaatctgaaggttgaaagtgacctcaaaggttataaagtctattcatcccttgtcatttcagtataagacatggaaggacttaatttggtttgtttttaattaaaccaacatattttctccagttagaagtgaggttgatagtgtcacttcagactaggtcctgtaaaacttctggcatttagaatggtagtgtaaagccacttcctctgtttaactaatagacatcagtttctttgtcagcaccttacatggtactgcgtgcagtttgttcatacggaattaaaaaacatgtaactcttctcctttgcaaggttttctatgagtttccctgttttgttatttaatttctttaaaaaattagtctgtatctctgggctctcctaggtggaaggaaagtaaagctggaatgagggagaacccttaccctaaaggaaaattaggtgacattagggtccctttagtcactctatgttaccttatttatttattttttttctgttgctcaatccaagtgaaagggtcaagggaggaaaggcttagagacagtcaagctgatagcctacttgttctagcacagacattgtttaactgtgacaatagtgggcctgtattccttgccatggggtgcaatgtagtatgtcatcacaatggttagttctctgatttgtgcccagttgttagtaaagcttgtagtgcctcttaaaatgttagtatcatgttagtgtcatttcccccttaccattcttttccttttctttcttttttttttaaaaagacagtatttcattttgtcctccaggctgagtgcagtggcaaactgctgggctcaagtgatacccccacctcagcctgagtagctgagactataggtgtacaccaccacagctggctttttgtttttccttcggtagagatgtggcttccctatgttatgttgtccaagctgatctcgaactcctggcctcaagcagtcatcctgccccagcctcctagagtgctgggattacaggcatgagccactgcacctggcctgtcattcctgtttttgtgtatacggtccatgtggtcttaaaacctttcctgaacgtgtctcagttgaatttcccaagaaccttgtgggctgggtttagtggcggatattactaatattttacagataaggggaactactgaaatgcagaaaggtggcaagcatacagctcattattgtggtgccagaatcaaaatacaagtttcaaactccatcactgggaagttgagctttccagtgtctcatgctatgtttggctcagtgggtagacatccttgttcctaaccaatgctgtagaactatcacctgagaaatgatgcaagtttttactgccagccaagagacagtgttgccattccagttagtaggagaggaaatgccagttcttcagggcattttgacacaaataggacaagttgcacacataatgttatttaaacatccagaaagagttgtctttaaatatagccatgcttatttataaccctatgccttttccttctctcaccagaattctcttgacatttgtgtcaatattttccctgtattctgttcatctccttttgaagactgccaatgaaggaggtatgatagcattcttgatttttctaaaacaatgtatacctatcattttatttctcttttaaaatccttggcttcatgcttctgtcttcaaattgtagggtctttattatatgaacaattgggatataaggcatttggattagttggaaagcttgcagcatctggatcaattacaatgcagaacattggaggtaagaatttttcaaaagattatttgggtagactttatgctcattgtggagcacagaatggtgacacatgcgttttagtgtcacgtgccgcgttttgcacttgtaatggtataattttgttttcctccagctatgtcaagctacctcttcatagtgaaatatgagttgcctttggtgatccaggcattaacgaacattgaagataaaactgggtaggtgctaagtaaggttactcataagaaacaattatagtcaaaagtggttagatacatttttatcaaagttgtatacaaaatgattagttaattatccataaatgttccttttgaaactgaccaagaaggccccccatccccgtaaactgattcgaactttggagaaggaaaggccgaaagatagtagctagccctacaattttggatatcttaatttctaaaacaggttttctagaacttgctttctgtctttatgttcatacttaaagaagttataggtgtttttaatatatatcctaagtgaggactgaagctttgaattacattaaaaattaatccgtcttatttttgtaagtttggaattcttaagacttaatctgttcaatgcaaaatacaggctggacatccctaatctgaaatccaaaactttttgagtgccaacatgacactacaagtggaaaatccacacctgatctcgtgacaggtgtgcaaaattaatta

SEQ ID NO: 69283 - DNA, 1003 bp, Homo sapiens
ttgagcaccaaccctggctgaaaaggataggcaggggaagcatctgggggtctttccagactatctagaaagctggagagagtgggcttgggctttgcgggagagtcttgggggcgcctgcgggcggggctgggccgcgggcgcgggccgcagagggaggggcagggaggcggggcctaggtctgggcgggtcggaggcggggcccaggtggtgttgatacacaaagagaaggcgcccgggcggccgcggtcccgcccactgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggtaacgcgtgcgggggggcgtctgtgggaagggcgcggggcccgggcgagagtgggggaggggcttccgggaggggccgcgcgggaaggcggccgcggggtccgtttcctttcgaggcgggcgttgtcggttgggctggccagccttccaccctggcccgccgcgcgggtgtcgcgcccgcgacgtgggtaggagagcgggcgctgggcgggggccgcgtgcctgcacggtgcggagccgcatcttcccattagggggaggggagctagcccggccagcggctctgctgcggcaagtcttgtgactgatttgcatttaataaaaaaaaaaaattaagtccagggagccaggaatctgggggcggcggaggtgggcttgggcatgtattacaggagaggccaagattggggaagacgagttgggaacat

SEQ ID NO: 69284 - DNA, 1009 bp, Homo sapiens
gaaaaagttgaaagtactaaatcaacaagcacttattgaacactttttatgtatcaggcactgttttaggcactgaagattcatttaataatgagccaaaccagtcttttcctcatggagttaatgttgcagaagatcataagcaaacaaacaaataatgtgttttcacacattgcactaaaaaataaaataggacagtggggaatggagcttgagtccaaggagcaacttttgctggaatggccaaagaagatttttttgagtcagtaacatttaagataagatctaaatgataagaagggagctgcataaagatacagtagttctcccttatctgcttgaaatacatttcaagaccctcagtggatgcctaaaactgcggatagtaccaaaccctttatgtactgttttttcaatccgattaccaatatggctactaaatgactcacagagaatggactgtgtgtgagcaccacgaatggaaacccacacatgagttaggctatgattcaggagatgtcttgagagagatgatagtctcactagggccagagcaatgcagatggtgagaagcaacagaattctgaatatatgtggaggcagagccctcatgacttggtgatgggttggttatttgaggaaaaggaggactcaacatggttccttggtttggggcctgagctcccttatgaatcatggtgttattctgacttggaaaggttcgaggaaaaatagttttgatagagaaatcaagagttctgctttaggcagtaagggataggatagatgccctttaaacataacatataataggtttctcttggttcttgagaaactcaaaactatttaccctgtatttattcattcagcacatgtattgtcaggagctatttcaggtgctggaactagcagtgatcaaagctgattaaatccctgcccttgtgcacttacgttctagtgagggagacaaacaatgaaaaagtaaataaataaacatatttaacataat

SEQ ID NO: 69285 - DNA, 2996 bp, Homo sapiens
tccttatatatgtgtgtgtatattatatgtatgcacacacacacacacacatatatacactttttgttgcaacatctattaagcttttggttttgtttgctttataaaattagaatcatatcatatatgctattcttttttaacctgctctttttcacctaaaagattgtaagcattctctagattattgaatctttttctgtcccttgatttttaataatcacagggtattccatcatcttggtgtactaaatcaattaactattactccattgttgaacctgtaggttgtatctctccactgtattcctcttctttcttcaactaggattctaaattgactgataggttaggcctgggcatctgagatattaagaataatatggctcaatatatagatcagattgccatattatgtaaacaactaaaaaacaaattgtactaagtatggtttctgtgctcctaacagagtctctctgaattacaggctttaattttccttgtggttggaatattcttcatgattggaagcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacaaaaataatgcttatagctaaactgcctgttctagaaagcatctgctttttcatgttattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggatttagttcagtttagctcacacaggtgtttgctgacattcattggccatttaatacagtgttgagtggttctctgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgactatgatgtgatttttgatctattgttaaagaatgttgtgttatttgtccatgaaacaaaatttaaaatccaaatactgtctttcttatattggtttatgttccattttcattgttacctttgacacataactaacatctatagccatcatcctgaaaataattgccatcttattttggcaaaatagatatttaatcctaaattattatgatgattataattttggcatcacatatataccacctagaatgaatgtggaagaaatgagtcttttatggttagtttgaaagaatccattgaagatagaaaatgagagaatagaagaaacctgagaatagtaaaataaagagcagagaaaatatgggggcagggaaaacatgtgagtgctaaggattgattatgaatgaacgattagggggattgacggatcacagggtaagtatatgcttaactttataagaaacttcc

SEQ ID NO: 69286 - DNA, 2017 bp, Homo sapiens
cctaattggtggagcctactatacactaaggctatatggcatagcctagtactcctaggctacaaacctgtacagcatgttactgtactgaatagtggaggtacctgtaacataatggtaagtatttgtgtctccaaacgtagaaaagctactgtaaaaatacagtattacaaccttagggtatcactgtcttatatgtggtctgttgttgaccgaaatgactatgcttaataccactgaactgtacacttaaaaatggttaagatggtaaattctatgttatgtatgttttataataataaaaaaattgaaaaaagcatcaacatcttttctgggaaaaaagaaaaggaaagaaaatgcattagagtgatgagaatatttgaagtaatagataaagtcaaaaacaaagaaatgatcttgcctttgaactttcttgtttaagattcgtacatcagtgatcacactgttatttcccaaacgacccttcagctggatacgacatttcctgattgcagctgtgcttattgcacttaataatgttctggtcatccttgtgccaactataaaatacatcttcggattcataggtgagtttcagaaaggcttcaatttggtcaacccaaactcacgcctcattaaatgatggacagggaaccagtgctgggtcatccagatccccgttctttctcaggctcatggattccctttatccctgagaggctctggtgattgagctgctcactgtctcttcctcctaactgacattgggagccaccttataggtcatttagtcaagctgctttttctgatagatgaggaaactgacccctataaaagtcaagtcatataccttggtgtggacccaggatttggacttaggtattagctccaccatcaggaaaagaggaagatagattttacctgccagaagctctctgatactacgagtatcagctgaacattgaaaggtatcttcagaggaataggaggttgattatataaagtgtattattagtatttccccataactgcatggtctattaattttcattctactcattgagggtttacttaaactttaaacacaatctaaaactttaaaagaaccatgggtaggtcacttgcaaagtaagaggtggatagggtgtgtcatgagttcagccaccttagtatgtatttatattactaatcccctgtaaatttgtgttaaattcagccttttgttgcttattatatgttgcatatacttatgcagctttgatgttaggtacattttaattgtctctataaacatatcttctatgaataaataaccaagatgagcttatgtgacttaagtgtgtgtttttagtgctaagtataggatagctttatatttggtttatttaaagtgtgtgctggcatctcctttgctaggaactgctgggtaagacattgaccttgccctgtgtttgtcttctcaggggcttcttctgccactatgctgatttttattcttccagcagttttttatcttaaacttgtcaagaaagaaacttttaggtcaccccaaaaggtcggggtaagtaaaccttgcaatttcccccattattagttgttcttccaactacttagaataaactagaaaatacacatagttcagaaaaatgaatcaatgtacaagaaccaaaaatcaaaactgggctagaactttctggtagcagagaaaggggacatatttctgaaactcaaatgattctacttcaaatatcaaatatcctgtgttgagtctgtcatacatgtcaaatagtagtagcctttcccacagacacatatgcttcaggcaaatagcagtgtccaataccaagctgctgttgtgctatccgtggaaaatcatgcaagaaggaattaggctccctagcggtgttatggaataatttaaatattttggtcatggttgttaggtttgcaaagccaaaggaaagatgttgcttttgttttcccttccatagtacctgttgtccctggtgtggactaa

SEQ ID NO: 69287 - DNA, 1116 bp, Homo sapiens
aatgcacctttttaacaagtgactaaaaaacaaactgtgactattctctgaaaatgagcctatatctcatacttatttattctgtttaacactgtgaaacaaattaagtcctctggcactatgtatataccataaaaagcttattcgtaagcctactaattggaccagttttgacaatattgaataagcactaattgcagatcataatgtagaattataggctgctgaggaaaacaatatcacaccatttgctttcctcagtttccttttcagaatgagtttcataatgttcactaatccaatttttaaaatcctttacaaagttattcttaaactatttccagagactatctggtttgtcattctagaaatgaaattgccttttcagcctaaacagatggccttaatttttggtggagtggtatgaaaggaatgtcacatgagaaactgcaagctatttagcttgaattttttgtcattcatacatgtttcaaaatatattttacattttctctcttttaaatgagttcccatctctgcaccttaagtgacttcagaactaaaattttaaagtgaacatcaatcacagcatttccaaaaatgtgaactcctagcttaaccgaagtattcacttattggaaagctgatagagtaattccactaagtccaaaaagtgtcctctaaaagattccaaagataagagtgttttcaactttgtcaagctgtacaaacacaaatgtcactccctccctctgcccacagggatctttatccagttacagcagcgtaacttgagcagctgctgcaaactgaggctctcttgacccttcgcctacttatttcagctgctaaaatagggctgaaatctgtcaaggatcctgaagggaaggataagattcctactattcaatttaatttaagcttttattcagtgcctgctgtgtgcacaacactaagctagaaagtctgaggaatgtttagattattaggtcctgttccttgcctttcatagatttacaatctattgatagggagagctaaaaaggagagaaagaggaaggagcaaacacaaaaacgtcaaaattttaaaataccattttaaaattttattttaaa

SEQ ID NO: 69288 - DNA, 1140 bp, Homo sapiens
aatatctgttttagtgtggtgatggagtcatagttgttgagcttgaaaaaatggtagcaatcattcatcctagagtttacacactgggtttgtaacctgcatcaggagtggctgcgcaggtagggacaggggaggtggtaggctgggagagacaatatgtggggcttgggtctctcatccccttcaacaagagcaccttggtctctgtctgatttgtaattgcttctgtacagcggagatagatttatcacaatgtaaatgagcttgagaggctctttattttgtattataccttctgcaacgttatcagcttcaggacctctttgttcatttgaatgaaggttgcatagctaatgagctcagaggcaagaccagaggtgcctggattcccaggcctaggtcttttcctctgttctgtgttctctctataaaatgttgccataagtgacctgtgctgatttgacaacaccaagcggtttcattctctttttcctgttgtaggagaagttgaagatgaattacttcatgcctacagcaaagtgtatacattagacatcccccttctcatggttcgcctggcagtccttgtggcagtaacactaactgtgcccattgtcctcttcccagtaagtacataagactttgatgaaagaaacctacttgaccccataaattagtacatgtgttctaccttcattttgatttaattatagggtgagtttgcaattgcaatgcctgaggatattattttcctatagcattttgagtcacttaaaattggccatttaatgtgtagatagagcaagtagtttcaggtggtatttttatagtgtaggaaaaaaatcataaaacttatttttaaactcaaagttgaaaagtggagctggagcttctgtcttgtggattagtaaaactgagtaggagttcatataactttggaaccttgaaagccaaaaccatattaactttcaaatcttattaaatttcatcacagttttgaaggcatttcattttttttccagtttgttgtgctgcaataatatacaaaagttgccttttttaacctgatgccttgaaggctaatgaaaaggggattcatgttaagtaaattatataccagaaaaaaatttttcaaaaaac

SEQ ID NO: 69289 - DNA, 2379 bp, Homo sapiens
tgtactcctcagataggtcccggaggactagattggtgcccatctgcagaaaaccagaggggatatattgactctgcagatctgccctttgattctgccatctctcagctggcccatgccttttgttgccagactactgcccaagttatagacactaacacaggcacactgagtatgggctatgttgatttataactaatgagggcagaaccttagaactgcagcttcactgtaaactttggagcaggatttaacacagaatcagccctgatactgttaacaaaggtccacctgaaagagctggaaggtcaaatgtctatcttggaagagaacttggaagcagtgccaaatacacaatgacttttttttccatttgggggattagatgttcatcttacatatcccaaatgtcataacttgcttgcatgtgacttcagtactgtccacaccattaagctgtcacattttccattttagcaatgtcaagctacctctttatcattaaatatgaactacctgaagtaatcagagcattcatgggacttgaagaaaatactgggtatgtcttatgctccctctgtgacatcaagtgactcattctacttggtcttttctgattctaatatccttgtctctcacttctagagaatggtacctcaatggcaactacctcatcatatttgtgtctgttggaattattcttccactttcgctccttaaaaatttaggtaaagatattttctaactggaaatatttttatttttatttcacatttaaataggttagctaattgtagatgccatattcaccttccaaaatgcttcttctaacttctaggttatcttggctataccagtggattttctcttacctgcatggtgttttttgttagtgtggtaagtgatgtgatgacatgatccttgcaggttggttagcatgagtttttttgtgcctaaattagtgtcctcattttgttcaagcacttcactaatatgaaatagttcttgtatcacaagtgattttcttgtagactaatttagagcaaaaaaagagcagctacgatttaaagatagttgaggtagaatatcaaagctactactaatggtttggtctaggcacactggttatatatggggaaaaaaggaaaacttcaagcaggaacatgacaataatctggcatttagaacagcagaggagagtcccagatgagaaacaagaaggctatacccatattcacatgaatcagccattctctcttacacattccacccattaagagaggacaagaacagtgggattaaagaagaaatcctcctctctaggcccctgacaaaagagggaatttcttgcactatcatgaatgccaaaatttataaagcatttccccaaagaggtaaaggagaaggaaaaaaagttttgaagacccatgtcaccttagtttgaagaaataaggaaatgatcatctttctcatggaagggcatgaaagagggtgggaaggattcttgcaaaatattgtcctgttaactctaagaggcagggctgccaatcacagctccaactcttcccttagaacagaggctagaggaagtttactttgtccattagtctaaaaggaatccctaactgagttccctcaccccccaccctataagccacacatatggattcttatttcattgttttttctcaaaaagctgatttttttttcttttttaatgactgagtctaggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccgggtaagtgagcggtccgggcttctaatgagtacagttatgtgttttctaagtttttattcaataaactgagatggcctgagatcaccatctatgttggaatgctaaacacgtggtgttgtctttgtttttcagacggcctatgcaattcctatcctagtatttgcttttgtatgccaccctgaggtccttcccatctacagtgaacttaaagagtaaggcagccatcattttagcattctaatttgctttgaaattctgctcatatgttcaaagattctttaacaggaaacacagtttatagcttcctcttcagagaaaatatgtactccatccactcctcagtaacatgctttaatcagaaaggtgggaatc

SEQ ID NO: 69290 - DNA, 1050 bp, Homo sapiens
agcacctcagctgtggttcaaagcatagccactactacgcttctaaacaatggaataaagtataaagcggtctctcagtcaagcctcacacaggtaagaggcgtgactttaagggagtaagatgaaatatcgtaacatcaccccagaaataatgctctcactttggttactttatttgattagttgatatttggcataagagaaatcacttgtatttctctatttaacaactctacatttagaacacttaattttctcaatcccctaaaaaattaacatttactgcagatgttttcacattaacagattaatgtctggatcattctgaatttttgaagaccaaacatgttaacatcactgacatcactgaaaaccagcaattaatagctgtaacattgaatggtacctcaccaagccagctaatcagaaatatctcctgtgttcacactctgtaagatttagctttagccaaggtctttgcaaagattaaccaaataatgtgtacagaaggtacatccgctattgtaaaaatcatttcactttgacagtacagaagaagcaccagcccttctgttttagatgtagtccgtccttttcaagctgtatgattgtggacatgtcaacttaacatctcggagtttttatatcttcatcagtggaatgagaataacaacatatatcttgtcatctcacagggtttttcagatgatcaaatgaagtaatgtgcagaactaaccaatgtggggaattattatcatcactgttactttcatatgaagtgaagaaaatatttttaaactcagtagtttaatttacaatttaagtatgtgttttaaagtgcctgttagcaaaaattcactagaaggatgtaggacacacttaaagttttcatgtaaaatttgtgagttctatttttaactgaatcttttggccatgtgtcaacaaattaacgttatccttcaccaaatgggtgggcttgaaaaaggcgtgatgcataaatatttacagttgtaggcaaaattgtaatgttatgtatatgaatacatattc

SEQ ID NO: 69291 - DNA, 1591 bp, Homo sapiens
ttacaaagtacttcgtaatctaatgcacaggatcagcagtaatgcagctcagactgcatgctttcgcctttggattcctagatttcagattaaggtttagtcaggctattgaatagcccttcaattctaagtgttgatgtgaatatcatgcaaatatgatgtacatattcccatgtgctgagtaagtagatgtagcatttgctaatgttgctatacatttagcatctaagttatgaaccagattctaccactgggtaacattaaaaaagttagggacttcaggtatgtaaaatatagcaaattctatttctacgactttaaagggtatgtgtagagttctgaaaagaatttctcagcctcccccaaatccacatacttttggaaagctgatgattgaaaagattaatgtgatcctttattgtaacatctaacataattacattttatttattgtagaaactttattacctactctctc[450 bp omitted]gatgtttatttacatgtttgagactccagcatggaattatatgacaaaaatattttagtcattaaaacaatctctttaacaaggctattttatctttgattgtagggtctttgatttatgaaaaattaggagaaaaggcatttggatggccgggaaaaattggagcttttgtttccattacaatgcagaacattggaggtaaggggatatacttttcaatggatcccataaactttctatagcgtgttcaataaataagaaaacttatggcaataaacaggcactttagatacagaaaaattgctacttatagttcttaaattttaaaatgatagtttcttaaataggtttgtgtcctgctttaattaaaaacagcaatatctaagaatgaaataacatataaaaccctgccaattgaattctagaattaaaatataaaataaaagctttcttgatttttaatgttattacagcatgaattattactcttaaaaattgaagaatttgtgcttatatctgtcattgacaaaacagttgacgttttctatgtgtgactgagttcgatttactaaactgaaaagtggttgtctgggggaacatagccaaatgctgtggtccttgaaacgcagcctgcactgagccagcccactagacagtgtctct

SEQ ID NO: 69292 - DNA, 1545 bp, Homo sapiens
ctgggcttgtcctatgccatggccaacacagggatcatactttttatgtaagtgaatgtatatgtctacatttggtgatgaagtccatgcatacctggtggctttttcaattaacaatctcaagtttgatctttgtgaacgtgaagactcagaggaggctaatcatggcacttggtcacccaaccatccctaacccaacggcagaaagtgtatgtgctcaatcaaccaaagtgctggagcagcctcgccagaagaattttgttattcagtaaatacttgaaataatttggtgtttagcaaccaaaaagatctttcccagaagcaaatctgattttatctcattcttaggaaagaagcaaccaagcctaagagccctgcatgcccttgcctaccttatgtcccattccctgtacccctgtgcgacagatacactgggcacaatagccttctctccatcctatgaagatgccacattccctctcaccattggacctttgcacatggtcttggaaccctcttctcttccttcttcatctagttaactcctcatatgtcagttcagtctcacctgaatactgcgcgccctgatctccatgactggggcaaatcaccttatcataacactcaccacaattttaatgttttagtgccatttgtctgattcatttggttaatatctgtccctcttgctggactataagctctagaaagttgagcccatgtctgtttttactcaccaatgtctctacctccaaacctagagcagtgcctggtacaggcaatatttgttgagtgaccaaaccttattcctaaacctacgtactttcaccaaacttgttcaaatgctgcctaagggtagcagcatctggtagttgacctgtagggtggatactgcactgtctatgacagacaacaacagacgtttatgtgcatcatgtacagcctggcattttccaggatatagttggcagcagtggaattcttcacaagaataaagtctgatgttaggcaccactgtggacacagatcctaatcccaaatgcaacgctagagagttaaataactgtctaagaatgcaacatttatatcacaaatatgtgctgtttatgttctgaatatcacatatgattagtaatcacacagctatttgagggctaagcatcaggactataaatatttgtattgtgttagtgctttgattgaactcttttatgtataatattcttcagctgaatgggtttttatatcaactttacttttatataagccatgttttgaaataaactaggattttaataatctgaattttaatagctatgtatgtagtcatatatttgtatgcttttgtaatgtgcttacctctaagacaaaaaaagctgcctttccttattaattatacataccattaaaatgaattaggaagttacagatcactgatgaatagaaataggaaaaacttcccccaatcccacagtcatagatcatcttcatgagagaagaatgttccactttttaaaatgagggcctcattttaggcttataaac

SEQ ID NO: 69293 - DNA, 1407 bp, Homo sapiens
gagctgaccagcacagctctataaccaagttgtacatcttctagcctgtgtccaagaaaaccagaatcacaacgctctgtggatagtgacatcttaaagttttctttccctcccaactcttttgccagttcattgaattgctttaataatttccttagtttcattcattatctgttaataatccatgtacattttgagagtaattaaaacacatacgcacacacagaaacaaccaacacaacacacagctaccactgaattactttccagtaagagatgtatgtataaatgattgtaccaaaaaaaaaaaaagaaagaaaataccagctacagggccctgcctgggactgcttgatgccagggggagaatggggtctccccctgggtatgggtgggtatgggcctgctgcttcacctttctgagccacagttccctatagggatattttgaacatcagatgagataaggatcacagtgcctaggcatttaataaatattcgttgaattaataaaatcatctgattatggtatggtagtagttcagaaaattctgtcataaccctgtactctttctttggaagggctctaaatgggaacacaattagttgtagtctcttgcatagctaatgtgagaaagagggaatgtggtataaacaattttttaactaaaaataatatttccttcctttataacatccttcttccatcccaaagtatagttgtaaatggaactcaaaattgttggtctggaatgaccgttagtgtgaaggaggaaaagaaaattggggtgtcttatttcccctcctctgattcagttacttagatcacctgaaacatacatatgattcagagcatatatttagatgttttcactttcttatttgtgtgtgtgtgtgttcagtcaatttgctaatgaagacactgaaagtcagaaattcctgacaaatggatttttggggaaaaagaagctggcagattatgctgatgaacacgtaagtgaatctatgctttcaggcaataaacgggactgagggtgtctgatctacctaggtctctgtgggaaaacaatgtgactgaaattttccaagccttgatcagcacattctgtgtttattcaggctcttactggaataagggcttgttttttcctgttcgccatatggctgcatgaatcatttatgaaacttatgtgttttggggggaaatcattctaacccaaaggtaatctacaatcatacatgttttcccttctttatgtgactccccttgtaatttgtatttttactgaggcctctgctgaaaccaagcactgcattccgttgaaaattacatgcttttattgatgttgagtaatggctttactcctgtaatgttatcttagtcttcaattttggactgtaatctgc

SEQ ID NO: 69294 - DNA, 1011 bp, Homo sapiens
ttttatctcctggcttaaacataggacatcattttgcagtttttaaaatcagtttaaagagatgggttttatctatgtgtggtttggattgaacccttaaatgtaaatttttgagaaattcaacataatgtatttatttgtgatcattatacttgtgttttcaatacatgctgggtttggtatcaaaacatttaacatactggggacatttctcatctattttatacaatcttggcatgttaaatgactacaactcatctcatgccaaaataagaacatgcaaatgcctcaaagaaagaaaatctgtttactttcaaattctcaattttaaaaactactatggaatacagattttagtttattgattaaaataaagattccagagtttaaattctaggtggcacttttgtttttatagtcctcaggcccattttaggcttcattttatcctgtcatctcagtctccaactgtgaacattatgtaccagtcttcacatagcaggtacattaattacagaccattaatgtaaaccacaaaagagtggtgggcagtgggtggggggtgaatggaaatggaaagaggcaacaactgagggcattgtgctttctgtgagaaatatggggagaaggctaggaaatgttcttaacttgtgtactcagagctatttatgccttgagttctagaaaagcacatacaactttgtggtttcgtgtgctgtttctatctacatctcatactgttttctattctcaaaaagtaaccctgtcatcctctttcctctccagattattttcaggattagcttctgttataaaaaatagcttgtacagatctcctacaataattattttctattttatttctaaggtttatttatttatttattgagacagacagagtttcactcttgtggcccatgctggagtgcaatggtgcaatctcggctcactgcaacctctgcctcccaggttcaagcgattctcctgcttcagcctcctgagtagctggga

SEQ ID NO: 69295 - DNA, 1322 bp, Homo sapiens
gattctgccttggtagaccttcctctgtcaacaatttacttttgtcttcctttcttttaaaacatgtatcccactcacaaatacctaaatttccttgaagactgctgccatgtcttaagatttctttttttttccatagtgactagtaaaacctgccattttcattatacataggcactctataaatatctgctaatttagcaattattagtaatttcctttcttctcttccatttcttcctttcttgtattgggtaaaggaacatttcaggattttcttatgtaaagttttcaggagtttctttccttcctcccttttacagagagcatacaaaatgtagatgattcatattcacttatttcatttaaataaaattataatgatgtatgttgtgttctgtttgcagaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcaggtatggggttaaaaattactatgttccatggaaaaataagacaggatgtggacatggaaaacagggtcttgatgggaagaactggatttattacaggtaaatttgtgataacaatgatattgatgctagcacatcaattccctggtcctgaaatacagtgataatgtcaatctcttttgtgactgatttagaattgaggttacaatgtctttgtctccattaataatgtgtaataattttaattattttagcctattgctcctcttatctttctcagattcctctttgaatgttgctacacctcctggtttctgtagggattcttttctctctaaaagtatcctctgggcaagctcactcacaactactatggcctcaccctccaaatatatgccatatacccagcctgttaagtttctctactgaatttcagataattatatctgaatgtctactgcacgtctctactggaccattactgtgtctaaattgcctcatttataaagttaaacctgtaatgtctaatactgaactcctatctttccctccaaaacctgctcctcctctagtaatccccatcctagtgaaaatcactgctatcatgtagcaactcactcaaaagcccctaggtgtaaactttgacccacatagccaacggtcagtcatatccagttggtttgacct

SEQ ID NO: 69296 - DNA, 1895 bp, Homo sapiens
atctgtacaatgggaataagaaaaaaaattgtactcacctcagaggaccgctctgaagaattgatagatgtaaggccttaaaacagtggctggcatgtggtaagtgccatatgagtgtttgatatatcttttctaaaaaaattctgggattagcatggcttaatgcaaatgaaatgaatgaggttcctattaatatacaaagtagaacagactttaactgaagcttttggactgcagacatgtatacttacagcagcaaagatctcagccctgctgctccttcttcagagaagccttccctgatcccccagactaagttggatactatgaaagacactgctatggccccctagaggggctggataaattaaggatggagtggaggagggaggggagcatgccagtcactgtgacccacatgtgcaaatgacctgagatgtagagaacacggtggatttctggaatggaaagactagtgtagctagaacactaaggtgaggagagtgtggacggagatgagaccagagaggtgggtggaccaggcagaatcttaccaggcatgttgagaattttggactttatcctcagagtaaagggaagacattaaagggttttaagcaaataaatgatatgatctgtgttgttgctgttatgtttcaaagatcactctgggtattgggtaaagaatgaatggtgggggtggttaggggaggcaaaagagaattgaagatcaattaggagatttttacagtagacatgatggtagcttggacaagagtgaaggtgaaagaaatgaagagaaaaagactaacttgagaaatacttcagtttattgtaaaagtcaaccagactttgtaaagaactggatgtggagggtaagaaagaaaaatttataatagaaggctcttatgcttttgacttgaataattggataaatggtgacaacattctttggaatggaaacattggaagaagagggcctatcacaagttagactttgaacacattgaatttaaactgcctttgagatatatagatgacatttaggcccctggacacatggaacttgagttcccaggagaagcctaggctgatgtaacttgaggagtctttggtatatgtattcatcagagttctccagagaaacagaaccaactggagataaatagacagacaggtatagatgtatatagatataagatgacatttataatgggaattggctttcatgattatggagccaagagatctcaaagtacagcatctgcaagctggagaaccaggaaagctggtggtataatttaatctgaggccaaaggctgagaaacaggatgttgctggtataagtatcagaattacgaggtctgggaagcaggagctccaatgttcaagggcaggagaaggcagcagaagatggatgtcctagctcaagcagagacagtaaatttgcccttcctctgcctttttgttctatgtggaacctggagtgtttggaggatgctcaccttcagtggtgagagtggaccttttttactcagtctattgattcaaatggtaatcttttccagaaacaccctcacagacacaccccaaaataaagttttacttgctatcttcccatcctttaatgcagccacaatgacatataaaattaaccatcacgttatatgaagtcttgggagtggactggaagaatggggcttaggatctagctttaaggaagtcaagcaatgaaatgtcacatatttttaaaaggacaaaccacaaaaactgtgaaaagcaatagtggtgtcatcagcaaatagaaatttttgagaattcctagaaggcagaaagaagatagggttggaaaatctaagagaaaaggaaccaagataagtgtgcttttcccatag

SEQ ID NO: 69297 - DNA, 1076 bp, Homo sapiens
tgacacccttacaccctgaacttcttaggtacccatccaaagaacaagacattacaatgtttaataattagaatttggatataaagaattagctactcagaacacttagataccttttaattaatatgatagaaatgaaattattctaatataataatattctaaatacttggtttcaagttttgactttgtattttcatgaagagtcaattgaattaacaacgcagttgagcactgctgtgctagaaaatccagtctgtttctgcgagacctctttgtattagagagaaacttaactttaatgaggagaaaggctagactatagaaaattctgttgaactaaatttgacttttcttttagaagcattttgaacattccctgtgcaacaaagcgattttttctcctgacaatcagaggagagaattttcatttcattttgaagcattatcctataaaactataatcaaaaagcatacctctatctattactataacacagatcatatcaaattgcatttatcttagtggaatgtaacactaggcactgtgctagatgctaggaatatgtagaatccacaaccccagcagcattcctattctcatgaagcttctgcctaagacagttaattatcaaataggcaactaaaagagtaagtaagaagtgtgataaatactacgcaggagaggagagcatatagtggcagatctagtgtaatgtgggaatgtggggtcagagcaggacactctgaccaattggcctttaaagattttcaggttgttttagttaacattgggagggacctgggctaagaatgtggggaatggcagtccaagcagagggaacagtgccttaagaggtcctgcagtggcagtggggaaatgaaagaagcctaatatattcagtgagtgaggggtgatcggcttcagtatgagactaaagagctatgtctgggtcaaagtatatagaccttccagtgtattaggaaatttgactttagtctaaaagtgatgacaaaatcacagtagggccttcagtagcgcagtcgtttggaataacatagtggtcatggagata

SEQ ID NO: 69298 - DNA, 1122 bp, Homo sapiens
aattttgctatgtagagtaggtttaaaagaaacatgattaaactcttcaatagaagtctcttgtgtgtgcttttaatttttatccaatgctaatttactataattatttactatacttgaagatcagaattacaacaaagccaaagcttacaattttaggaagagtaaaactttaacgatctatacatttatctccacccgattttaaatgatattataatttaatatcaaattaacatattggagtgcattcattcttgtttgattgacccactattaaatgaaattttacaagaatagatttgattttctaacaattattgcaatttttgcatggttaatcttttatttatctggtaactttgcaaacagaaagaaatcttaaattggaaacatcactattaaatgatggaaatagaaattttaaaaggaatttttttgagatttccctaccgttaaaattagtacatttgttattatcattgttcccctagaccacaatacttctcgtctgataaaagacaaaactatggggtaactctaaaaaatagacaatgagctaagagacaagtaaaagtaagtttgcaatactatacagttaatagaccaaacgggcacatttggaaaggaaaaaaaattgttaactacacattttgtttaatgtttaatgtcttgcatcgacttaagaatatcttactcgaggagcaatgtttagttttcttttatagaaataggaattgacacatctgttgtaatctagcattgcttctgattggttattagattgttcattcatgtcataaatacttaaaaggcaaagaaccctcaattcttgattcgtttgtgatttgtttttctttcctcactttcagaatagtttctagttgatacattttaatagcagaataaataaatgatttgccaacatataaaatatggcagagttaaaaaccctacctctgacatgttgagagccaagtagattttttttttaatgcagaaaatacctacttaaaaattcttttaaaatgccaaacagccttttgcctactcagcacactgccgttggtgtaggagtggtggctgatattggcctgtgatttccaacttcatggcatcttg

SEQ ID NO: 69299 - DNA, 1021 bp, Homo sapiens
tcagctgaggctaaaagcaattttctatttaggtctgtggcaaagtcaataaatttgtcaacctgaaccaaacttgtttgctaattttgcaacatagtagttgactattcaaacatttccagaatgctccattatataactgaaaaggtggtttaggttgggttgaagagaggggcgtgcgatcagctaagcaatttcctcaaaacttgtgggtcattgcatttcacttggtggggtttcttagaatggaaaatcagagcctctcccaggggcctgggctgaaagctctttggggcttcatatttgggagggtctcaaatttagattttttgaaggtatcatcaaatgatcctaatcatgtagtcatttgtattgtatgtgtgttaagatgttgttttgttaaatagaaatgtttaaaatgcactacattttagtaatcccattttggattaaaacaatgcaaagatatatatgtatatttggtgtcttaaaaaaatagaagtggctcaagcttccacggaaatctgagaggctttgccaaagcaaattagaaaattattgatctttacttctttgtttgcaattaattttatatgtggctttgggggggggggtaacatttaattatctcttcttttctttccaattttttattttgtaagttgaggttaataattacagaaccatgtaaagagatgcctatagtgtacctaagttttcattactttacaagtgatacaaataatatgacagctcaggtatagaagtgcttgactcccctttatcatggcagagaattctgctatttgaataatttaggaagatttctgtaacatttttctatggattttctctatttttctttttttgcaagtatctatattaaaagagaaataaaatgaagaatttgaagtgccaaaacaatgacatcaaaaaagatcacaaattctctttaacactgtaagtctgaaaacgaaaaggcagacagcaaatccatattaaagagaagtaatcaaaatat

SEQ ID NO: 69300 - DNA, 1054 bp, Homo sapiens
atttgacaccacagccttttagtcttcagctcaaattctaagcaatcttagccaggttaacctcaaattaatgagaagtagcatgtatgcatgcttgcaagactgccttgaatttaagagatgtaaagatgggagattcccatgtatcttgtccaagacaagcatgttgtcttgtttgatcaagaaactgcctcaaagagagccagtcatccattcttgctgccagctaatccatgcactgattcataatgattaaaaacgtcttatatttgattctactgaatgtgattagaccaaaactgtgtggctgttttggcaattagtactaaaatgctcagcaacatcaaatggtacagtgtgagtgaaatgtaggtcacttactttagcatttggaaagtgtgtcgtggtacatctttgggtcttcatgttttatcaatctcacaaaaaagattaacccaaagcaaagccaaccaaccccccaaatctgccagtacacttgcatgtttaaacactggcgctgatgacaggttcaggggtaaatatgtaccatggggctgttcagcttcacaggttggttaatattaaacaaacacatattgcaaactgtgccttgttatgaggttgttttctgagattccaggggtcagggtcaaatcctcacatttttcaccttttccccagtgccaaccaatagtataacaagtgaaataatagtctaatacacagtaacaatacactttcaaagcaaaaagtgttgaagctaatttaattctataatctattttgctaatgtcatttcacttttataaaaaagaacaatagaaataccttgtatgtttataatgctgtatatccaatacatcatttaaccctcacaataaccttgtctaagttttcattagacccagtattaaagagaaaactgagttccggaatatttgcatgactttacttattcaaaaaagacttattaaatcggtatcatattaggtattgaagtcagagacaattctttaaatatgcatgtataacaaatgctcacaaatgttcacta

SEQ ID NO: 69301 - DNA, 1104 bp, Homo sapiens
ccaaatattaccctttaagattccttttgtaaagtaataataataagtaacttagaaattttctaagggtttagaagtattctatggtctcatattaaaatattgctgctatacacatttccattttgcagaatatctcattggtgcctatcactaacatatttttgtatgtttctttaaaagaaaaagttttctttatcttagaaacacgtatactctttgtgttgcagacattgctatggcaagtccatatattttattaaatgtcagactacagttaacagatgttgcagcagtgctggaggaattaagaccatgtcagcatttctctttaaatatatattttttcagggctttctatgtatgaaacgttaactccttaacaagttaacacaagacaaggaatgctaatgcccaagtggctggatattttaagggacctactaaagaaagccatctctcctggggacctgttaatattattaataacaaaagttgggaaccattcctgaaatgtttgcctggaggcctacgaattaaatttgtcatctgatttttagccaagaaatacagaattaaatttttgaattggagtttagttatttaatatttgatcgttattctgaattcaaaataatctactgcttatgaatagattcccttaaaatattgtgtgcctaggcgattttatggagtccactgatttaaaaatatacagccaacaacaacagcaactaatatttatttagctcttactctatcccaggccatattctaaggttgtaaattatctcattgaagaaaagtaaataaactagacacatgccttctttactaagttactgctctgtgcaaaaataaaaaaggaagaaagggaaggatggaagagaggaagggaagagttgaataacgagcaaaaagtggtcttaatttaccagtctactcaagagataaaaggaaggccatctcaatatgattcatattctcaatctctgtgtgtgtgtgtgtgtgtgtgtgtatatatatatatatatatatatatatatatatatatatatatatcctttagccatttataatccttgaaaagtcattttgcccaaa

SEQ ID NO: 69302 - DNA, 1055 bp, Homo sapiens
gctgtcctcatcaaaatcccaatggcattttttacagaaataggaaaaataatcataaaatttatatggaaccatgaaagactcaaaatagccaaagtgattttattaaagaacaaagctggagccatcatacttcctgatttcaaaatatattacaaagctatagtaactgaaaaaatatggtaccaaaaaacaaacaagacaacaaaagctgtatggtattggcataaagagagtgatagatcaatagaatggcatagagagcccagaagtaagcccacacatatatggccaactgatcttcaacaagggtcccaagaacacacaatagggaaaacatagcctcttcaacaaatggtgttgggaaaactgtatatccacatgcaaaagaatgaaattggacctttatcttacatcataaacaacaaaaaactaaaaatggattaaaaacttgaatgtaagacttgaaactgtaaaactcctaggataaaacatagggaaaaactttttaacattggtcttagcagtgatttattggatatgacaccaaaagcacaggcaaaaaagcaaaaatagacacgcagtactacatcaaactaaaaggcttctgcacagcgaaggaaataatcaatagaatgaaaaggcaacctgcggaatgggagaaagtatttgcaaaccatgtatctgatgaaattaatatccaaaatatataaggaacacctacataacaaataacatgatttaaaaaaggatcgaaggacttgaatagacatttattcaaaaagacatacgaatggccaacaggtatatgaaaagatgctcaacatcagtaatcatcaggacatgcaaattaaaatcacaatgaaatatcaccacacacacattaggacggctattatcaaaaacacaaaagataacaaatgttagcaaacatatggagaaaagggaacacttgtacactgttggtgcggatataaattagtacaggcaatatggaaaacagtatggaggttcctaaaaaatgaaaaatagaactactatatgatcctacaatc

SEQ ID NO: 69303 - DNA, 3349 bp, Homo sapiens
gataaaatttacacaaacatacaacaaaatccaaacaaatgttcttctatgcttttatgaggggagaggtggaggggatttctcttctgattttagtttttaatggctatatttttcattttagtatattatagcagagtcaggaagtacaaatgtatttttaaaaggtgatgtagggaattgaatgacagtaacaaatgctatccttttatctttttagtagatgtttatgccagtcaagatcctgggttttcataacagactttgacaacttttgttttgtaaggatctattattccaggtttttattccaagctcagaggtctgcatacctctttaccatatccatgcttgtaaaatactcttggtcataatgttattaggaagggaattcaattacttctaccacccaaagcattatttgaaatgttagcaaatgtccatacgaaatgtttttcgatagcgtgatttcctctatcataactaaaacaaaggaaaaaggagaggagatggaaaaaagaactaaataatactcatgccagacagtccagcccagagaatgtcattccctgtatatgattatttcttgttggctatttctgcctattgttcccaataaatctaatgtgtattcatgattaaaatgactattatctcagttcccttgtttcccctcaattttgtctcttttgttcactactgtcaccctgatgcctaacacagtgcctggtataaacagacactggtacatgtttgttgaatgaatgaaggaagaaagaaaacatgtttctttctgttttttgacagaaaatattcttcaaataaacatttttttcatggacctactaaaggcctttgcaaaatgattttgtgcattgtttatagtcaatacaaatacttttaaattgtttacttaatttgcatgattgcacatgattaagagtataagcttggtaggcaaggtaatgtggatatgaatcctaatgccatcataaagttgggcttcctgggctcagatcttgactctaccatccaacttcctgggttccaattttggctctcccactttttgcctgagttaccttgagcaagtcagtccactttattgcttcactcatctctgaaatggggaaaataatagttccaacctcacagggattttaggaggatcaaattagtgaatatttgtaaaacatttagaatcatatctggcactttttaaaacaacagctatggtatagaattattgtgatgatgatactgcatggcacgtaaacactcaataaaataggattgctactatagatattatcgcaattcttcatttctataatctgctatgaagatttggggccctaacagcctttccatgttttggtccagtgaaagtcttattgtttctaccttccctttcactcgtaactctttctacccaccctgtgtttgtcctgtcattttgccttgcgtcatttattcattttacactgcatactcctaagggcagggactttgctctttgttttggcataatttaataacactgggtacactcgcggtactataaagatgttgaagaaaaagaaaaaagacgcaatttaccaacaggcaactttggcttacggcgggataggtcgctgttctgtctgcaatgttggtactcctgcaggccgcccagcagcatctaggggcgtggctgggggctctccagtgaccgcacgtcctgggcggccactggggtgtgcgcagcgcctggagcatgagccgggtggtggcgtgcacggaggatcgcgggaggctgccgcctcgggacaccccactcacacaggtttgcttgctgcttttgcgtggcaacttggttagagggtccaggagagtgggtgagacgaacgtggaaggggaaagagaaaaagacatactgcaaagcactgaaaaacgaggtgggtgggagggattcattaagaagagaggctgtggcagtccttgcttttaagaagcgtttcgtgcatgctagatagtgctattcaggctatagtcttgtttctggaatttttccaaatgggaggaatgtgtttcaaggatgcagagtattctttaaaaccgtatgaccaaactgacctctattgttaaagggatctaactaaaagggttcgtgtttcccactttgctttgtgaatgcctgaaaagcaatccaaaggttgagaacactggaaaacagagctattttattgcagtcctgagaatgcagtcattactgttttattccttcttatcttttgaagcaatactttagtaattctttagtaacagtatgctttaaagaaggtatctgacacatttttggcatgtgccactatgctatatttcattattctttctgtacagaggcatctgtaaggaatatatatatatatataaactttgtatattaaagtaattataaatttgcatccagttgcacagagaggccacctaaacctttcacctggtttcctccaggggttacatctgacacactttagtacaatattaaacccaggaagctgacatttaaacttcgtatattaaagtaattataggttcgcatccagttgcacagagaggccacctaaacctttcacctggtttcctccagtggttacacctgacacactttagtacaatattaaacccaggaagctgacatttaaactttgtatattaaagtaattatatatttgcatccagttgcacagagaggccacctaaacctttcacctggtttcctccagtggttacatctgacacactttagtataatattaaacccaggaagctgacattggaataatgtgtgtatagtttctatgccattttgccacatgtgtagatttgtgcaatctgacccactataggcctgtcaagatgcagaacttccacctgtatcttgcataagatctcccttgttccacctctttatcattatctccacctgctcctcgctaccccggcaaccacttgttttccatctctatattttcatcgttctgaaactattatataaatggaatcatactgcatgtgatctttttgagactgagtttttttctttttacactcaacttgatgctcttgagatccatgcaagttattgagtagatggatagtttggtcgtttttcatgctaagtagcattccagttgtttgactctatctagtgctgcacattttcctttgctttttaaatcagtgaaacttggaacttcagtgggattaaggaggtacttgagggcacttgaagaggtgaaaagtgtgaggacgaaatgtgaatatttttattttcaaaatgacatttgtttgtgttagggcaaaa

SEQ ID NO: 69304 - DNA, 1050 bp, Homo sapiens
tcctatttttagaaccttaaccctccttttttttttttttactttttacatatccaaagcaaatatttctataaaaatcaaaggctgttatatattttatatacatcaaaacaataatatatcaaaatgattacacagttttaaaaaatgtgcttccacctatcaattgaaatcatcttgcaagccactactgccctgatgatgttctgcaggaaggataagaggtagaagtaggggagggacaagtgaaaggaaaggtgctttaagagccagtctttatactaagccctttaatgtgaatctcatttaatcttcacatgatactctattctataggtatttgttatctctgttttacagacaggaaattgaagaggttaaggaaagagccaagagtcacaaagctagtaagtaacaatgctgatattagaataaaattcatcctatgcaaaagctcctgcttgttgcaataaagacagcagtaaaataaagacaaccagagggaggagaacaaaaacttaaggaaacaagggtgttagaaatgtgttacataacacagtatggtgtgagagataggagaaatggaaaaacagaatcactttcatgtctcttagttctttcttccactgtgtatataatgacctaatttcactcattcattccataaataattatcaagtgttactatcttcaaagaactatattagggagtttcttttattcctatcttcctagcacctagcacagtgctgggcaaataccaggtgctcaagaaatatttgtggaacaatgaatgagtctactggaggaaagaatagataaggaaacatttgcaatacagcatgattaaaaaccagggaaaaggctgggcaccgtggctcatgcctgtaatcccagctctttgggaggctgaggagagtggatcacctgaggtcaggagttccagaccagcctgaccaatatggtgaaacaccatctctactaaaaattacaaaaattagctggatgtggtgacgtgcgcctgtagtcccagatactcgagaggctaag

SEQ ID NO: 69305 - DNA, 1477 bp, Homo sapiens
tttctttatgtaaagttcacgtttgtcacctccataccaggaggaaatttagtgagtcatctaccctgaacactcttttacagactttaaaataaagatccacatgtacttcagcttataggacagatccaataaatgcaaccttgactcatggaagaaatctaaccgtcgaaaaataaacccacaccaggatcttctcggttatcccggacccaggaaagagggagcagggaccgggcttccaggcttcactcctgaaggacagctggacatctcagccccacctgggaggatgctttggtctacttctcaggttgccgcctgacgattggtggctggcctggaagggagggtccgcaggaaacgcgacactggggatgttgcccctatcacatgatggaaatttccactctttagaaaggcgaaaagaaaagaaagaagggtctctccatccatccctttctgatactttccctgaatcccagtctggaaagggtagtaaaagaggcgggtgagtgaatttttttttgtatttcctgttagacttgagacttgtcagtgtccaaacttgcagctggatcccagcctatcggatgggtgcttgtgtgtatgcacgggggacatccacacgtgtgtagcccggtctctcaatcatctggggcttatgtctggggctcttcatgacatgctcatagttcctaattcttattattttccaaacattcacgctttgggtgggttattgcaggctaatgattcggttgactagaaataacgtaaactagggcacatggagggaagagactgattgggcgggctcatgtgtgacttcttttcaaggagaagcggttgtgccaaggtagcctattccaggagggctggggtatggggcacctccgcctcccgcactgggattccctgggctgttggatttcgagttggttgtattgggactgcgttccgtggccgcgccgcctgcctggctgagaggcccgacttcccccgcgggagctggctccgcgaccgcccgggatcctgctggcaaggtgttacccgagtccctggacccgcgcccgcgtcctcaggtcggggacactgggtggaaggcttaaaatagaactgtcgtctctgatagctgggtcgccccagagaccagcatgattccccgggcggggtactctgacctggggagcccccaaggagtctctttcaagggagaaggcgagagcagagctggatgtgggcccctggtctctgggcggtgggcgagtctgaaaactgcgccagcggttccgagggcggcttaccgcgcggtcggattgcccggcctgctgcgcgctggagtgaagggcagggcggtgcagaaatgcgaacggggacggatagtggggtcgcggcaaccgagctaagagaagcctagggaggaggggcagaaggcgggaattgattacaggttagagctgatggaggaaaaatt

SEQ ID NO: 69306 - DNA, 2249 bp, Homo sapiens
aaggataagttcatatcctttgcagggacttggatgcagctggaaaccatcactctcagcaaactaatacaggaacagaaaaccagacaccacatgttctcactcataagtaggagttggacaatgagaacacatggacacagggagggcaacatcacacaccgggacctgtcagggggtggggggctagggaagggatagcattaggagaaatgcctaatatagatgacgggttgatgggcgcagcaaaccaccatggcatatgaatacctgtgtaacaaacctgcacattctgcacatgtatcacagaacttaaagtatatatatagcatcattgagtattttcatattgcaatgtatgctatttgtttgtttgttttaatttcaaaatagaaatctaagcaatgtctttcagagatcagctactaaggaaaatgcaacatcatcttatgcctgctcctttgtatttattttaaaacaagttaatctatgaaaacatctattttgaagagaactttagagaacttaggctattttttaaactatctagcctataaattccccaagagtgaacacttgtctgcctctgaccactcagttattcagctatccagttctcagcatggaaattggcaaaacattttcccatcttagcagcttctcatcactgtagccttttctagacattagcaaaatatgttgtaaaatctttttaaaatataaagcatgttacacttaagtataaattgctaatatcttaaaatattgttccaacccaagatatttaaaaatctttaccaggagaaaagtttcaacctaaagagatagtgtaggaagaaaacaaaacattggcctgacttggaacccacaagggcccagtggtccagtcctgacactgcagttactagccgtgggacattaggctacttgtgtcagcattctgagcctcattctcttctttcagagaaaggggtctgcgtggagctttgagacatcttcaatttcatatattgaagtagacattccagatggaggggaggttggagaactctgggaccttaaagaacaggtgtagtgggaataagacaggctggaagtatgagaggctgtcagagcatgagatactagaattcaagattcaacattagaatagttactgagggtaaggccaagggagtgagaggctacagtgaggtggtagcaaagtctattgcaggtggggtcaggaaatgtggctaggatttgatggagatctccctgggtaataagagggattttggtgagaagaaagactgtgagctggagcccaatatctttagtgaatataatacacgacctggaaattagtagagcatagtaacttggtgcagccatgtaagtgccagacagactttagttcaaatcacagctccaccgtggaccactgctagtttttgggcatgttgcttaccatgtcgaatcacagtacactcaactataaactgtgagaaataaatacgtctatcccacagagctgttatgtgtagcagatgctagtataataattacctacccaacaaccatttgcatcttcttttttactaacaaaacaaaatcctttatgaagctaaatgctcaagctaagttggtcccagccttagacccactgggtagatcttgattcgtcttagccagtcatggtgatcccttcttcctttccaatgattgacttatgaaagactcaatactggacagtgtgatgtaggataagctaagatgacttctgggaaatatttcctatctttttactttggtgtgtgaagatgtgatgccaagagcttctgcagctatcctgaggaaaactagcagataagctaagcttaatgaaagaaacccttagttacctatcaaaggcagtatttgaaagactaatgacaaaatttctgaaaacagtttggaacttgagaatttggattgaaatataatctaaacattgttccttcttagcaacatagaaattgcattattatctttaaaaggagaatagagagagagaccttgaaatgagaagctaacagatctgtcttttaaaaccagcagtgactggaacttaatgaataaattattggatgttctacccttctacccctgtagttattatgtgccttaggaggtagattaatgttggttcaagaagtataaagtgagtcataagaagagaatctgattcaatgatcttgacatttattaaatgccaaagatgataattt

SEQ ID NO: 69307 - DNA, 1700 bp, Homo sapiens
atgaccttagacttgtaagctcttgtcttagttcatttgggctactataacaaattatcattaactgagtagcttataaacaacatttatttctcacagttctggaggctggaaagtctaagatcaaggtgccagcagattcagtgtctggtgagggcccattttctcattcacagatgatgatgccttcttgctgcatcctcccatggtggaaggggctagctagctctctggggcctcttttcttaaacgcaccattcacatgcatgagggatctgtcctcataatctaatcacctccccaaagccccatctctcaatactatcccattggaggtttggttccaacatataaattttgggagacaccagcatgatgtggatgatagcagctctgaaactcatcgtaacccaacattctttggacttaaagatgagacctttagctaacaaaacttaccatgaggtagaaacacagaattccagtgtattagattttaaagggaaatgtgactgtcaaggagatctcacatttaggtcagtctgatcagtgcaaagtacctgagacatttactttggggaatcaggagagttggttatgtgaaaagaatgtgcaacaaacatcaactctggcagtgtgatgtatccatcactataataagaatatgctggccagggagcctgggtaaatccacttcttgttgcatgacttggacacacacaattcaagtttgcttgcaatcttaatgtgactttaaatatctctctttactccaaattatgctggacttacgtcatagcttaactctcaaagagcattctcactttccttatttctaggttttaaggaccatccctgtctcacctccatggactgtctacaatatgcatggtcaaaaagtagacccgttctgcaaccggacagcagagaaatgtgtctgtgatacccacacagtcaagaggcacacttaaaatagcatcagaccctaaaaaaagataggaaatgaccacagaccagtgggccagacagcacatgtatcctctgtccaggacccatggccactgttggcaggcctaccactgaggcaaatcctactaggaggtggaagtcatgaaaagagtttttccacattcctttctgtgatctacagtaaaaacctcagggagatattgaatcatctgctgttttttacaaccccaattaaacaaaattttctgcacctccttctccttccgcattcttccccccacccagtttccttcttcccccttttcgtcaatggagtggtgtggaggagggtaactgaagctaggttggggatttgttcccagaccacaggaattagaaacaatttaaacaaatgtttaaattatcaggatcctctttgtttctagcttaactaagaattgcaaacggtatctatgaaatttctctttttcacttcccatgtgctgtttccaatgcagtttcatgaagacacatacacaaaatcttctaaaatccttgtcttttcacatcacaccaaacagtaatactgttgattacacaggtaaaacttgcctcaaaagatgttttgtagtcgatatacattaaaccaaagcagagtattttggggacccttaacacctaatttttttttttttgttaatcaacactttcatgttttcttgaagctaatatcagtttaggtgcttatcact

SEQ ID NO: 69308 - DNA, 1041 bp, Homo sapiens
cagcttggctatttttataagccatgtcaaccagttgtttgaatggatcagcccattccatcataggaattgacctggttactccataggcacaaggagatgagaagggagggggaatgggtgagaaaaggaacctaagctgagcaatgcagaagccattgaattgtgacttccaagaacttaaaaatcactgattagtcagccactcgttggaggaaaaaagtaagataagactttaatccctgaggacttatttctagtatttgttctataggaagaaatagaagtgccatagttttcagtctctctttcagtcatcccttttctctcttattcctctatttattcatgccaatcacggtgttgagagctaatgaagagttgaggtggggcagaggtgagggtgattcaaacgtaaatgaacataagtcctgctcttcaggacattccccacctgtaaaggaatgaaacacacacaaatataaattgccatgatgggcaggttaccactgtccttactgccagcactgccccagccctggttgtccctctgttccatgagccctttttctgtaaaatgcttgaagatcccatgtctcccacagttctggacacacagcaaatgagcaaaagagctgcttgtgtttcattggtttagtaacactccatttcttttctctgattattaaatgaatttgcatatatttagttggcctatgagatattagacctggaaatgttacaaagtaattttacctgaatttagtagatttaatattttaaaaaatgtccccatcttccacccccaaattaatcattttagtagtcagggacaactgttatataacacagtcttcttagctgctcaaaggtcaacagttaatgattgatagatcaggagcatctctgaattttgaaatcatggagtgtgatccacatgggtgctatgattcagatgacctgcacccctaggcctctttattttaaaaatatacttttacttcaaataaacatactgctcttttaagttctttgtcttat

SEQ ID NO: 69309 - DNA, 1047 bp, Homo sapiens
attaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctat

SEQ ID NO: 69310 - DNA, 1034 bp, Homo sapiens
tggagacaccctgtaaaattaacatgtcttacatcttcctataattattttatgtgtaaattatttaatatgcacaatgaaaaataattgtatacgacaaagtgaactgctatgccaggctctgatccaaagatattgtatggattggtttttggcatctaagggcactttagcttttacttcacattagtgaaactatattcttttaaattagctcactagaaatctatgctagttagaataatgaaaacttgaaataaataaggtatatagaacaagaaaatattcctgattcaattgtttcatgatttctattagcatatcacattaatgttttgtttcaaaatatgatggttactttctcaacatgtttctattttaaaatgacctttactatcaacgtatctacatggtgtcaagtaattggaaggcaaatacaaaattcatataaatatttgcagacacaccctgagtgtgatgagccttgattacaaaaaagatgttgataagctctgtcctcaccaataattatttgttccttttggaaaggtacatagtctgtcaaagcaactgaattatttctagtctgcaaataaatttaatggagcaaatactttctaggtcacagtatgggaaaggtgacatttttattatggaaagagtgaaggtctgttttttgatctgctgaaaaaaatagattggcatagagtttttttctagtcacaaaattgaacattttattttgagatgttaattttcaaaaaacaccatcagataagaaaatgagtctttgtcatatacattttgtcccaactttataataattcattactagtatagtataaggttttaataggtagttagatcatttgagccaaattatttgccaatctaaatattaattattcatttattgaaaatgtcaaagttgtgagatcctggactgtgttaatcatgagtgttttttaaatttaattttttctttattcagaacaacattaagtagcaaataaaaaataccactgcaagtctag

SEQ ID NO: 69311 - DNA, 2022 bp, Homo sapiens
aatgtctgaagttgatttctgtctcagcagtaaaataaaagaacatgtttaattattgatgtctgcaaaggatgcaggtgtggtaactggaagaggaactgtcatgcatttgagattcctagtcttgagatacagacaaatctgatgttcaaagctggctttacatgatatcttctgagttgaattatatgtttggaaaattagacaaaccatgcaatggggttagtgaggcttttctgcacagaaaacaacagggaatgcttagcaaggtagaggtttttataaggacacttgggaaagtgcggaagtgcagaaagccatctctgaatttccttcaaatagtcctgggtggtctggcaaagaaactgggaagctggcatccacagctcctttctccatctctgctatcattaaaactcagctgctctcttctttcctttcattgttcctgccttaacaaactaattcaaattctctttgcctaccagccttctgctttctgccttcctttggtactctatttccctgccatattcctatctgtacatctcaagttaaaattcccttaagggagggcacagtggctaacacctgtaatcccaacactttgggaggctgaggcaggtggatctcttgagctcaggagtttgagatcaacctgggcaacatggtgaaaccctgtctccatgaaaaatataaaaattagccaggtgtggtggcttgagcctgtggtcttagctacctgtggttccagctacttaagaggctgaggtaggaggatcgcttgagctcaggaggcagaggttgcagtgagccataatcacaccactgtactccagcctgggtggcagagcgagaccctgtctcaaaataaaataaaataataaaattttaaaaatattccccacagagagtaataggtcaacccttcagaatggcatgcccctcttatcctagtcctagccaattaaaaaaaaaatttttttaaagaaaaaaaagagtggcatgcccccttgggtgggattctcatgccaggttatataaataccactgggcagtctaaagagagctcctgaaatcagatgcccattcctagtccaatcacctgtgactatagtggcggaatcacaaggtacaaaggatggagaggagaccatgcgtctggcaggaactccgagggaccccagtggggagtggtgtgcctagtaggcatctgtccattacaaccatcaatagtgtagtgtacacactgattggacttgcatggcttcaaatgaagaaaaattttcttataatgagcaaaagcagtggttttcaaactgtgcttggcaaaatgtcttgagttctgcccaaagaagagacttagtaggtaagactctgacttccttgttcccttttcatctagagcactttcatattattcagtttcatatatgggttttttaaaaataaaatttcacttgaagttaacatgctactgttcaaaagtagtttgagagccattgagttgtaggaacacaaaaaacttttgtttggctaatttttttaagtggtaaggctttattttaaaaggttagtagttaatacacacaataaaataaaaagtcacttaatatattttacacaattttttgtaaaacaaaaaaagggtagggtagataggaaaattgaaattggttatttcacaacattatattcttaatcacaattgtttttgtgtcttggatgttattaatgaaaattgtttaattgtgattttcactatatgtttgaggctaaatgtggtggctcacacctgtaatcccaccactttgagaggccaaagtaagaggatcacttaaggttaggagtttgagaccagcctgggcaacatagtgaaatcccatccctacaaaaataaaataaaataattttacaattagccagatgtgttggtgcacatctgtagtcccagctacttaggaggctaaggcaggaggattgcttgagctcaggaattcaaggctgcagtgagctgtgatt

SEQ ID NO: 69312 - DNA, 1061 bp, Homo sapiens
ttcctccatactttcaccagtactcaccattcaatttctttctttttttttttttttggccaatttgatagatatatcatgttttggtattcatttcctttattataatcatctttcacatacttcttgcccatttgtacttttgctctgtaagatgcatgatcttatcttttgcccatttttctattgatttgctcacctttcaattcatttgaatgagcgctttgtaaatcaagaaaattagcctgtccacctgtcaaaagtttctaatgattgaaataaattattttcttccctttatcttaacagatagacttcttaagccctcttatgcaaagaatttcaggctgatttcactttaaaatgagatataggtgataacaaaagccaaattgtcacctactttaaaggataagtgaataataagaaggcagcatgatgtacccaagggaaatttgagtgatcttagctgggaaagaaaccaaatattcatgcctttatgcactgcacaaaacttgcacaccagaactttaaaagatgactctttgaaagtagttcttcagtgtctttcatactccttaatcttcccaattttaagtaacactgttgacaaactttaatttccattttaataatcttagcatcattatgagatagtattaggcaaatatttaagtataaacgatatctacaaactttaatttccattttaataatcttagcatcattatgagatagtattaggcaaatttttaagtataaacgatatctacatatactagaagacaagtcatagttcaagagaagcatgatataaaaaggccattatgatgagagtcagtggacttggattctagatgtgccaccgtcactcctttgccacgtaaccttgggtaactccctcagtttctgtggttctgttttctcatctataaaatgaaaataataataacttttcttcctagccaataccttgttttgctaattaaaagaactcatgaagtattttgcaaactatgcaacactctcgattactgtaattgttgggaagtaacatatct

SEQ ID NO: 69313 - DNA, 1048 bp, Homo sapiens
tgtgaactttctctccatgtttactcaaagtaccagaaatatgtagggacagcctccacttatctcgagatttcctgctgttcatgattcagctcactttgctgttctttttcatttcctctatcttacattttgattgttttttatcttctttttcttcagctttattgcttgtttcattggttcttagcccagtgtctgaaagtgaccctgagaagttgtctaagcagaaaagcatgcattgtgtttttagattgttcaagacagggccgccattaccccattggatgcctttgtgcaaagtggaaaaatgtgtccttttctctgaggagatgcagccctacactagggtgcatggcttggttagcagaaggcagactgatttcaaaatccagtctattgtgcattcttgtgccgtgaatggagaggtgcagccctgtttagagaagagcctgtaatcttgcttaaataagtcactacagcaactattatctcacagtgaaaatgttcctctttaaaggccgctaaataaatgaatgaccttggacatacatttatttcctcacttttcagtagtttacaagatccctgaacaccattcaaggcttatattagtggctttctgctaccgctaacatcaaatccaaaacaccatggacttacttgcaaggtcttatttgcactttcagcatagcaccatggacttattagcacactttagtgttatattaccatctcacacttgtcttcatttcagcaaacaattaataaacatggactaggagccaaactcttgaagcacaactttcgtttatcaccagcttcgcattttcacctcatctaaccctactaacaaaatgcatatccttgaaacttccaaacagaagactctggggatgtttggcaaaacctcagcataacttctgctgctccaggcttgggatccacagaagagctgcctcttgggtcagctcttccagccctgctcggctcctcccttggccactcccagtcccacagaccctcctctatgcactgtgctcagaca

SEQ ID NO: 69314 - DNA, 1121 bp, Homo sapiens
ggctcacccctataatcccagcactttgggaggccaaggcgggtggatcacctgaggtaaggagttcgagaccagactggccaacatggtgaaacaccatctctactaaaaatacaaaatcagccgggtgtggtggtgggtgcatgtagtcacagctactcggagcctgaagcaggagaatcgcttgaacctgggaggcagaggttgcaatgagccgagaccatgccactgcactccagcctgggcaacaagaccaaaactccgtctcaaaaaaaataaataaataaaaataaaagcggtttgtaaactgtaacaccttgcacagaaacacaagattactactattaaatattatttagaaaagtagagttcttcttaccatttccctgtttctttcttctcacttcctcctttccccttctgaccatcttttcagccgtgaacataccacaccagcaagaacaataagagccaagggtctgaattgtttaatcaaaggaagagtcaaaataagctacacccagattactgagaaaggtgaaatgaaaacaagctcaaaaccaaattccaggaagatgctgtctttgtattgacttaccatttcatgttttcacacatgtcaaagtcttgaagcttcggtcattagtcttccgcttcctaaagcaagaaactaaatgctgacttgtgtcgtttgccccagatgccaccggaaatgtcatcttctccccagacgctggcttgcaagcacagcagcacccagaggctaacctatttcccctatagcccaagctctgagatctcccgtctggtcacaatgatctacaggagaggaagaaagctatctagggacgagatctagaatcaactgagagagatgcttaaaaatcaccagttactttaatgagtaagtacttttcagtttttccattttatctgaaactttaagttggcatttctgaccagcctttcttgagaccatcattttttgggcacttactgtagacaggaatcagcaccctagcctccttcagcccaccccatgtaacactaaagagacaactggtgcttggcaataacaaaaatattagtgattgataaacttgtaaatttattaaaatgga

SEQ ID NO: 69315 - DNA, 1052 bp, Homo sapiens
tgttggccagattggtcttgaactcctgaccccaggtgatccacccacctcggccttccaaagtgctgggcttacaggcgagagccaccgtgcccggccccatttcgggttctaactggaatgcttcttcccagtcattttcccctctctttccttctcacagtcatagctgcatgttccattagagaagaataataaggccaggcacagtggttcacgcctgtaatcccagcactttgggagggcgaggtgagtggatcacttgagaccaggagttcgagaccagcctggccaacatggtgaaaccccgtctctactaaaaatacaaaaattagctgggcatggtggcaagtgcctgtaattgcaggtatctggagaccaaggcacgacaattgcttgaaccctggaggcaaaagtttcagtgagctgagatctcgccactgcactccagcctgggtgacagagcaagactctgactcaaaaaaaaaagaagacattcttaggtaaacatttttgtcagatattggccctgagctcttggagcaacatttgggtgggttaagtgaactggttaggatataggacctccagaagtcctcagacactgtgaggttgtcagtctgcagaactgtgttttggctcttcttctttgttttttcttttcctttttttttttttgagacaaagtcacactctgttgcccaggctggagttcagtgatgcgatctcagctcgctgcaacctcctcctttctggactcaagcaattctcgtgcctcagcctcctaagtagctgggattacaggcgtgtgccactacacccagctaatttttagtatttcttgtagagacagggtttcaccaagttgcccaggctggtcctgacctcaggtgatctgcccttcttggcctcccaaagtgtagagattacaggcatgatccaccgtgccctgcctgggttcttctgaattcaaggtctttatgtgtttttatgtctcttgcttgagattaggatatgggattatactcattcaccacccatcccctcccttc

SEQ ID NO: 69316 - DNA, 1011 bp, Homo sapiens
agtaggcacttattaagtgtgagttggagaaataaatgaatctaaacaaatgaacatgcttgagtcccaaagggatttggagtttgcttcagttttgttttgtttttctttgtttcaaactcctggtctcaagcagtcctcctgcctcagtcttccaaagtgctgggattacaaacataagccactgcacccagccaaaacttttattctgatagcaaaaatattttaatgaaaattctttgtggggaagatgtcaatattttcaactgttctcttatgaaacttaatattctatctgttttaatattttcatttttgtatttatacccatttaaaactacaaataggatatatagcttttaaaacttgaatgtgtaatttaataatagctatccacccatacctattaaaatgttcctacatctattaaaatgtttactaatgcgtaaaatcttacaaatttcaagccgcaccggattttcaaggcttttgtgtaagtagatgaagtggatgccatgttcctcccatttgcaatctgttagcagtattttagtgtttctactatttagtcatctgtggatatgagttgtaaatggcaacttgaaataatctgaagttttgaagatgagtttcacagtttttaacattgcatccaatgtgttggagagaaaaaactttttctctactcttttagcatcagtacttgggggcgtatagattaaactaacaaaagacagattaacaggagaaaaagcacatacttttatttatttatgttgtgtgtgtgttgccaagatacagacctagaaattttatttatttatttatttatttatttatttatttatttaatttatttagagatggggtctcactttgtggcccaggcgggagtgaagtagctggaacactgcttactgcagcctcaacatcctgagcccaagccatcctcccgcctcagtcgtgcgccaccatgcccagttaatttttgtataaagatggggttttgcc

SEQ ID NO: 69317 - DNA, 1041 bp, Homo sapiens
tcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaagtagttgtgggttttgcatgtgtctatatttaatggatgcctctccattaaatgattagttcttaatatggtttgtctctgtgtccccacccaaatctcatcttgaattgtaataatccccatgtgtcaagggagggaccatgtgcaggtaattgaatcatgggggtagtttcccctatgctgttctcatgataatgagtgagtctcacaagatctgatgggttttttttgtttgttttttttttttgaggcggagttttgctcttgttgctctggctggagtgcaatggcatgatctcggatcactgcaacctcctcctcacaggttcaagcgattcccctgcctcagcctcccgagtagctgggattacaggcatgcac

SEQ ID NO: 69318 - DNA, 1038 bp, Homo sapiens
tcagcctcccaagtagctgggactacaggcacatgccaccacacctggctaatttttgtatttttagtagagacagggttttgccatgttgcccaggctggtcttgaactcctgacctcaggtgatccgcccgcctcggcctcccaaagtgctgtgattacaggcgtgagccaccaagccgggccttagcagagggtattaaattaaaagtgctttactgagtaattccttaataccaggttctcaaaccgttccactgaaatacctgtaatggtggagatgaaacccatatatacaggaggtctgcctgctgcagctactccaaggattaaattaatttcaagcatcatataaaatattaactgaaattctctgttcacttcatgcggtatcctttgttttataaataataataatcataacgcccttcaaaacattgaataaaatcagtgcaaaacattgagcaaaaatgcagtgggatttagggtcctaatccataaaatagggggatgatagcatctcttataagattattatggacaactaaaattgtatttataaagcccttagaattgtgactggcacatagttactactttaaaaatatttgtccatcaggtgcaatggctgatgctgttaatcccagcactttgggaggcccaggtgggaggattgcttgaggccaggagtacatgaccaacctgggcaacacagtaagatcccatctctacagaagacttttttttaatcaggatcccttgagcccaagagatcaaggccacagtgagctatgatcacatcactgcattccaacgtgggcaatagagactctctcaaaaaatagggcctggcgcagtggttcatgcctgtaatcccagcactttgggaggccgaggtgggtgaatcacctgaggttgggagttcgagaccagcctgaccaacatggagaaaccccctctctactaaaaatacaaaattagccaggcgtggtggcacatgcctgtaatcccagctactcaggaggctgaggtgggagaa

SEQ ID NO: 69319 - DNA, 1010 bp, Homo sapiens
atcatactcagaaaagaaattccaggaaactgcgttccaattaacatggaaatgaatccacaaaataaatatgtatccagagtttatgcaatcccagggtacaatggagacagatgcagattgatctaatctggttgcattaggaataagaatgtttgttggggaacattgtgtggaaagttgacatttggttcaatcaggaaggccaaagtagaaattatgaaagcaatttcctttgtccagttaaattaggcattcaaataacaggctactctttgaccttcctgggaaaggtcaggatggcatcgaatggtcattaaataaatagcaggcctgttcttgtaaatactttgtgagactttaggaaaacatattctggattgaaaatcagccaaaaaagatctgcaagaatttctctaacatatttttattgcttctatttatccatttttaatttggagaaatagtaagtactggtaaaagcacaagaacaaactgaatatggggtctattgaacaaaattaagaggtcacttttctgccacttgctaatatgtgctgcagctgctaaaaaaaggaagttttgttgtttgtttgttttggttttggttttggttttgagacggagtttcgctcttttgcccaggctggagtgcaatggcgtgatctcgcctcactgccacctcctcctcccgggttcaattgattctcctgcctcagcctcccaagtggctgggattattggcaggtgccaccatgcctggctaatttttgtatttttagtacagacggggtttcaccacgttggccaggctggtcttgaactcctgtcctcaggtgacctgcccgccttggcctcccgaagtgctgggattacaggcgtgagccaccgcacccagccagaaagaaggttttttgaaaaatagctcctgtggatgtctccccaaggctccacttgatatagctaaggagaattcctggcatgtatcataagatatatggtttcttaat

SEQ ID NO: 69320 - DNA, 1049 bp, Homo sapiens
tccatccaagaaaatacttgcatccagagagaaacacaatacagactcctccgtgtgcacccaagcagttgggcaaagcataacacttagttctatataaaactaaacctctcatttcaggaagtaatggaaaaaaaaaatcaaccaaaatttctgcattgagataataaaaatatcttttgttattccttaaaggcagattgtagatgtactacatgttaatttgctgtcaatttattcattttttaaaatataatctcctccagtcaaggtggatttaattccattttcatcttgtgtacttcctttcaaggcttggtaatttcttttctatttttatccattccacttttgcttcctgtcaatttttatatcaaaatctgcttcagttccatttggcaaggtgcagtaacaaaaatacttctcatgctttaatgtttaaatttgccattgcactttaatatggttctctgtttgtgccaatggcgtaacgtcagctctttcacttggcacagatcctggacttgcagaaggcaggagttcgatttctataatggttcttcatcactatctgaaattatcctttttcctattcatttagtgtgcattgcacacccactatatgctagacactgtgtgtgtgcagcaggaatgcagcttacataggagataaaataagacagcaactgaaaaaatgctggtatatgatgtcagcacaggtgttctgaggaagaccgtgcccctgccatcatgcagaggaggagggaaaagaactgggacacataccagtcactagaggccatgagatttttctcttatctgaaagaagaatataaactcaatgtgtcacagactgaggccattctgcagccactaggccatgcgacattaagccataggacacaggtatgattggctagaagcctggtccaagaaagggccctgtgggagtgcaagggacactacttcaccactgagaccacagccatggatacagactcattttaccagcattttgaaccacctgtcatgccacagggagtgtcaag

SEQ ID NO: 69321 - DNA, 1388 bp, Homo sapiens
tgagaggcttccacttccttccgcctcccaaatatcattttgttggccaaatctaaaccatagccagaactctgctaggaagggagtcttagaaatgtgtttcccaggcttgcagctcctgtgatacaggaggaaatgtggaaggggatggaaatagttaccagacggtaagtatagtgaacagaaaatatccagtacctacagatgatgtgacagctagcctccaaggtggccttcaatgacatgtgcctcctgatattcacatacttgtagtaggtgaaacccacagtttaccaaggttaatccctgtgaccaacaaaatgtggcagaagtgatgatatatcacttctgaggttagattttttttaaaaaaaactgtggtttctgtcttgggagtgctctctttatctctctctctctctctctctctctctctctctctctctcagctctggctctgagaaaagcacactgccattttgtagagagaatcaattacttactaaagaaaggagaaacaagaggatgcacaaagaggaacacagaaggagtatggcacagagtcctggagccaggaaagcattcaagtgaggaccagaaaaccctagggcttgcatccctgagtggctatggattctgagggacctctggtcgcatgttctactggaaactggttgtttttatcttatttcagtgtccatgaggcctgcacatgtcactaagtccctaattctccctagaatcatagatgcaacttccccattacttgaggtagcatgaatgagcctctgctcctggcatcgggacagcctaaccagcgcatattgttgtgactgcttttccttattagatatgcaggagagcctttcagccctcagtgatttggtcaacagaaaatccgtgcttgggacactgtggttcagacatgctttctttgttgctggcacggagtgagaggcccttgttgggagaacttgggagaactggcctggcttcttcgagacccagcttccaagggggtggctttctctgcaggagaaagatttacctccaatacctgagaagcaaggggccaggatggatgtcctctgcaaccagaagagcatatccagccactaactatggcactcagcttctttctttactgaatgaagctcaaattgatacaaaagttaccttgatcaaaatccttacaactacacattagctgtcactcccccacccccaacaccactccccggctttgccctggtaatcctcattctttaaggggtctggccttttatttacttttttattcaacgtttttgcagcatctgaatagaaattatccttgctcttctttaccccaagtgccttggctcttgacctctgctctcatcctccct

SEQ ID NO: 69322 - DNA, 1053 bp, Homo sapiens
gaaacaccatgtagccatttgagaaatgttatagacatatctttattgacttggaaagatgtgtatgctacatcttgaatggagaaaccagttcacaggaaattgagcatggtgagagatgtacgaaaaatgtatactacaaaatagatgcagtgataatatagctctaagatagaattattttttaatctaattttggcttatttgattttatgatttttctgaaataaatgtgaattccttgtataatgaaagttattgaaaaacaaaatgcattacggtgcagctcacatgccaataagccaaaaaatctgatagccactgaaatctgataaagactgagtacatcccacaaattcccttatgttagggatgatgacattatctgagacagttgcagaatccatgtgggtgagttctaccctgttatcaaggcaaaaccctaggaataatcagtggctttgagcagtattggagggtgagcctttccaccctccttgaagcactgtattccttaagggtttcagttaagttcttgaaagtcactctctaaaagcacaataatgcttatagcttttcacttgaaaaattaatgaaattgcataagaaaataattataccttattctgtgagcatggagatgaaatacaaagactcagatcattggccgggtgcagtggctcacgcctgaatcccagcactttgggaggcccaggcgagtggatcacctgaggtcaggcgttcaagaccaggctggctaatgtggcaaaaccctgtctgtattaaaaatacaaaaaaattagccgggcatggttgtgcatgcctgtaatcccagctacttgggaggctgatgcaggagaatcacttgaacctgggaggcagaggttgcaatgagcagaggtcacaccactgcactccagcccggatgacagagcaagactccatctcaaaaaaaaaagaaaagaaaagaaaaaaaaagactcaaataattgacaaactccaacactgcacaatcttggggaaatagtctggcaaatacctatacatgaagag

SEQ ID NO: 69323 - DNA, 1022 bp, Homo sapiens
ttcatctccaccatgccgtgccgtgcaccagccccactggacttctcacctttccactgactgtgctgcacccttcaactttgccattcctgtgtgctttttctgtgaaggcttccctcatgccagtgtttatcttccttcctgtgttctcttagcgttttgtgctttcatctcttaaacatgaccatggccttatatatttacgtatacatgtctctctcccttgtttcgacctacctgggataagtgctttgtatagctttttatttttgtattctcagacttctaagtctgtctagccaccaaattgaatttactaatcactgggatattagctgtaagatcattgcagccttttaacttgtgaccctaaaataggaaacctttaatattttgatttaaggaattgattttaattgttttagaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcagtgagtagaaatactgttatttgctgatcatccagaatgggttaattccaatggagaattgatattactgagacttctgatttgtactcatcatgctaattttttgaactgcctaacttaagtttctagcttttcttttttgtttgtacttattgtaagggtgattttgcttaaagaatgattactattttttttttaaccacagtgtgaaatttaaagataagaaggtatcttgaaaattgattttgtttaaaaattttcatttctaggatttcagttttattatttagttcagcaaaattttagttttttaaaaggaagcttcataaaaatgtagaatttatggattgccattatt

SEQ ID NO: 69324 - DNA, 1044 bp, Homo sapiens
acggaaggactagtttgccaaccagtacttaaagggaaaaaaaaatcccctaaaattaccaggattaccggttgacagtagtctgttcatggtggaaaaacagtaactttctcacatggttattatactcacaaaggtcagacaaattaatgtcacaaaggtcagagattagcaaggtaaatattagggattaaactgtttaagggagtccagggaaatattcaaggttttattgttttggagatcagaaaatcaggatgatcctgcagtttttgggttatctccttttaagcttagtcatattggaagcaggcagaaggctcagatattgcttttacataccctcaagccaccaagctggttccatcctgagaaggaagtcacgaagctgacttctgcgcgcgctcaagcccaggctaaagggggcggggcgaggccgcgggggcttgtggggaagcgcaggaggcggggctttgcgtgagtcactgccgggctcggcgtgagtcgctgcggggctgacggggtggcagtgcggcgggttacggcctggtcaggtgagcgggcgttgcggttctcgctgcccggagcagcgtaggagatccttggggtggccggtgggaggaggggtagcggttatgggtaccggtgaggcggggcgggccggggctggcggtggaggcgcgcgttgaggcggcgcgtcggtgtccagggcagcggcgtctcgggtcgcgcgttcccggaggggctcgcccccgcaacccgggcctgcgcgctctgctttgcaggcggaccctccaccctgctgcgattttgcagtgctcgggaaggcagagccgccctcccgcaaagaccgaggtggggcccgcccccttgcggcgtgggtgtgcggtgttcgccgggacagcgggtgtgaaagtgatacccccagcgctggaagtttttgattgctggctcgcacccccgccccatcgcagggtccctgggagagtttttgggcctgctcgagcagcagcggtgatgggtgaaatggaaaagcatctaacc

SEQ ID NO: 69325 - DNA, 1449 bp, Homo sapiens
cttagcacagggcctgccagtcagtgctgagaacatggcgggctcaggagtattaagatgggcctccagagaacctggaacattcaaaaccactgttctctgcggagggcacgggcttgacagctggaacccagggcagacaagaattaggggcgttcaagaagtggggatgagaaaagaaaagccttctcccttcaggaagtggggagagatggtcacctgtgtgccctgccctgggaagcactgccctctgctggccacctggtgagttgcagttgcccaaaggtcatgtttattgagaccctactatgtgccaggcactgtttagagcactgatctccgaagcacttggatcgacacccatgtcaataaccaacatttaattaaaacccacaccccactgtgtgaatatttgtttgtaagtaatacacatatattactacattaatatcataataaagatagataaaatagaaattgatggagtagaaatgcaaagcaggtagaaaaagtaaacgtaagtagaagagctcatattttccccaggcacatggatgatctgatgtaccttactttggaggccactgctctagggactggggactcaagcacagtcccagtccatgaggagctgatgaaaatcaacaccaaggcttatataagacacttcccaattttcaaagggcttttatacatagcatgtacttatagctactatttatatacattattttatttgacttatgaaatagttggggcaagtcttattgtctccattttaccagggaagaaagtgaggctgagggaggctcagaccctgcccaggttcttcctgactcactgagaatctttcctcatcctcttggatgtgcttccctgggctgcgtggctgcgtgggcacatgcacctgtgtattctgagcaccacccaggacttcaaccccgctactaggagaaacaacctctcagcctcccaaacagcacctccaccctggcatccagctggtccccggcctccctcccttcccccacccagtccgcctctgctgtctttgcagatgccattggcctgcagccagatgcccgtggtgtggccacatctctggggctcaatgagcgtctctttgttgtcaacccacaggaagtgcatgagctggtagggaccaggcagggtgccagggcccagggaggagatctattttgagtgtggcagtggtggattctggggagggtcccagggagaagagggaggaggggcctggctctggctgctgctgggtcctcagcacacaaaggagtgggcctcagctgatgggggaattcccaagatagtgcagggcaggggctggtagcactggttgggagctcccaaggagaaagaggaggacctgccctagttaggggttccccaggagacaggagcccaaaaggaggggtctcagcactgggg

SEQ ID NO: 69326 - DNA, 1058 bp, Homo sapiens
tttacctattaatttttaacaagaaattttaattttaattttaaacgaaaatacgcatcgtactcagaggtaaagatttttaatcctcgcggttcgctcgtataaaggcatatttccggtcccttccaaggtccaacaatccggacacggcgggtctggggatgggcccaggaatccgcctttttagcagcattcccccaaacgacacggcagcttcgcaaagcggcggtggcgtctgcggttccgggcgcgggcggcctccggccggggagggcgctgtgcgggcggcgctgggggcgggccgggggcggagcgcggggcgccggctgctctggcggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggtaccccgggacgctgggcggcgcggggcgggtgcgcggctgcggggcgggcgccgtcagctgctccaggacgctccccgcgagcggcgcttccccgcggagcgggtggagtgtttactcgaaaacagcggttggcggcggcaggccccacgcgggcccgggctcctgggcattcctgggtgcctctgagacccgatgcccgcccgggcgccacctgggggtgccgacggcccgccactgccggctgcacagacctgccgcgccgcccgggttatctgtcacggcacactgcctgtcgccctccgcccagttgccccacgacagtgtcccctccgcgcgcccgcggcgctggtcgcctcctatccccaaacacacacacacacacacacgcacacacacacggttgttctgagggatcccctgccccccaggcgccccttccctgggtgctgggtgagggcagagagggaagaagtgggaaaggaagagggctaggg

SEQ ID NO: 69327 - DNA, 1051 bp, Homo sapiens
agactttctggttttcaggatccttttatcctcttgaaaagtagtgaaactccatgcaaattttatgtatgtgagttttagctattgatatatactatattagaagttagaacattttttagcattttaaagtaatactaaaaataacatgaattaacataacatttttgtgagagatattcatgttttccaaaacaaaataaaatcagagagaatggtagggttttgtatttctgcaggtttctctaatgttgggcttactagcaggcagctcagtctcttacctgcttctgatatcacagcctccgaaaaggaaaactccattctatgagggaatgagagacaagaccatattcttggtattcttatgcaaataggcctggtctagtggatctgcagggctctggagcaccctggggatgggccctgatgtgtctctcctgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagtgagggcgggtcccagggaaagagggcatgggagggacagcagcggggattttagcagcattcccatcctggttccacaggttacctccaaagagactgggtgaattacttaacctccccggacacgggttttgttatggttcatgtggagaaaacaagtccccacctcgcaagttgggtggattctatgaaactgatgtgaagtcttgagcagtgcatagcccatacaagcactcctgatattgggacccattagtctgtgctcagctctgggatgggagcgccctctggtggctgtggctggaaataaccagaggtccttcttccgggagtctgatgctaactaaagcaggttggaggtggcctagggtatttgtcacaaaagcggagtggatgatacagacctgtgattggccagccctgcccttccctaatc

SEQ ID NO: 69328 - DNA, 1583 bp, Homo sapiens
acccctggccctgggcccacagcctctccaccgcttcattcctccctgcttgaagaccccgggtccgctatgcagccaccccaaccctcccaggcttcctgaccagggttgagaggaagcttagctaaggcccttgctgcagccctggtgctccagcatcccacccttgtccctccccacaggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagcctcaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccactgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctccccaagaagcgcagcatacccctgggacccctcggccactgcccactcggggagccttctctgtttctggggcctcccccaccatagctctgattcccaccccacataggagtagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgctttaaaagtgcctctgaaagggccccccagaagtgagcagtgcgccgtcaagcgggtgtgcagggcacacagctgcacggcacagtgtgggtctgagtcactgccggaggagggaccagggtggtctgggccgcagcccctttaacaatctgcccttcctgccctgcaggaagaacccattctgaacacaccctggctgtccctggctgccccactttggggtgacaaagaggaggcagccct

SEQ ID NO: 69329 - DNA, 1135 bp, Homo sapiens
gcctcctcctgcaccctggacgtccctactccagcttgctgccaagcccctcctcagcccacctccacctctcccttccatatttctctcccccaatactcacccggccctgctctctgggctccctgctccctgttgggccaaaggctgagagtattcacgctgacgtgggctgggcctctccccgcagggctcctggcacagcggatgtttgtgatgctgccctgtggtggggttggggtaagtgtgcccaggggtctcaggggggcgttgccagggctctcagctctcctccctgtggttctcccaggcccagcccctgcagaacctctgcttgttgtggttctgccagacagggtgagccagggacttcctgaggtgccccctgcagcaggaagctccttttggacaggcgtgtctcggacccacagtctcccccgaatgcggagtccagcctaagccttcccctagaaggtgtctggtagatgttgagtgaggtttcaggagcagggccaaggctggggcttaggatcatctctcccttcaaagacccccatgactgggcattggccgccaggctgctctgtctgctcttaagtggcaagttggggtacctcagcctggtccccagaccttgggctgcctggtgtgacatcacggtggtgcttccggtgtccttggcgatcccagcactccccactccgggacatagccccaaactccgctcgcgagctttgcttcctaagtcctcacccctttgtgaagggagcttcccgctccctccggctcagctctcctcgcctaacactatccctgcagtagtttctcaagcaaggtgtgtagaggcaggggatggaggcctcattccggagggaaagtgggagctgtagctggtgggggactttgggagccagtcagtgccctattcacaacttcccatttcttgccactttctggtttttccaactgttgttgcttctgttttctcctccctcctctccctctctgtctttctctctctctctctttctccagcctcttgcgactctctctgccttcctcgcctctcttggtctgcctcgccctccccatctccccatcatgccccccggcccctccctagccttgaggccca

SEQ ID NO: 69330 - DNA, 1021 bp, Homo sapiens
cagtgaacctagactggaaccaggtcttggacctattgggactggtcctctgcctttagtcccctgatgtccctccttgcccagcagggccaggctcagaggcaagctcagagctgcctcctgatgttgcacctggaatggtcctggtgcagtgttctccagaggcctctgtgtcccttattcggcgggtgtctctgtggccaccgggtcttacagtgggttttggggcagggaagtttgcatgtctaagctgttcactccactttgacactgaagttcagtttccccatcagtaaaatggggagaaaattccaagcacacttctcagagcagagcagaagaggttgactatggagaggagaatgaaggtactgtgctattatccaccccctccagtttgcttagggataatggacctcagctttagtccttggtggcctcttggcatggaagctggaactttctcaattctgatataaaacccttgagcaagagagaaactcatgtgtgatggggtagggagtggggaccctctggtagctgtgggcaagcatgcccaaggacttggaagacagaagcctgtggaaccccatctcctctttgccttctttctcctggcctttcattaagggctggtaattttgaagtcggcaggggcctgagagaaggtgagctaatgcaaggcccagggtcacacagccagggaatggcaggcggagggggccagaaccaggccttctcactctgccagtgcccattctgctggcccaccctccacagcttggctctccctggcctgccctcagttagacttcggactgaggcctccagtggggtgtggggtattgctggaagcagggcctgaataaagtctggggctagcgggagggcatctgtcctcccggaggctcccaggactgtgcatttgtgtgtgttggatttgttcactagatggggcacttcctttggggcaggaagctttgatttcctgtggtgatggtgaggaggggttggtaaggat

SEQ ID NO: 69331 - DNA, 1077 bp, Homo sapiens
ctggctctgctaagggccacctcctgccattttggctgcaaagaactagtgtcttttcttaccattggtccttgcattactcccaactgggcgccaccagccttttcatcaaatcctccagccatctgggcagcaaagttctgcaaagaaacccaacaacgttaggaggttgaaaggcactaggtcttccctacttggctaggtaagctctatatggatacaaagaactctactgagataaactctgattgttggagactaacctatcattgatcagaattaccactgatgcctggaaagtaattttgggaatggattattagatgacagtggcaaaatcatttcactggaagggaaagtgttatttgaggaagtatcagttccttgcatttcattttataaaattatttttatgctctaaaatatgacagatgttatttaacgtatatggagaaacataaccaaaccttctaagggtgttctttattctttaagactttagtgcccagcaaaagactaaaatcaacagtcttggaatatttcagcaagagatgtagtaggcatctgtgatcccatttgagtttaagaatttaaaatacagcaaacatcaaaatagcaaacctgcaaaaactaggcaatcatataatttgttgattggtttgattccagaattgactttagccacacaccttcactcagtggagctctttcatgagagtgaatagttgcttggaatgtacttggcaagaaccaaggataaatgtcttccaaggacagtggtcactcgtcttccagggaaatacaagtgcccagtcatccttcctcctatcccttacacccaccccccagcatcaactacgtggtacagatgccaggaagccaggtaactgaggactttctttatagaatcccagttagtgaaaaaagccagcccttagcaccacagtctcatgcctaatatgtgactcttctaaattacaggcctgagggcaaagcccatggacaggctatgtacacactgctggcagccctgggagccagccaggtaagtgcaagcagcaatttaaaagccacatt

SEQ ID NO: 69332 - DNA, 1064 bp, Homo sapiens
gcccatcgcagttgcaagtatttgcaggtccctacgttgcgctagaatactgaacttgcaaagtgttggctcggagaagtttgcgcacagatataaatgggctcttttccaccagctttgataattaggcgcacatgcacacagctcgcctcttcgaagcacttcgagttcagcaaaaacagatctcaactcatcgaacttaggtgaagtaggaaagagagagcgcgagcgagggagcaagcaaacgccaaagggttgacttcacagcctgtccaaggcttggtggctggtgggctcaaagcagagttagacaaaggggactaacactctgacactggtgggctgaaatcccaggccacaaagaacggcttccgataggccctctgagacctcagcgcctctttagggtaccctccccctcccagctggccctggagcaaggtgcagccctagcgctcatctcgacttccctccgtccgcctgcgcctctcttctgataaagggtacagaaacttccagtaggagaggccatctgaaagacgataacattccaaccagaccgtgcttttcaaatgcccccgaaaatagcgcccccttccccgcggtcttaccccattccccgccgccccgaggtactacaatgagttacttttctaaattctggaactcaccgagccaggctgcgtggtgtgtgtgtgtgtgcgtgtgtgtgtgtgtatgtgtgtgtcagggaaggggagcaggctggtcgattgctacggttgctacaactatttcaaccggtatagttagagatggctcttgtagtcgggtccaaatgctgttcggactgcacctttctacccctcctttggtaaggtccactgtctgggattatattcaggacaaacgaagcctggaaagtgtattaggtagagaggatttttttttccacgtgtttgggcacgtttccgacggctgggattccagccctgtctttgtatgttacagattgtaaatcaatcgcagagggaaactcttcggcggggggaataaaagttctctgccttcgaggctctgtgggc

SEQ ID NO: 69333 - DNA, 1910 bp, Homo sapiens
gaggaagtcaaggcagagattcaaagttaaatttttaaggccactggcttagcactggcttggttttagagttaaggcgacaagaccttagctgcagaattttctccattccaatctaaggagtagccatcaattccttacttctggagattgccttatcctttgcagaacacaagtgctaggaaaggaaaaagtgtgggagagtggcacacaagaagtccagagtccagtccactggagacccctcattcaatttacttttattcttttcacaaatacctactgagtaatcgtacgcaaatcctatctctttgatgccttccctgatcacatgatcttaatatctctcatctggacatctgcagcccttataatcagaaaataatataagtccacatggtatttgtattgtaattcaccttttgcatcatgaatggactgagacatgtagccaccaagggcaggtaaatgatttggtgcttttttttcaaaccaggaataaaagctgtttctttctggcctgccagtgatgaggtagaggtaattattcaacatttatttagaaagacaacattgtgggccaggcatagtggctcacacctgtaatcccagcacattgggaggctgaggtgggaggatcccttgagcccaagagttcgagatcagcctgggcaacacaaaaatttaaaaaaaatatattgtgaagaaaggaggactgctcatggcagcctgcaacctcctttgtggtcccaaatcgttcatctctggcctcaaacctaacgctccactctacccttaacaaaaacaccttcctcagcatttagcatgctctttggggtgggtgggggttctcagtctctaccaggggccttgtggaagtattttctctacacagctttctgttaaatagtttcctccatcctttttatttccggtgatattgtgcatccctcatagactgagactctgaggaagcccctcaggctaggtgttttacaagcacgtgtttaagcactggccttagtcgccctgaagggtggagtgaaaagatggtttgactatggaaataaaagccaccttgttctcaggtttttatagcctgctgaccttgtcctcaggatcttagagtctgtattagagtctgtagaccttatagttaactaatttaggaagctaagcaaacaccaagcaatataccttatcaagaaggcagactcataggcatgtagttccatacagaactagaagtagaggatgaaggggcaaaggtggaggtaagtcagggataatgttgcctttatctgcctatctatatgattcttcctaatttttaaaaagttgacttatttaaaataaactgtggatcttgctttcttgctttgactggaaactccctggtaaaaaggacttgatggtgtttgtctctctgtccccctgtctctgtggctgtttgctctgtctctgtctgtgcctgtgtctcccgatccaagctggaccagtgattggatcctcggtgtggtctggatttctgagtccaccccttacccaggagtctgaatactgttcattcatttatttcatcccatatacctggaagtgaagcctggaacgcaaataacatgcaaatttgtggctctttggcactttaaaaaaccaaacctgtctgtggaggctgccaaagaactttcctgaggccaaacacaccaatcaggacttccaacccaccctgctaactgtggccttctgttcttgctcctctcctgcacccctttcttctcacaatataacttcgaagtgaagtgcttgccacttttctacctgtaaaactcacactcatgacagtaaaacataagaaagcaccaacttctcaaaaatctattattttgggggaacagttttctctatgttgg

SEQ ID NO: 69334 - DNA, 2793 bp, Homo sapiens
atgaaaagaaaaaaactacatgtaaccaagaatgaataatttaaaagaccagaaatacaactgagactgtttgttgaaaaccttgcaaaagaaagaagtatggggaaaggcgtatcaggtctagacaaaagcattgaaaattaagggtgtctctgtgtccctacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattttatggcccaaaggcatgttattaatatcttatgtaatttactttaaactaaataagacttttttctcctgtgttcccctttctcctgtgtccactgctcatattcacctgccttccctaaaaaaggaatatttgagggatgataagcactagatgccagctatagagacctcaacagaaaccataatcccaagaatcactccgagaccctgaa

SEQ ID NO: 69335 - DNA, 2201 bp, Homo sapiens
tgaagtgtttctaaatagaactagccctgattaaccagggatttatgcaaggtcacatggagaatagtagttattctccataaatgactccataaacatgttgcttgcctgtctttctctaaaagtttagctttaattctgataatttgttccttgaattggcatgtaagaaaaattctgtgtgcatgtttgcagtgagggaaacctgccttcctggtttctataatattactaggttagctcctgtgagtgaatgacctgaaccatactattcaaatgctgctgttagtctcttggactttgtggttgataagggtaaatttaatttgaaaatcagaatggggaggtcaaggtgaaaatctagagaggtaaaattggaaaaatggcttttgtccccccaaaagttgtcttgatctctgctcagaagtattgtcatgcccaggccttttagaacattttttctcaagctaattagaagagttcaaactataagcatgagaatggctaaaaatcaagactttactggtagtgaaatgttttatttctaaaaacatgagaaaacaatagtttggctggtttactggggaagaaggaagatacaaatagcattggtcgtttatgtcattgtggtaatgtacaggaaaaagattgaatccttagtttgaaaacattgtaggcttttctctgaaagaaaagcttttttcagcttcagcctggcagctcttcaaataaaatctcaaaggaacaaggcactataaacaacccacccatccctaaacatgactgcatagacaagtagatgcttatggccaaggctgcaaaggcagcaggaagggtagctccttaagcaccaagagccacagtgagcaaatagaggcaagtgtgggtcccagaaaaggtgacaggtggactaatgttgacagttagtcctcagattgtggtatattggtgagacaaatagcaagcacaggactcatctacttttagctcatttcaaagggaatttaggatctgctggtgctaagagagtcttgtttgaggaaagggctgttgccaacttggcgtcggggacagttgtcttcacaaaagtcaagcaaatgctgtgaccatcactgctcctctttcatcttgaacactgtgatcccttctctcatttctttttccttcatcttcagccctcctctgtgagatgacatgtaggacttttttgttctctcttagctcatttttttggtttaattgtgtcttggctgaactatggcaattttcctcatttggatggtgtaatagctaaaaaaattgaggagaaagacttgaatccagattctgccttggatgtcagatttacattctcagctaatgtggggagcattgaggtcaccaaactcccttctactgggatctaggggaaatgaaaaagaacccagatcattccttagagctaattaactagttgactttggaggccattttcctctcagttgagaaactttggttgggtgcagcaatggaagaggaattctcaaagggaacagataccatggtgtctgatgactggggttctctgttcttgttcagctgtgttggtctttagctttctagtgaaccctctgaaggtgaaaaaacaagcaaaactcaggctgtgtaagtccagctaagcttccttggtttctggaactctttcctcttgaaaaatagaatagtgatgtatagcatgacactcatttatgtcattcttttttttttttttcacttcagacttacgattccagaggtaatctctgataggcacctaggggagatgtatttccatggctgtcatgtgcttcaccgtccttatctctctgcctgattcctttcacctcctgcttcagtccttatttcttgttggaatatataagctgtctgcccctatggaaggtttcgcttacagtaactggcagatcatctgcttatgtcttggattgaagggtttaccctataacatggccaacattataagatgggtagaaggccagaggaatcagtgaattccttcttgccaatttttcctcattagagaacatagtttacagcctagaaatctgtacttgctgggaagatcctactgcatttatggctgccttcggaaacctagaggcagtctttagcaccattatcctgaggggcagagttagactgaaaacttatagttaagaaat

SEQ ID NO: 69336 - DNA, 1819 bp, Homo sapiens
tctactcattttagatcacttatattacgaatgacaagctttccaaaatcgcctccatttatgtatgatattttttaaatggacattgaaaaagttatattattattaaatatttgaggtattgggggagaagttacggtcttcacctcctaactccaatttattttaagtatattaattacactacagtttttaaactgatctgttcctaagcctaaacctgtaggtacctgttttattttagaaggttatttttacagcaaaagaaaactgggttgggtatcttttcctaagtaccttctttgcataagcatccctggctaatctgggtatactcaagcttcacagctgtggaggatttttagtttctcagtgtagtaatcattaaatattttagatatccatatcctgtttttgtatgatcaagaccttccaaataatatttgccaataactattgatcatttacctcattagtacgattcatgttttatgtgttttattcttgtaatagtcatcatatctttggaagtagatatgatagttcaccattctgcagataaagaaacaaggcatagaaagatttaaaaacttgcaaggttatacagctagtaaacagcagagccaagattaagacccaagcattgggtcttatctactatatcttaactacctcagaatcttaaattggatactggtcttaggatcagatatatagaacttaggagccatatatcatgtccaggatgctttttttctctggggccagccccattctttttgccactggttggtttataagataaaaatttcagaagctcatcactccctgaataatatctgtgaccaagaataataaggaaggcatggtttgttactgtctttctttagaagaaaccctctttgcctcttttggctcagatattagaacattggttcaaataatggaaaaaaagagctcaccaaatcaaaggaggaaattaaatcaaggatagttataagtatccactgataagttatttttgatctgtggtcctttgccatttatttcctgccattgctggtggtgcgaggtcagttactctaaagggatagtaggctttagtttgttgtaaatcatggaaaacctcctagagggcagcaatcagtaggatatgagctgagttcttgctatttactgtggcatttacctcagtgagattccttacagagacagcattcatcaggacatattttccattccctgggcccatcagaggctggatttttagcaagctaagttaatggaaattacattattttagaggagatgagaagaaggaaagattctttgtctactttatccctaccacccctagccataacttttgtagaaggagtgcatttcttctcagttcagaatgatgttatccttgaaaatgagtgccagttcacatgtccataataatgatgggagctatcttaaaaagcaccattttcaaagtaccatacttcgtaggctttcaaagttactgcccttgagaagctaacatcctgatggagtattattaggtatccttaagtattgatactcattgaagaatacttaattttggccagacacagtgggtcatgcctataatcccagtgccttggatggctaaggtgagaggatcacctgaggccaggagttcaagagcagcctgggcaacatagcaagacccgatctctacaaaaaaattaaaaattagccagccatggtggcatatgcctgtagtcccagctgttcaggaggctgaagcaggaggattgcttgagtttaggagtttgagtttatagtg

SEQ ID NO: 69337 - DNA, 2989 bp, Homo sapiens
gatcaccggaggtcatgagttcgagaccagcctggccaacatggtgaaacctcgtctctactaaaataaaaataaaaaaaagaaaaaattagccaggtgtggtggcgggtgcctgtaatcccagctactcaggaggctgaggcaggagaatctcttgaacccgagaggtggaggttgcagtgagccgagattgtgccactgtactccagcctgggcaacagagtgagagtcaaaaaacaaacaaacaacactaaatgcctactctgtgccaagcactattctagttgcagatcatttttttttttttaagagacagaatctcactatgttgcccaggctggtcttgaactcttggctcaagcgattctcccacctcagcgtcctaaagcactgggattacaggaatgagccaccatgcctggcctctgatccaggtctcttaactcccaatttgatgctctgtttacttgttctctatatttaatagttttctttggaaaagtgttcactcttcttctttgtgtttctgtgatagatcctgcctagttaggagtttggagataaggaagtttgagaaaaacaagaggctctaggacaattaatcatgtctgtggctctgctcagcatatcacttgggttgtcagcagagccacatggacctagaattggcctgtcatctttggaaggaagttgtgttgctgattctctgctttggctcattggcttgttagccatttgatgtagattattttgtgtgtggggatttttaataaatctttcaatctgagtcatttgggaagagcaatgttctagcttaatgtattattttgagaagtgatgtcctctttcacgtaatgttggtctcatgcaagtagggagctatgccaaatgtagtatctctgctgaactttgggtcacctttttaactaatatgtatccatatgattttaactaatatgtatgcataaggattgtgtctccttaattcctagttacaattattttatgtcatttagattccttttacttattccatacttgtaaagcactcatataaacaatttaaatgattgtttttattgatgaaaatattttaattttctcataagcctcctgctcatttgtcaaatttttcttttcctacccatagttctactttcttccaggcagagctgtggatcaaagaattgtaagttatttttggtatcatttttccttctcaatcagttcatttttagttagaagaaatcaaacaattagctaatcatcctgcttattttttgccaataagaagtacctgtttaggctgggcgcggtggctcacgcctgtaattccagcattttgggaggctgaggcaggtggatcatctgaggtcaggagttcaagaccagcctggccttcatggtgaaacctcatctctactaaaaatacaaaaattggctgggcatggtggcacgcgcctgtaatcctagctacttggaaggctgaggcgggaggattgcttgaacctgggaggtggaggttgcagtgagccgagatcacgccactgcactccagcctgggcaacagagtaagactccatctcaaaaaaaaaaaaaaagaagtgcctgtttatacttttaagttgttgggttttcaaaatattgttggagttggaacatttctatacttatgtttattaaatctataacaattgttgaagctaaattaaattggaaaaatagagttagctattatataatagggaaaataaatgatcctattttggcatttgtaaaactaatttattgaataattcatatttctggactttgcaaaatcactgaaagcatttagtctcacttaaggaacttaagttatccaaacccctcggtctcggtaattttttaaaaatctatcaaaaatgaagtatttgaattaaacttcagtgatatcttgtattcgtttctcctttagggttcaatcccatttttggatttccagactgaagtttcgctttcactataatcttaaaagcatgttaagaaaagaactgtgtgtttacaaatgttaacaagtcatctgttcacatttagcagcacactaatatttttagtaatttcagtaaaaataggtcgggtgcaatggctcacatctgtaatcctagcactttgagaggccaaggtaggggggtcgcttgagcccaggagtttgagactagcccgggcactgtagtgagaccctatctctataaaaaataataagtaaaaatggtagagtaatttcagtaacattatgtggtttcactctatgtcttaaaataaggatgataagttagtgtaaggattttagactttctttgtgagggtcctgtatttaatattcagtgtacatcaacaatatgtttcataatgagagtggtctacatttggtcacgttccttttcattttctagaactagtgtttatgattctcgagcacgagaaagattgcgccagattgaagaacagaaggcattggccttacagcttcaaaaccaggtaaaaaagaaaattggaataatattacaaataaatagtacatcaaagtagaaactattttggaaagttacccagatttgggtaattgctgttgtaattccaagatcgtatggtagcatagcatgttatgatatgtcgtaaatgttcttggtctgtccagtcagtgctactcattgtacataagacaaatatagatagtcccctacttgtgatggttcgactaatgattttttgactttacaaaaaagcgaaagcaatgggcatttaagcacgctctttgacttatgacaggtttattgggacataaccctatcataaatcaaggaacatccacagatttctttatcccacttactctgaagttttatctttcagagattgcaggagcgggaacattcagtacatgattcagtagaactacatcttcgtgtacctcttgaaaaggagattcctgttactgttgtccaag

SEQ ID NO: 69338 - DNA, 1022 bp, Homo sapiens
ttggagtcagatctgccttctgatcttgggttggaaaaggcttcatgtagctttggacaagttactcttatgaacctcagtttccttatcaataaaatgccagtattgataccttacacttaattgtgaagattaacttacagataaaacacttatttttataagtgcttcacatgaaatgccacaagatgcatgcaactttcttgggaagaagttgatctctcaggtaaagagttgatctcagttccttaatggttctttactaagactgcctttcctttacggaggatttcccctagtgatgactaaagaatgagatggcaggagaaatggtctgttgggtaaggctgtttgagcaatgctctttgtcaaagttggtgcctactctgctgaggcttggtttattggctctctactcttaattctccactactgcctctcagttaagttccagtaatgaagatctgcttttatttcccagaatatgctatgctgtgtcatacctctttgcctttatacattctgatccttctgtctggatgtccctttctctctctgtctacttggtaagctcttattttgcttccttttctttctttcttttttttttttttttttttttttttgtgacagagtcttgctctatcatccaggctggagtgcagtggcacaatctctgctcactgcaacctccgcctcccgggttcaagtgattctcgtgccttaccctccagggtagctgggattacaggcatatgccaccacacccagctaatttttgtatttttagtggagattgggtttcaccatgttggccaagctggtctcgaactcctgacctccggtgttccacccacctcagcctcccaaagtgctgggattacaggcatgagccactgtgcctggccttaattttgcttttcaaaatctcatccaggtgttattttttttttctcagaagatttctttgactttgccagataatgttagtttttccctccatccttctaccttgtttgtta

SEQ ID NO: 69339 - DNA, 1131 bp, Homo sapiens
tcttttgtagagacgggatcttgctatgttgaccaggctggttttgtactcctagcctcaagcgatcctcctaacttggccttccaaagtgctgggatcgtaggtgtgagccactgcacccggcctgctgtgttctttagtccatcttccatgctgcaatcagagtgatctttcagaattcatgtctgatcattcattaaaggggtttaatgattatttgttaacctccttcaagggtggtttatcagacattgaattaagctcaggctccttactatggtatacaaagcacttctttcacaagcctcactttctcacttttaacaaatatttactgagagcctactgtgtgccaggtactagtataaatattgaggataatagggaacaatgtgaagtccctattctcaaggagcttgcattctacttgaggggaaggatgaaggacaatgtgaagtccctatgctcaaggagcttgcattctacttgaggggaaggataaacaaatgtatatgccttgtgataagtgctatgaagaaaattgaagcagggtaatatatagagtaggattgggaggatactatttgtatagggtggtcatggaaagtctctgataaagtgacttgagcagagacatgatggaggtaagagggagccatatggaaatatgggactctttcatgtgtttttataagctggactattttcagtttgcaaatacaataagcatttcttaccttcacattcagtgttctttttgcctggaatgtcctccgtacctcaactttgtctgtcagtagtgttttatcttttaggtctcaactcacatgtgaacttctgcatgaaactttacttatctggaggtatcaaatacttcttcctctgtaatacagtaatagtaatccatagtaaccattactatgattgctatgcctttgccatatatggctttgggaattcaattgctaggatgagaataatatcagttttccgttgagaagattaagagtaatgaaatattctttctcatctcagttcccctacttctttgcagctccccatatgttctaagctttaaatatttcttaaaattctctatttgttaagtcttttggggagacttcatagttt

SEQ ID NO: 69340 - DNA, 1224 bp, Homo sapiens
acagccagttggtttttttttttaagttttcttttgtagagttggggtctcactatgttgactgggctggttttgaacttctagcctcaaatgatcctccccgcttgtcctcccaaagtgctggaattacaggcatgagccactgtgttaggcccataattcttaattatcttaaggattctgcctgagctttggcagagctaggattctgtttacatgctagtttgagaaatacttgccttattggatgtgtttaaactgttttttttttttgttttcttatagacagttcaagaagaagaaagagagatttacagacagctgctacagatggtcacagggaaacagtttactatagccaaacccaccacacattttcctttacacctgtgagtcacagaagcatatttcagatgaatttaattctacaatttattacttgatattgaaacaatattcttctcttgctaggtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggtaaacatggtatcatataactacatttttagtcctaatagccaattaactgttcattagctcattacaggcaacattgtaatatacatataaataaatgagcataccgaatctgaaaatatgaagtccgaaatgttccaaaatctgaaactttttgaataccaacatgatactcaggaaatgctcagtggagcatttgggattttggatgtttggatttgggatgctcaaattgtataatgcaaatattcaaaagtccaaaaaatccaaaatttgaaactcctggtcccaaccattttggataagggatactgaacttgtaagacatgtacttacatactttaaatacatatgattcagttaaccatgctgtgagtaaactaaatccacaaataggatattctttttttcttacctcaagatgcaaatgatttgatacattttatttaaacaacttcctaagtacagg

SEQ ID NO: 69341 - DNA, 1013 bp, Homo sapiens
tatgatcccagcacagtgggaggccaagacaggtggatcacttgagcccaggagttcgagacgagcctgggcaacatggagaaaccctgtctctacaaaaaatataaaaattagacgggcttggtggctcatatctgtactcctagctactggcgaggctgaggtgggaggattgcttgagcccaggaggtcgaggctgcactcgacttgctttgtgtcactgcactgcagcctgggcatcagagtgagacccatctcaaaaaaaaattgtttttttaatttgatgaaatacctattcttcttaccaggaacaatttttcttcaatataagagaaaaatcaaaaagctagttaaacaatatacatcctttcattatgagtaagaccttttttgaagttacagactcctgaaaagaaagatgttctgttgacacttgggttgttatattaattcagtaaacctaaaagaaaaagccaattttgtgaatgtaatgtagcatataatttgcatgataggatgtgtgcacatatctgttagattacatatttaatgtacgtctaatgctgtggttgcttggagatacaaatgaataataattaccttgcatttaaatagcattagagcttccagtgtactttccacgtgtattattgtttttaatccttttaactcagcaaaataggtagagatgaggtaatagtcatgttttacagattaggaaaataagggtcataggtcacatgactagtaaatggcaggcctagaacccagaacttctgaagaggtttggtcaagtatgctttctgttatacaacacagcaatatggttcctgcccaatgaagcttactgagcatggagtcaagaatacagcattacctgctaaataattacataatttggtaatcagtgatctcttaggtggcaaaacttgattatttgtgatatggttactaaaaatgctgtgcatatttttggtttaaagtttgtattgaggccgggcatggtggctcat

SEQ ID NO: 69342 - DNA, 2217 bp, Homo sapiens
aaccctccctctccaaaacaatagaaaaattaggcatgtatgatggtatgcacctgtgatcccagctacttgggagactgaggcaaggagattgcttgagcttaggagttcgaggctgcagtgagctatcattgtgccactacactccagcctgggcaacagagtgagaccctgcctcaaaaacaaacaaacaaaaacagtatctgtagtttcctcttggtctgtctctagctttgtttgatcccatcagcaatagaacaccattcagcaatttcattgggattggaaccacctttttctgtttaaacagactgcctgatcttctgcttttccccttgcattttaaagctgcagtctctgtcacatgccgttgagaatgctactctgacttatccttggtctcaaatttcacacctgttagggtaatttgcatttttgacagaccgatgcctcagatagatatctgtatttagatcatgccctaatcaaattttagccaaaatgtgtgagagacaaatatttctactgttacaactttaaacttaagtataataattttctagttctttactaagactcattttcattagcatcatgtttctatcctcaaaattatagtaatagatgctaagcatagatactgattacaaaggaacaaagttacaattcattttgaaagtaaattagcttattttaattatcagactaaggtcaccaactgttgaattaacaagtgctaataccagccatgacttcttcttttttcctatttaccctaaatcctgacatcttgattagcttacagaagcacaaaattatattttggaaggctgcctatttggatagagcatgaaaagatacattaaatacttttaatagcataaatttacaatattgcgaaaagttctatagtaatatgttttaaaagaatatcttcaaaataatgtcagcattagaaaaaaattccagaaatagagaattattattcttgtgttttcactggagctccttagagttccataacttaatgtctgaagttattttgagggagctgttttaaattgtccaattctgcagatagggagaggaggttatagaaattattctaccactcctagctgaaacttcaggaggtttttgatatgccagattgtaatccacaagttagaaaattcaaataataagtaattctcagttaatctgattgtagtagcaaacattggagtaataatatgtttgattatggcattagatgactgaagattattataccagaaccagatatatatgatgggtcattccttgccataagccaaccagaataagcagcaattaggttatctctgctctttgagagagtacctgagtcttgaacatggtaactaaaacgaagaaagtgacactagctgcttagtaatcaataactgttgttcatttgaattacaattctcactggccccccacctgctttcttactggtctggcctaccttctttcaggcccaggcctgggagtgcttgcaagatatagttggggtaaaatgttgacttttggtggacaccacggagtcacattgatgcagataaggcacatggctgtggcaggattcagctccttcatcaattttcaggttagtatggctgaatcaattatagtttgtagaagttcccctactgcagactttactggcagttgagactgggatctttcttccatgagagaaatggtgacatgccacattactttggaatacaatggttggtcatggttgcagtcataaggagaaccacctgtagaatttgtttaatttattcaaacttttatttttttagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaaggttcgtattttgtcatcttagttctcaagcccttcctcagacataagagaaagtgactaaaaggtagatagttattacattgggattttaaaagagtaacaccatttttggactttaaaccttaaggatatgaacaaatccattttacattttcaacttctcatttacttagtgctgaattttgatgatagccagatcttactagaagagagaattttaagtaaa

SEQ ID NO: 69343 - DNA, 1059 bp, Homo sapiens
tatcttaagtcctaatgtaatatttggccagattccttggctttctactcagttacgtaattgttgagaattacatttttcttatgtttatcctcataccacaagttgattcccatatcaacagtcttacactaaaagcttcatctctcacttgagtaccttttttttggagaagaaaataattataacagttactatatatatggtgatgattagagaataacaatagtaaataataaagtcatactgaaatgggatgctaaattacagcttgaagcagaggactcaaatttgtgcctttaacaaatctcatctagtccctgatcaaacaagcttatggcatgtcacagacatcaaaggtccctttctaaaaatcaggaatttaaatctgtgaacgtcagtggtctatatatatttttttcttataatgaagtctttaattaaaacctactttttactatggactttaaaaaaacttcttcctctttccacactcattccaattatgctctctcctttggatatattcttttctgataatccccacatcgattgcagtggtcatcactttgtgccttacctcttgattgggctagacacggaccctcagtttacctgcctttatctgctgatcctgactttattggtatttgtcttctctctcaccctgctgtcccctccttcaccaggatgaaaatgagcagcaaggcccaaactttaggatctaggatctggaacttctcctttattactttattggattgacttctctagatcaagctttttaaaaatctgcctctcaatccacttaagattagagtatttaaaacattgatttttttaaaaaataaaattttaaaaacttttttacagtttactttgttacagcaaaactttacacgcctgtaatcctagcactttgggaggccaaggcgggagtgtcacctgagcccaagagtttgagaccagcccaggcaacgtactgagaccctgtctctacaaaaaataaaaataaattacctggacatggtaacgtgtacatgtagtcccagctactga

SEQ ID NO: 69344 - DNA, 1728 bp, Homo sapiens
cttgaagtcctgggttcaagtgattcttctgcctcggctttgcaaagtgctgagattataggcatgagccactgcacctggcttatagtcttgtttaattatatatttttcctagtatatgtttttattttattgttaaaaaagtgacatggccgggcgcggtggctcacgcctgtaatcccagcattttgggaggccgaggtgggcggatcacctgaggtcaggagttcaagaccagcctggccaacatggtgaaaccccgtctctactaaaaatacaaaaattagccaggtgtgatggcgcgtgcctgtaatcccagctactcaggaggctgaggcaggagaatcacttgaactcaggaggcggaggttgcagtgagcagagattgtgccggtgtactccagcctgggcaacaagagtgagactgtctcaaaaaaaaaaaaaatgtgacttaagaaaaatcttctgctttgtttagattttatcttccaggcaaggacatttggaccgatcttttacatgttccacaagaagtgcagcttataatccaagctattactcaggtatgacacattacttggagtcaagggactttataccttttggatttcttgatagcatatcgtttatgtttatcatctccaaaagtaaaaacattgtcaaaaacaagatggtattttcttcactaaaacatcatttgaatggcttttcctgtgtatgtggttgctatgatactttactgattttgtctcatccaaatactggttttctagtgggaaagtgttttgagaatctaactgtccattatgccattgtaaaaagcaatacaactttgtttttgacctttttttgggaatatgtgtatgtgatgtgtgtaaagggtgtttgttttgcgttaatttaaatcacagagcaagtttatttctgttctgcttgaaaccatgaaacctgaaaatttatttcttcctgagcttgtccttctttcagggcaggaaatgttaactacatgtttctgtctagcacctgccacagccatatgcttgcatattcaagggcttttctatttaacttgtgatccatgacagaagtcagcattctctaggctgttcttatcctgtgacctgcctgacttatctatcatctgccctcttactagggtttggacttccaagggtcttctgcccctgccttgagaaactaagagttttgttggttagcctcttggctgtaggactcagaaagattacagtagtcttcccaggtctttttactcctcatgcttcagtctccttgccttaccacaatatgggaataccagttataccattgaaactgcctcaacaggaatttttttttttttttttttttttgacacagagtctccctgtgttgcccaggctgaagtgcagtggtgtgatctcagctcactgcaacctctgcctcctaggttcaagcaattctcctgccttaacctccctagtagctgggattgcagacacccaccaccacgcccggctaaattttgtaattttagtagagacggggtttcaccatgttggccaggctggtccgaactcttaacctcaagtgatccgcctggctccccctcccaaagtgctgggattacaggtgtaagccgctgcacctggctggatttttataaggataaattgggatgataaatatggaatgcagataataattattcttgttatttggcttccttag

SEQ ID NO: 69345 - DNA, 1043 bp, Homo sapiens
ggttcgcggcggttcccgggttttgcgttccgcgcccggccggaaaccccttcgcatggcagccggttccggttcggtgagtggcggcgggaagctgggggaggggtgaggatggagggagcctggtccaggagactgtgtcggacccggtcagccggcccgggctggactgggcggaagcggggagcactgtggggccggcgccttttcctctgccccgccccctgggaccacctcccctcccccctgctgtccggtggccgcgctgtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggttatgaaaatccccttaactgccacaatttgcttacctggctcatcgcctcctggtaattcccttgaaccgtctctttcttggtgtaccctaacgtgatctctggatctatgcctcgtttctctttccttgagcttggtgatttctgtttatcggtgcctgtgcagtatttccactatcttgttagcagtaacttgcttctttatcactttcaagtcagccttgttaaagtcattttacttcatatttggtacacttattatatttggagtggtggtgattcttgtaatattcatataaagccttttatctactaccaactatttgactgagggtctttgttataattggttattctggatgtattagatctcatcatctcctaaatctttattc

SEQ ID NO: 69346 - DNA, 1036 bp, Homo sapiens
gacagtggcaaaagacaaatcatatatcattaagggaacagtgcaatttcagtgctctagataatttttcgttaaaaatagtgttctagccccagaaaactggccattatagtcaccatagctcaaacgctttagtcttcaggagcttctagccctttagcctgtcctagctgccatcttcttacactgcctacctcccaagtccccttacctctgggcagtggtagtgatggcatctacaatttccatgatccgatgcagggcagagtcagtgccaatggtcatatcggtgccacagaagtcattgtcaattgacccaaccaggcccacaatgttcaggtagctggacttcgtagcctcctcatctgtgatcttacctgacaatgagaagcaaaccaggagccactgggtgaggcacctggcatgcctaaagaggagatatctagagagagagaaactctagccaaaaggaattgtagacaataccagaaaaaggagggcaaagactgcctatttgtgtctgggtaacatttttctccaatgggaggtaaaagcagggcgggggcgatgtgtgtgtgtacacgcgtgcacgtaccgacacaaataagcaatactgatgtgaaaactctcttacctgctttctggaggtcactcaacaagtcactccactcagaacggaaggtgtcagccccagtgaggctgccatcacccccaatgacacagagattggtgatcccacgcttcaccaggttgtaggcagctcggagtcgtccttctcgttcccgaaagtccttgcaccgggcacttccaatcaccgtgcctccctttggaagaggtagaagtcagctccccagagacagggctcaacatgctgagatatcccctattccaatgctgtgatggcctaacataactgtgtgactccctagaaagttccttgacatccttaagagtgatctgtcccttccaaaggaaagggaaatgatgctggctgaggcatcatagggtcattcccatattttgctacacatctgag

SEQ ID NO: 69347 - DNA, 1113 bp, Homo sapiens
ttgtatttttagtagagacggggttccaccatgctagccaggctggtcttgaactcctgacctcaggtgatccgcctgccttggcctccaaaaatgctggaattacaggcatgtaattccaaccttagacactcagtttaaaccctcttatcctatcttcactggaagagcaaagcaatctcctaccttgttttgtcaataagaagggaatattattaagccccagtaatcctgttgattaccatagtgggcatgtttctctagaagtaagtagaatctttggggttccgatggcaagaatacagagtcatcaagctttagatgaaatctgtttggggaggtaaagcccagtaagttctttgctgcagttcttaattgtgagactcagtcttgtgatttggaaaagggctcgagtatcctgactctctaggctgagccaagatggggcagcctgagccagactgtctttgttctctgggctcctgcagggcagcaggatgggtgtggaagcagtgatggcacttttggaggggaccccagataccccagcctgtgtagtgagcctctctggtaaccaggctgtgcgcctgcccctcatggaatgtgtccaggtggtaagtactgatcctaaacccctttcttaacactctcaagcccctgccttggagctcaaggggcatgagactatgtctaaggccactggtataggagcaggtggaaaggcaagatggtatagtaagagacatgtggggaaagaacacagtgggctttgcataggagctcttaactaagcttcagtgttcccatctgtaaaatgttcctaaggaaggtgggagattctacatcctccttagtaatgaaacccagtatctcataatatacaacctcaaacctttttatcttgtctttattggaagaataatgctatattcctcctaactttattaagaacaggagaatattattaaattctagctgggtagcttttgtctctatgatttctatcttgaacatgtttctctgaaccaacacgaggttactaatgctaacgttgagggttattgtaaggattggagataagctatattagcatgtgatacagtacctagcaaa

SEQ ID NO: 69348 - DNA, 1036 bp, Homo sapiens
acaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcatt

SEQ ID NO: 69349 - DNA, 1036 bp, Homo sapiens
taaaactgtttatcagctctattaaccttttggcagagtctttagggttttctgcattttaaaatgagcattctggctgctgcaggaagataagaatgatctagttaggaggctttgacaacagtccgtgagatatatactatggcgtggcctagagatgatgagaagtgatcagatttaggatacactgtaaaggtacagccaatacatctatctgatgtaaaatagaaaaatagaggaagtagtcattattctaaggttttggagcaactgggtgaatgatagcacaatttaatgtgatgggagataatagattttgggtgtgtttggaattaagaatttactttcggagaacccagcagagctggttgagctttcaaatgtgcggttgtgggttcggggtttattggttgaattccgctggctcaggagcctctgcagagaaagcgtgagagatggagatgggcaaatggattcatttagagctgcggaacaggacgccctccgatgtgaaagaacttttcctggacaacagtcagtcaaatgaaggcaaattggaaggcctcacagatgaatttgaagaactggaattattaaatacaatcaacataggcctcacctcaattgcaaacttgccaaagttaaacaaacttaagaagcttgaactaagcagtaacagagcctcagtgggcctagaagtattggcagaaaagtgtccaaacctcatacatctaaatttaagtggcaacaaaattaaagacctcagcacaatagagcccctgaaaaagttagaaaacctcgagagcttagaccttttcacttgcgaggtaaccaacctgaacaactactgagaaaagatgttcaagctcctcctgcaactcacatatctcaacggctgtgacccggatgacaaggaggcccctaactcggatggtgagggctttgtggagtgcctggatgacaaggaggaggatgaggatgaggaggagtatgatgaagatgctcaggtaatggaagatgaggaggacgaggatga

SEQ ID NO: 69350 - DNA, 2652 bp, Homo sapiens
ttttcctagaattttttttttttttgagacagggtctggctctgccacccaggttagagtgcagaggtgcagtctcggctcactgcagcctctgcgtcccaagcttgagggatcctcccacctcaacctccagagtagctgggactacaggtgtgtgccaccgcgcctggcttatttttgcagtttttgtagagacggggtttcaccatgttgcccaggctggtcttgaactcctgggctcaagtgatatgcctaccttggcctcccaaagtgctgggattagaggtgtggtggccagaattttgttttttaatctactgtattggtctatgttttacacttggcagcaaaagctctcagtgcttttggatcttgtttcatttgttggacgctcttgtaaaattttttttttattaaaggtaggctagggttgagggagacagcagagtattgctttaaagtttgctgaaaaacatgccaactttattactgtttcccttggtattgctgatgggcttttctcttttttctaggacttggatgttgtgggtgatggtatgcagtgtcctccttcacctttgctttttgatccttcactaacccttgaagatcatttagtcaaagaaattgctgaagacccagtggatattttggcaagtgaagaacagtcccacctgtttccctcatgtagtgacctggccaggcagagggttccctgctagatagcatgtgctcctggaggggagtggggtgtcatcactagtataaagatgctccacatgtctctcacttattgaataccatataagcaaagcacttttaaaaatgccctactctgctcctgtgtacccttgttgctgtagttctccagatgggctcttagaacacctaatggcccgtgatcctcatatcccagagtaggacatacatttatttaaataaaagcttgagacaaggaatctagggaaatcataccttctgagggagagttcatcactgaaattgttctcattgtagaaggaccagtaaagtaatgtgatttgagttctgtccgtgagccttgggtagaattccagtggccctgactgaagaccagcagttgtactgtggctgttggtttcaagcagaggcctaaaggactgtcttcctgtggtctgttggctgttctgggacctcagtagggaatggctatttcatttggaagaaacaacctacagctcaccatcccattggaagaggctcaggaataggctcttccaagggactaggatagctaatatgggaagagcatctgtccagaattaatttctgttgtattgttcttattgctagtttaagtggccactgataagtcagattcatacttcagaccacagtgaatgaattactaactgaagtgcctttatttcttttaacagggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcatgttttgtttgagaatatagtttctttttcgcggttttggggacctgtctctgatgggaaagggaagttgggacagatgatacttccatcccaagaagtaaataaatcttcagtagctcattttggttttgctttgaaggaagaagtaaatgaaaaggggcaggacttattaaagcccatcagttccaaatatctttcttctttttaccctccactctgtgtctcctacacccactcccatttctcacgattaatgccaatgccatctctgccagacgtggtggcttacgcctgtaatcccagcactttgggaggctgaggtaggcggatcacttgagctcaggacttcaagaccagtctgggcaatgtggtgagaccctgtgtctatatttttaaattttaaataattatttttaaaaaaataatgctaataccatctcagaattctctagtggtagg

SEQ ID NO: 69351 - DNA, 1180 bp, Homo sapiens
ctacaggtatgtgccaagacgcctggctaatttttgtatttttagtagagatggggtttcaccatgttggccaggctggtaattttttgtggagactgggtttcaccatgttagccaggatggtctcaatctcttgacctcatgatccgcccaccttggcctcccaaagtgttaggattgcaggcgtgagccactgcacccggcctgagcagctttaagtagattttaaaattatatatattctttaatgtgaagatgttgtgattctcatttttggtgattagcacaccaacaaatgggaaaggattgcaaattcttagatttatttaaaagcgtagaactaagcttctcgtgaagctagatgaatagaaacacggagcatctataaactggattaaacataggggggtacaaacctcctggatatttttaattcttaggaagaaggagaatttagcaccagactcttgaaaagcagtggcatgaaagttagtttgatatattgtttgagtttgtattgccttaggccctgaatcaagaccaatggtttgctgtagctgttggtttcaaacaggagctaagagtgatgtcttccttgtggtctgttggctattcagtattccagtgcgaattgccaattcagttggaagaaacatagtctagaatgtaatgtcattttttttttttttttttttacagagcaaaactatgttaggcttaagaaccagggagttggccgggcgtggtggctcatgcctgtaatcccagcactttgggaggctgaggtgggccaatcactggtcgggagatcaaggccatcctggctaacatggtgaaaccctgtctctactaaaaatacaaaaaattagctgggcgtggtggcacacgcccatagtcccagctactggggaggctgaggcaggagaatcacttgaacccaggaggcggaggttgcagtgagccgagatcacgtcactgcactccagcctgggcgacagagcgagactctgtctcaaaaaaaaaaaaaacaaaacaaaaaaaaccaggttgttgctctgtcgggatagggacttaaccaaaataatatttcctagccattcagaggaactgtgagttttctgttgtccttcctttcttcctaccttctccctttcccttgttggagcttgtttgcttgctt

SEQ ID NO: 69352 - DNA, 1056 bp, Homo sapiens
tagagctctgtttccccctattccagtggtgctttaaatgaatttatcatgtaatcatctttggaaacgaggtccaagaaattgttgcaaactttgccagtctgctaagggagcagagacattgtatcgcttgactcttttggaagggctgtttaggggcattttcaaggctatttgcatttgccactacatgtttcttctgaatatgtgtgtgttcctaggagtgttactgctacttgcttaagggagaatgggatggtgtctagtttaaatgaccaggatcctgaaaaggaggttggggacaagttttaaattactggtagagctagaatttgatgctagtaaatgacatttattttgagaagtaactttaaaaattgctaactgcatttggtattctgtatcaaatgtagttgtaatttatcttatatagtccacaccttgagttttatgtggcagacaatgctatttgtattttatgctttcgatagattgtgttttatttcccttgaccatttttctacagatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgtaagttagagaagctctgctttggttcaggcccttgagacaaagccttatttattaatggtgagaataggttagtctttgtggttaggagaatcgacaaagtttttgaagtgatatatacgtatagttgtatttatatgttagcatattcatttagagaaatctaccctaccttatatttttttccagactcttcccatacctttttagggatacaatttacatactataaattgcactctttgaaagtgtataattgagtgatttttagtatat

SEQ ID NO: 69353 - DNA, 1049 bp, Homo sapiens
taaggttaataggaagaagaattaagtgatcattcttaaatttgtttttcagacccttggtctctgtttcagtaagagtaattttgtttcatttgttgagattccacttaaggctgcaatttcagagttctgttggtaaaagacaaaatttgtgttaaataggctatatcacacttttagaatatggagaggtgtatttgggattgaggttgactcattctttatgcactaggttttaaagttttttgtcttttgcataatattggtgaatctatttttgttaaatgttgaatttctagcctttaggatgtgcttttcttatataactattttcatcgtaattgtttgtgtgttcttttgtgggtctattttatctgtctttttccatttcaggcccataccactcgttccagtcagaggtgcttggcctttgtggatgatgttcgttgttccaatcagtctcttccaatgaccagacactgccttacccgtatctttttactctgcctgttaaggctgtggtttgctagtttgaagactagtgggaatctctgtgctagtttgcttaattgaaggattttgttttcctttggccctgaatcaaggccagcagtttgctgaagctgttggtttcaagcaggagcctaaagaattgtctttctatggtctgttggccatttcataactttggaaatgtaatggtcaattcattagaaagaaacatgagtcgtttttcatagatgtgggctaatatttatttatagccttaatacttgggtcccaaaatatacataaaatatttgtaattgtctcaaggtttctgatttaacttgcttattaggatcctaatgctgttaaatctaattataaacttaaaaaattactgtgggttttccaccccagttgaaaggatgattttgcactgtgaacttctagtattatccttttgtgtggttagggccctcacttctgtattttattttattttttattttttggagatggagttttgctctagtctcccaggctggagtgcaatggcgtgatct

SEQ ID NO: 69354 - DNA, 1031 bp, Homo sapiens
tgtttttttttttgttttgtttttaaaatttcaaggtttgggttgataaaagtaatctagttttgtgtggtggagttacagaggtgggaagtcttaatggctgctctcccttccttgcctcagatgaagacagctggagtgatggggagcaggaacccattactgtggatcagacatggagaggtgaccctgacagtgaagctgatagcatagacagtgatcaagaagatcccctaaagtaagttgtaactccacataaggcatttgaaatgtagttagtatgtggaatgtagtgctgcatgctgttaataaattagtaacctaggagggttgaagacagctatttgtcagcagtaagaggttctgtatataaaagtggcatggttcattgtcgtcttgcttcaaggcaggatgattcttttttagaagccttgtaatttaaaaaaagtttgaacaccaaattctacgtatgagaaagtataggggagaaaacaggaaatttagacatgggagtgtgggaggtggattgagaaatggtcagaccagtttagagaagagaaaatggttgtgaatgggtgcttggcctaaacctcaggaataatgtgattgtagttgaatacttctgcaaaatgtcgtgtttatgggatttataaattttttaaagttatatattgttttaaattgacaattgtacaatgtatggggtacagtgtgatgtttggatacttgtaaaccttgtgtcatgatcaaatcagggtaattagcatattcatcagctcaagcatttagtgtttttttgtgtgtggattttttttttaaaaagaagaataaaaaggtattcaagagtttggtttcatgcctaagaaagagaaaccgatttagaaacccaaaagtgattatatcttaatcaggtttatatcttagtaagcttctgctcttcacttaacccatcatcaccgtaggagttgtagaagcataaaaacattaccactctggagtctcatatttctgtgtctcaaggtctgggtgta

SEQ ID NO: 69355 - DNA, 1004 bp, Homo sapiens
gggaggcggcgtggccgccgcgtggggctggtgttgtcgcttcccttcgtgctgcagctgtgcgagtcctgaagatacattcagcgtggtgtggttcggggtggggccgggcatggagggacacgctaaagggaggcaaagccacagatgcctgtggagacttggggagggcggcggggacttacggagcgtaccttacggggacgacttctgcatgtcctttggaaactgtccgcgcgatctgtgtggagcaggaattttcgggaagggtaagggctttttggtctttcgtttgaccccgcaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatgggtatatatgtatagatatatatgtcgtttttcttaaagcgagggggtatgtgatatgatgcgggcttcagcatagctgccgcgtttgagattttgtccttgtaaatttggggttatggttgtatccttggaaaactgaaaaaacggtgaagactggaaagacccttgagttggattacttagttcacctctttggttcttttcccttatctgtaaaataaaggcatattctaaattagtctttttttttttttttttttttttaagagagatggggtcttgctattttgaccaggccggtctcaaactcctggcctcaaggtatcctcccatctcggcctcccagagtgctgggattacaggcgtgagcgaccgcgcccggccctaaagttaattttttggcgggggggcggcgcacagattcttgctttattccccagg

SEQ ID NO: 69356 - DNA, 1240 bp, Homo sapiens
attttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatggagagggatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaacactcatttgattgttgtttatgtgtactgtcctcaaattagtccttagtctttttttttttttttttgagacggaatctagccctgtcacccaggctggagagtacagtggcgtgatctcggctcactgcaacctctgcttcccgggttcaagcgattctcctgtctcagcctcctgagttgctgggattacaggcacccaccactatgcccagctaatttttgtatttttagtcgagacggggtttcactgtgttggccaggctggtctcgaactcttgacctcaggtgatctacccacctcggccccccaaagt

SEQ ID NO: 69357 - DNA, 1099 bp, Homo sapiens
aacagctctcaaaatgagaatcccagtggcaggtggagataaagctgcgtcttcaaaaccagaggagataaaaatgcgcataaaagtccatgctgcagctgataagcacaattctgtagaggacagtgttacaaagagccgagagcacaaagaaaagcacaagactcacccatctaatcatcatcatcatcataatcaccactcacacaagcactctcattcccaacttccagttggtactgggaacaaacgtcctggtgatccaaaacatagtagccagacaagcaacttagcacataaaacctatagcttgtctagttctttttcctcttccagttctactcgtaaaaggggaccctctgaagagactggaggggctgtgtttgatcatccagccaagattgccaagagtactaaatcctcttccctaaatttctccttcccttcacttcctacaatgggtcagatgcctgggcatagctcagacacaagtggcctttccttttcacagcccagctgtaaaactcgtgtccctcattcgaaactggataaagggcccactggggccaatggtcacaacacgacccagacaatagactatcaagacactgtgaatatgcttcactccctgctcagtgcccagggtgttcagcccactcagcccactgcatttgaatttgttcgtccttatagtgactatctgaatcctcggtctggtggaatctcctcgagatctggcaatacagacaaaccccggccaccacctctgccatcagaacctcctccaccacttccaccccttcctaagtaaaaaaagaaaaagaagaggagaaaaaaacttctttaaaaaaacacataatttttcttttttttttttggactaagaaaattacttatgaaatatgtcatccttggactagggaataaattgatattgagacatagttaggagggtggtagaaggccttggctatatatctgctgtctcatgcatttaactattttcttacagtttttactggtattagagaggtgttgaagctgtgaaggattaaggacacattctgaattcttggcctctccaccatctaattaggtt

SEQ ID NO: 69358 - DNA, 1151 bp, Homo sapiens
tccgagtagctgggattacaggcatgcgccaccaccccagctaattttttatttttagtagagacggggtttctccatgttggtcaggctggtcttgaactctggacctcaggtgatccgcccacctcggcgtcccaaagtgctgggattacaggcgtgagccaccgtgcccagccttaattaaaaactttcttaacagcaaaagtcacttttcccaaatatgtcaaagtcttctagattctgatcttgcttctagatcatcttagttcatcctgtagtttagtgattctcagtgaatccttacatcagaatctctgggttacttgttaaaaaatgcttgcacccttctccaaacatttaattaaattttagggagcaggtccaagaattgcatttaaacaagtacctcagatatgtggtgtgcagaataaagcttgagtacctagatctggaagcagcatagttattaatgttaaaattaaaaatcattgatctgtctactttggcagaatgtaaacgtcaggtttacagggaccatgtgtgtctcatttgccactatattcacagtaccttgcaaatattaaatgcttactaaatatttgttgagaatgaatggaactaataacttttttcctcccccacccctgactttttttttttttctttagcaagcaaggacttagcacagacttcttacttcatggcaaccaacaggtttatattttaatttttttttctcttcgatttttggtataggactttacttgagtttgatacagtgtgctatagataattctctggtgaatgttgatttttctgcacagttttcatgttgtactttaaatttccatggtactttttaattttctaaggttatgtaattatttagtactgatttttttgataacctactcagttctgcatgatagtgactgaaaatctaatttggagtattctgcaataattatatgtgtatatatatatatatatatatatttttttttttttttttaaattattattattattttttgagacagagtcttgctctgttgcccaggctggagtgcagtggcacaatatcagctcactgcaagctccaccttccaggtttacaccattctcctgcctcagcctcccgagtagctagg

SEQ ID NO: 69359 - DNA, 1016 bp, Homo sapiens
tggcacaatcttggctcattgcaacctccgcctcctgggtgcacgccattctcctgcctcagcctccagagtagctgggactacaggcgcccgccaccacgcccagctaaatttttgtatttttagtagagatagggtttcaccgtgttagccaggatggtcttgatctcctgaccttgtgatccgctcgcctcggcctcccaaagtgctgggattacaggcttgatccaccgcgcccagcctctagttaacttttttcttaaaatatcttcaaattatatttcatgggacaatgatgtttttctggtggaataaatttctattaatattttagtgtggaaaccagtaaggtgtaatttacaatcagttatccttttacaataatttgtaaaatgtaaacttcttaatagttttttaatccattactttttcttttaaggctttgaactaacaattgatcacccacatactcatgtagtaaagtgcactcaacttgttcgaggtaaggaatcccagcttatgaagactatctcaagctgttttcccatttagaggttgtggtttgtggtggacaatacataatagttctgctttggctaaatttaaaggcctacttggcttaaatcaaaatgagttgttctgacttgatgtttttctgttgggttcttacaagtaatatttttagatgatctctagttaaagagaactaacctcttgagaatgtttgtcaaagttgggcagtttgtgaagttatttaacagaaattttatgaaagttgtgaggagtgggtgatcttattttaattctggggttgattaaaggccacctagaggatcatacagaatttatttggactttccatgatatacaatcccttggcagaacttttctttttaattctaatttaacaatattaggtataattgaatgaaactctcttatttagtttagtatcaagaatatctgaacactattgtgcctttaagtgccttttatgatttttaggccaaactgat

SEQ ID NO: 69360 - DNA, 1041 bp, Homo sapiens
gataaagattgtatttcacaaaaaaattagccgggcgtggtgttgcgcgcctggaatcttagctacttgggaggctgaggcaggggaattgcttgaaccagggaggtggaggttgcagtgagtcgagatcacaccactgcactccagcctgggtgacagagggagactctgtctaaaaaaaaaaaaaaaaaaaaaaaaaaagattgtatttcagttcttaactctacctcctaactccactcatgccttttattgttttggtttccctggaagggattgttagaattgtttatactttatatattgtgcctttgtagggaataatttctgtcttctcacttttaggcttatttgcaacaagttcaagatctggtcattttagaaagcataattttgcagactttaggtaagtttattttcctttgaaacatttttttaaattatgcaataaaatgatttgattctaaaaatttgctatataggaagaatatttcttgggaaagtttttgtagtgtccctctgtttccagatgatagaggttgtagacctgagtttagctttgacctgttccatagagtgaatgcaggtagtacagctgacctttgaaacagcagccagtgggttattatttttttcattctagggttatttgctttttaagttttggtgatttttacccccaaaaattataaaaactatctaaagaatgtttttccttccgtggattgttatggcctgtaacagcatttgtttttaaaattggtaactagtgtttagaacagcagagtgaaagtgggggaacttaagctttagtggttgcatgggcaactctgatgatattgtgttattatctgttattttcatcacacaggctgcctttagaagtttagaaaatatgaaaatacagattttttttttcctggttcttttgggctatcatttttctcttctaggtagggtaagatttcatgagttgtacgtcaaagttattggcgtagacacaattttttttgtacatatatatatatgatgagttcttca

SEQ ID NO: 69361 - DNA, 1055 bp, Homo sapiens
gctgtgatgaatccaaatttaaatgtgagaggacttaatacattaaatgtggcctaataatcaatgtggcattgatatgttatatatcctgtcaagtcctcaggcatttttgtatgtgtgtgtgtgtttttcttattacaaaggtattagaggctgggcgtgttgactcaggcctgtaatcctagcactttgggaggccgagttgggtggatcatttgaggtcaggagttcgaaaacatcctggccaacatggtgaaaccccgtctctattaaaaacacaaaaatcagccgggcatggtggcgtgcacctgtagtcccagctactcacttgggaggctgaggcagaattgcttgaacccgggaggtggaggttgcagtgagctgagatcgtgccgttgcactccagcttgggtgacagagtgagactccatctcaaaaaaaaaaaaatgaagaaacccaaagatattataataaattcccatggtaaaaattaagacagtacagaaatgtatgtggaaagtgaaaactactctgtaatcccacccagagataaccattgataaatgtttggtttatagtgacccagacatttttctgtgcacataaactagcattgaggtatttttatttaaaaaatcatatcttgctatgctactgttgcacagcttgcctttatcatgtaacagtatgtattggacatctttccatacttccctttattattttttggatttcttattattttaatttgccacatggtatttgtgtagttactgtagtttatttaaccagctttttattgatagctatttgggttgttgttctagtttattatattgtacattatgtttcatgggatagtcttgtacatatatagtgcacttatataagcattttaatacaagttcctataggtggaattgctgtgcccagagtatacaatgtataaaaatttttgtagtgtcagtttgccctactgaaagattatacattgtttccagcactgtaggtgagggtccttttctttccaccctaacaaacaacaaatattaatt

SEQ ID NO: 69362 - DNA, 1170 bp, Homo sapiens
cctggccaacatggtgaaaccatgtctctactaaaaatacaaaaagtagccaggtctgttggtgggcgcctgtaatctcagctactggggaagctgaggcaggagaatcgcttgaatttgggaggtagaggtttcagtgggccaagatggtgccaccgcactccagtgtgggcgacagagtgtgagccaccgcgcctggccgccttatatagtttttaaaaaaatctgtctagattcatacatcctgagatgtttgtttattcattcagtacatttatattaaatatttgttatgtgtaaggcattgtgctaagtgtcagttggcgattaataatttggtgaaagaaaacagacatattctttgatttggagagataagtatgattttcatttagtagtatctacttgcttggccatttcatccttttgggagggagatagaggttatcttttccagaattatacctgcctgtttttggatcttaacttgaacacttcagctcacaattgactatcaacactgctatagtatacatgcatcgattctacatgattcagtccttcacacagttccctggaaatgtaagtataatttttttatatgatataatccttttgtgattgattccacctacctattccatttgtggttggtctttgctactgaactgtaacttgaactttagaatttagggttgatcacttccattatgtgctgtgttgctgttctgaatccagcttttcagttttcctgttaagtgtctacttgtctagtggatttagtatatccatgtcgattctctaaagaagtagattaggccgggtgcagtggctcacaactgtaatcccagcactttgagagactgagatgggaggatcacttgagcccaggagttcaaaaccagcctgggcaacataatgagacctcatttctacaaaatatcaaaaacaaaaacaaaaagcaagtagctgggtgttgtggtatgcatctgtggtctcagctactccagcagctggcaagaggattgcttgaactcagggagttgaggatgcagtgagccaagattgagtcgcttcactccagcctgggcatcagagtgagaccctgtcttcaaaaaaaaccccaaaaaacagattatcagacatctaaagtcaacattttggggttgg

SEQ ID NO: 69363 - DNA, 1404 bp, Homo sapiens
agcggcgcgtgggcggccgccccatcccactataattgcggcctcgcagcctgacccggggcgccaacgctcaatccggttctcgcgggaagatacacggtttttaagaaagaacttctaaccccactccaccgcccaacggtcacgtgacgcgcctgcgtcctcgcctcaaggttttttctggtcgcatattggctgttaactcggctacggggtgtagcgaggtgcattccggaagtaggtcctttgacttttgcttcctctacggaggcaagtaacaacccggcggtcgacgcttagcggaagttcgtcaagtcgcagttgcccccgcacagcggatgtgggtcgcctcttaggtgacgctgggaagtgcctgcagccttcgccgctgccttctggttgaagcactatggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtgtatccttgtggcctaggccttcggccttggagttggtcccgccatgctctggcgtccgggtctcaggctctgtgggggggacgaaagtggggaagaaggtgggcagaagctggatgtctagttgggagagcccacgatggggcgggctgaaactcagttagcgctagggaagcgaggcagagttgatttcccgctcgctcacccgtgccgccagccttgctgggaattcgtatccttcccggctttgtgttttaaccagcccttccaactctgtcttcattgtgttctgatctgctctggtgacgttaagattctcattttccgctgtgccctaggggtctaggtctggcagaggtttctctgttgacggctgcctcccaaacctagtgtgtaaatttcgagaaattcagtacctgaaagtgttataaagggtggactagaattaatgcctcagccttggtccaaaatccattcctcatctactagctgtttaagtgacctctcaaatttttggccgtcttgtctataaaatgggataatacctcttgtgtttgattctgtgtccagcacagtgctttgcattcagatgctcagttagtagctactgttttatagaatttcagaggaaagatgttagtttacgtttgtaggggatacccacgaatctaatgttttaaatagtttacaaaataccgggtccttaacttacttagagtgatgatatgtatttcattttcaaaaatgaggtaacggctggatgcggtggctcacgcctgtaatctctgcactttgggaggccgaggcgggtggatcacctgaggtcaggagttcga

SEQ ID NO: 69364 - DNA, 1054 bp, Homo sapiens
gggggctgtcctggcacagacattggcccttctgtgccaggcctggtgatgggcgctggggacccaggaactcaccagagtctcccacactaggagcaaccaggggccctggtgtgttgtaggggctgggcatggaaggtggaggatatgggggtttgaggggtgtggtgggaaggttaggtcaggcaggagagtgcagggctctccctgcccaagggtgctgtggcctctgccttcacccaacgctgcctctgccacccccgcagtacttcatcgggaacatgctgctgagtctcttggccagctctgtcttcctgcacatcagcagcatcgggaagttggccatgatctttgtcttggggctcatctatttggtgctgcttctgctgggtcccccagccaccatctttgacaactatgacctactgcttggcgtccatggcttgtgagtttattctcaggtcctttaataccccaggagcttccctcacctttctaggtcactgtgagcctctctggtgcccatgccccttgtgccttggaatgccacaacacccctgtgggggaaagggaggagatggaggagctcccagcatgtgaccccaaatagttacccccaaggaaaccctagtcctgggaaatccttgtgtctttaggctagacattaaaaaaaaaaattccctcttacatttgcatggtgctttcacatccaccatcttaaccacctataggacatacagctgcttggtggcagggctctggttaggaaccaaagcttctgattcctgcttgggggctttgcctgggacaccacactggcttttcctctgcaaaaccccattcctttgatatgtggccatagcttgttgtagtagaaaaagcctctggtctctgctgggtttgaatccctgctctgctgctcattagctgtgtgactttagacaggtgagttagcttctctgagcctcaatttcttcatctgtaaaatggcaatgtcacctaaatcacagggtagttgtaaagattatagtaactaacatttatggaaggctga

SEQ ID NO: 69365 - DNA, 1026 bp, Homo sapiens
cagtgagagccctgcctttcctctcttagcttctctcttcaccacttcccagaagcttcctaaatacccacacaagcccacaatccctggagcctgcatccctgcttgttccagagggtgggacaagaatgcccagatcttccagaattaaatgatttttctggccctgttctgccccagctccaccctgatgcttgggatctatgccagcatcttcctgctgctgctaatcaccgtgctgatctgtgctgtgtactcctgtggttctgtacgtaaggggatttctgaggctgttggggagggcaggctggactccagacagggaggaggtcacatggggagagggagaaggccatgcctcttccactgggccccatccctggttgccattcctccttggctgatacaaccttcaactcttggtctcttgatgcctctagctgttccctaaggccctgcaacgtctgtcccgcagcattgtccgctcacgggcacatagcaccgcagttggcatcttttccgtcctgcttgtgtttacttctgccattgccaacatggtaagggtccagtgggaattctcccacctctgctctgtgccaagcactgtcctggacactgggagtacagcggagaaaaggacatattttctgccctcagggagccccctcccagaataggggaaggttaactccggttctccttccttgttctcccaacctcttgtcatccctgagtgagtactaaggcccatggggtataaggtacctgggcatagcccaggttagggtacatggcttcaccaggtaccttgcaaccctttccctccttggttaccctgatatacccctccacttttgcagttcacctgtaaccacacccccatacggagctgtgcagcccggatgctgaatttaacacctgctgacatcactgcctgccacctgcagcagctcaattactctctgggcctggatgctcccctgtgtgagggcaccatgcccacctgcagctttcctgaggtgttcg

SEQ ID NO: 69366 - DNA, 1020 bp, Homo sapiens
gggcaggcagggcagcccagggcaggcaggacctcgggcctcagtcaaagccgtgccagtcgctgtgctccgagtagtattccagcttggcacccatgcatttgacaccgtccagcagcatgcatgtgccatggcgtcagcccatgatgcaggcttgcaccttccgcgcacgcaggtgctggtgccaccttcccagactagtagcatcccctctttgaggaccccttctttgtgcgcctagtactcgcacttgacactataaccttcagggaagggtaggacgctgagaagcttcaggtgcaggctggggacaagtgcctggcggacgtccttgctcagcctgtgcactgggacggagcaaaggtaatctcatacctgtgcaggatcttcaggaaccttgaccagaaagctgctgtccctctcctggatgaccatgaccaccgagtcctgcaacttctcatcaaagtggacgtggctttgggagccctctgcatcgtggcctgtcacaaagtggatactccggaatctgggcttgctgcctttgttggttgcagccatggaccccctccctgccacgcagcttccgcaggaccaagccactcatgcccagcagcctcccatgctccggggacaacagcaggagccttgcagggtgcagcccggggcggacagggcagggacgaccgctgaggcggtggcagggtctcaacgctgagcacaaggaagggagcaaggctcctcttttaatttggttttcagtcagttggaactcagtccttagtttaggactggagcttgggaaaagagaagcgaagaagaggaagattttcaattactactgggcttgcttcagactggatccaaggctcactgcctttgcagcaaggagcaggaattgcctagtcacgtcatgcagtcatgtccccaggaaaaacatgaacaatcacagcttttcctttctgggcctctcctctttgttttgtttgtttgtgtttgtttgtttttttagagacagggtat

SEQ ID NO: 69367 - DNA, 1300 bp, Homo sapiens
atcagacacggctccccagggcatctgggctatgctgagtgacgttcttcccattccccagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgttagatctagttctagttaaacttcccagcttctccctggcaggagggacaccactgggtgcggggtgggttggcttggaaaatgagagacagccacattaagagaagagtagaggggtctctgctgatagtcttgagtctgtaggtggacttgagaggagatgcagaagccacgcaggactgtaatgcatcttccgcccctgctctagcctcgcgtaatgtgtggccctggcctggacaccctctagggagctttaggcaaaggtgagaaaggaaagcagttgtgaaattttggcaggtgaggc

SEQ ID NO: 69368 - DNA, 2586 bp, Homo sapiens
cagaacgagaggctgaagctctaaagcgacggcagcaggaggtggaagagcggcagaggatgcttgaagaagagaggaagaaaaggaaacagttccaagacttgggcaggaagatgttgggtttgttattctaccctgtgtagcccctagatggaagaggaaagagtgggatgagatacagtgtctcttaggagagatagaaacctgttcactctggagtttggaaaggggaaggatggtgggagtttatgagaaaacatttttctgttagatctccatttaccccatatcataagtctacccctttttttcttcatttggggttcctcgtctggattccctccattccctctcctcttttcttccatgagctcttctgcagctttgctttctttggtctgcagaagatcctcaggaacgggaacgtcgggaacgcagggagaggatggaacgggagaccaatggaaatgaggatgaggaagggcggcagaagatccgggaagagaaggataagagcaaggaactgcatgccattaaggtgcaggccttggctccatcttcacttctctcccacacaaaaatgaggtttagttatttggccattgtgatctctgcatgtgagaattgggcctcaaagctcatgtgctttgtgttctgtccctgggtaggagcgttacctgggtggcatcaaaaagcggcgccgaacgagacatctcaatgaccggaaatttgtttttgagtgggatgcatctgaggacacatccattgactacaaccccctgtgagtggcttcaggcctgagttctaggtcttttccactaggcagtcctagagagctgatgactacggaggtggaggaagtaagataagctgggatggaaaattggtagactggtagtcagccagccctctggtggaagaaagaccctgtctgggaagaactgtttcatactagtagtctgcccttccttcctactgccgttaacagctccttcttttttcttttcctctatctcaatcccaggtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggagtgagtgatcaaggctagggtggctggacagagcccagaggctctacagaaaggagttggagggcactgattctacttactcctcacaccctgctccagggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggtaaggagggatagattggcccaagagatctgacatgttcctacactagtttgggaatagagaactttgttccttgactatttggagccatcgctgctagtgggcaccaatgtgaccttttctgtcactttctggtagaagtgttggcttttagtgattaggtttcttcttggggtccctatttctgtgaactgtacttggcatccttccattgtgctagcagatgtgcttactactatcagtggttgcccaggtggtataactctccctgtacctattactctttcttggggtcactgcaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggtgaggtcagctagcaccagctggagtgggtttgtctgggtaggaaaggtgaaagtggcaaatgaatgtttgatttttgttttacgtctataatcagaagctttcttctttattctttgttggatattagggaataattggatcatgatatcgaagaagtatatgttgctggcaaagacctggagaactttgctatcctggagtctctgatttattttatttatttttttgaggcagagtctcactctgtcacccaggctggagtgcagtggcacgatctcagctcactacaacttttgcctcccaggttcaggtgattctcctgcttcatcctcctgagtagctggggattacaggcgtgtgccaccacttctagctaatttttggttttttgttttgttttgttttttgagacggagtttcgctcttgttgcccaggctggagtgcaatggcgcaatctcggctcactgcaacctcctcctcccaggttcaagtgattctcctccctcagcctcccaagtagctgggattataggtgcccgtcaccatgcccggctaatttttttgtatttttagtagagacggggtctcaatgttggtcaggctggtctctaactcctgacctcaagtgatctgcctgcctc

SEQ ID NO: 69369 - DNA, 1024 bp, Homo sapiens
tgggccagtcttgttgagtcatggggaaacttccattctcttttcggggctcaacttgaacctcatccaggcactgaagtaagagtgatgtggaccttgttccttttcctcaaagcttatctcctggtcgaggaaaagactttaaatctcggaaggacagagactctaagaaggatgaagaggatgaacatggtgataagaagcctaaggtaaaggagaggaaggatatttttcatcttcaactcgtgcgttgctttgttgatctttaaagggagagagcctttatagactaaagttctgttttatcttcaggcccagccattatccctggaggagcttctggccaagaaaaaggctgaggaagaagctgaggctaaggtaagtacttgagggtcttcattcatcggctcaggctgccataacacaataccacagactgggtgacttcaacgacagaagttaattttctcacagttctggaggctggaagtctgagagcggagtgtcagcagggttatttcttctgaggtctctctccttggcttataaggctgtcttcttcctcagctcttcacatggtcctccctctgtacacatgtaccccttgtgttggattagggctcaccctaaaaggcccttttttttttttttttttttttttttgagacagagtctcactctgtcgcccaggatggagtacagtggcatgatatcggctcacttcaacctccacctcccaggctgaagcaatcctcccacctcagcctcccaagtatctgggactacaggtgcgtgccacaacgtccagctaatttttgtattttttgtagagtccagatttcaccacgttgtccaggctggtctcgaacccctgggctcaagtgatctgccctccttggcctcacaaagtgctgggattacaggcgtgagccactgtgcccagcctaatgggctcattttaacttaatcacctctttacatgtcctgtctccacatatagtcaaattctgaggtactaggagtt

SEQ ID NO: 69370 - DNA, 1002 bp, Homo sapiens
ttagcctcttcggctccaaagctgccctggaaatcccccctgaaatgagtaagaccctagggctctacgagttacctcctgaggttcaaacctcacttctagtactccacttgtcccatatcctattggaagccagagatttaagaagtgagggaaaggtcaattgaggatggaggaggaagactttgatcttcatgtcatgggatttggggaaggtggatagcttccagttcagttgtgtcttcttcttcaaggtctggagcagagtcttctcgacatgtgtgtggggtgagtatctcggcaggggtgggcctgggtaccccctttgcatgggtagaggctttctcggccatcctcactccttaagcaggagaatgtggaataaaggaccctgcttcccactggacaggtccaggtcagtgggacctctgagggcattcaaagcctctgtgcctcttgcgctgttgcttttgtcgggggagttgaggcacatggggagatggacacctttgctggccagcctgtttggtgttcaggtggaaaaattcgtgttttgggtgtgaagattcagggggttttgctgaaggagcttcagctggactgaggctgctggcctacctctcctgcctctggctgtgactgacattccttccctcagagagaagcgaagggcaatcattccttctcacttggcctatggaaaacggggatttccaccatctgtcccaggtaatctgactaggactctctctcaggccatcaaaatacccagtccctaagagctataaggagctatatactttgtttgatgcttgagaagatccagaccaagtttgtttagacagataggagtggctggggcctccatctacagggccacctttttcctcctcatatcaccaacagggactaaagacaacctgatgaggccacctggcatgacctccagcagccagtaacttgttagggaagagacctgcttgggccacatgggtctgctgc

SEQ ID NO: 69371 - DNA, 1525 bp, Homo sapiens
tgcaatggcgtgatctcggctcactgcaacctctgcctctcaggttcaagcaattctcctgcctcagcctccgagtagctgggactacaggtatgtgccaccatgcccagctgatttttctatttttagtagagatggggtttcaccatgttggccaggctggtcttgaacttgtgacctcaagtgattcgcccaccttggcctcccaaagcactgggattacaggcatgagccaccgtgcctggcagaaaagcttcttttccagttctgaagagtgtgaaggtaggagagccagaattcagttctctcactttccaacccagtacctggagagagagtgtcttgctggtcactggggagtgataggatccggatgcccgccttcctcttcaagtttttctttctgattgggtttcctgaccctgattgctggtatgggtaagaatgactctgaattcctgagaaaagggaagagggttaggacagaggaaatggaatcatttagtcaggtaaagggagcaaagccaccgaaggcagtggttggaggtgtagatgtgaggaagttgggttgagaccattcaccatcaaggcttgaagatgagtgtctgtttgtgtgtgtcatgttggctgtgagttgcagaagagagtatctggcctctagttgaggagcacttccggcttctgagctgaacatggtgtagaagagaggatactcaatccaaaaccctggctatctatgcagagggctgaccagttctacccatgtacccttccttccctcacccttcctcacaaaccaggcatattgagagctgtctggcagtcaatccaggcgaggcagcaggtttgagaatgggcttgtccgcctggcacctgcttccccccacttccaccttcacccctccatcccatatatcgttcagggtcctcccagcacagaattgaatagaaggacttttaaggcttggagggcttagcttggggctctaacccacaggaattctttctgagttctgaatatagtaataaagggcactcttggccttaggttatagataggagatggggaatctgttcttgtctttgccaaatcttgcatttatgggatgatacctctttgattagaacagccataggggaagagtggaggaagtaagtaagtgcttcattcttggatgaatatatgcataaacatacctgaaagaaaacatctagtcagctgggggtatgtatacccttgaaaatacaacaccaggccaggcatggtggctcaattctataacctcaacactttgggaggcttaggtgggaggatagcttgagcccaggagtttgagatcaacctgggcaacatggtgaggccccatctctataagaaaaaaaaaaaaaaaaaaaaaaaaaaaaatatatatatatatatatatatatatatatatataaatatatgtttatatgatatatatacaattatatgtttatattatatatatatatatatttttacttttatttaaaaaaaatagag

SEQ ID NO: 69372 - DNA, 1105 bp, Homo sapiens
tttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcagctttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtctgggcagtgtaatgacc

SEQ ID NO: 69373 - DNA, 4341 bp, Homo sapiens
ctttgtctaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattggtaagagcacagcttggatgtgggctttcacgccggcagctgaggcagggcagggacctattcctggttccccaacctggcctcttctccccaggcaagtccatacaatttgtggggttcagaaaagagggtggtgttgtttagcttactaccaggtgctgaggctgctgtttgcccacctaacctggctctccctgatgcgggaacttccatggcctggcactcaacagctgccctcaggcacggagttggtttcttctctgtgttgtttggaaagcaggtaaaaggctttgatgttcctgccaaaggcttggaattacttgggtttagatctttggtggccaatcttggttacagtttgctgaagggaggtctccctacatttgctatgtagatgggggctccagtcagcattgtcagctggctctgcctttggggctccaggatgccagcttacttccctttcttcactctgcctctcaggccccacatcttagctgaggccgactctggtagccaaagtaccagagcagggctgagtcattttgtaggagggagcaccaaagactgagtggaaaagtcaggaaagttggcccacgttacccaggcaactgtgaacctctcaaccaacttcctcatcctctttgacttctcttaggttttcattttggccttcaggctgctagcttaacgattatcaggtctgaggaagccttagcttttgttccattgttggtgttatggccaccactgggggaaagcagaaccaaactcattgtggtggtgtttgcggggctagtgtttgaggccaagtggccattgcctgttttttttccaaagggttcaatgtggagacagtggagtataagaacatcagctttacagtgtgggatgtgggtggccaggacaagattcgacccctctggagacactacttccagaacacccaaggtatgctcaggcctagcgtgggttggttgggtatgagcagagagtgtggctgtctttgttaatgggtggccaactgttaccctgctgcagctcctgggggcagaagaaagggaggaaagggagcaaatatttggagggtgtcaggcaggtgtggtcttttggttggggggagggggttacctgtcatcttagtgcagcccatgctctgccttcctagggttgatatttgtggtcgacagcaatgatcgggagcgagtaaatgaggcccgggaagagctgatgagaatgctggcggaggacgagctccgggatgctgtactccttgtctttgcaaacaaacaggtgagacttcttcccacccctgaatttgggagacagcaaactggctgtggaaattgttggctcttgggcctattatatggttaacccttttagtatgctctcaatgttagaagcgtgggaaactgagcacttggcttctttatgcccctcttcttgtgccccaccccaagctttatttagcaacatttcagtcctcaggaattgtctcaaatctttctttcatcttgcctgttatctactttaggagaattggcctcactcctgctgtcagacagacctgattctttggtcagtctgaatcacgtctcttgcttccccaccatcctcgtatttggtttccaattcttcagtacagtgacctctagtgctttggatcttgagttctaggtgactaaatccaaagtagctccttaggatcttgttctgggtttcctaaaataaaggaggaggggaaggtgctggtacacatttctttggtagatgggtgttctagaagcctttaaaaaatcctgaggcttctttttatgtgtctcccacgtgctccaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactc

SEQ ID NO: 69374 - DNA, 1048 bp, Homo sapiens
ctctttggtaggtgacattgaaacagacaactaactgaaggaggtgaaggagtaatctatgatggttatctggaagagaagcattccaggcagaggtgatagcaaatatgaaagctttgggccaggcatggtggctcatgcttgtaatcccagtgccctgggaggctaaggcaggaggattgcttgaacccaggagtttgggaccagcctgggcaacacggtaagacctcgcctctttaaaaaaaaaaaaaaaaagctttgaggcaggaaaggaaagtgttggggaattggagtggagtaagcaaagagagagtagtagatctcatgagagaagtaggggagtgtaggtcttgtaggaccttgtaagccatggtttgggccttgggttttactgaaaaggagctatgaagccacgagtgggttttgaacaaaggactcatatgacctgagtttggttttaaaaccaccctagatgctatatggagaataggccgaaaggcttagggaagaagcagagaaccaatgagatgactgcctcattgcagcgaccatgtgggacagccccctccttggatgggccacagtaagccaaggatgcacctagctgaggagtaaaggggtagccccgccataccccacctctctactgccagtgcactgttgtttgaacagggcacaacattagcagctggcattccacagagtgtaaaggatcggcttcttttaagagtgcggctttcttattcctcctttattttggtgtggaagaaagatggagttgcaaaaatataggaagggaagaggcagagtctcttgattaaaggagaaagcataaaccttgggaaactggcaagcctgaaccttgtcaggagtcacagagagccactccttattccgctccctcctctcccacccttgccagaagtctcagggtaagtaaggttaggggagggaggggcattaatgatcttacaatgcctttgggtatagggtagaatgtcagaactgaagggacttcagaaatcatctagttcaatcccccttccat

SEQ ID NO: 69375 - DNA, 1058 bp, Homo sapiens
gcacccggccaatttttgggtttttaatagagacggggtttcaccatgttggccaggctggtctcgaactcctgacctcaggtgatccacccacctcagcctcccaaagtgctgggattacaggcgtgagccactgtgcccggccttttttttttttttttttttttaagacagagtcttcctctgtcaaccaggctggagtgccagcggcatgatctcagctcactgtaacctctgcctcctggattccagcggttctcctgcctcggcttcctgagtacaggcgcgcaccaccatgcccagctaatttttatatttttaatagagatggggcttcaccatgttggccaggctggtgtcaaactcccagcctcaggtgatacgcccacctcagcctcccaaagtgctgggattacaggcatgagccaccatgcctggccagctatttagatattttatcagttattcatcagtcccactgtatattaaatggcaagagagaatcccaccaattctagtcttctagtccttttatgttgttcccaaaccagtcctgcgtcaaatatgtgtggaaaatggctgagaatggacaggatagctaagcaactcgctgtgcattacacagagataccaaatcctactggacagaagaaataatataaggacatcctcagatgaggcttaaatcagccaatgtgcttaattgaactcccacaatctacttggcactagagggaggacagattcaaaataagtagacatagtctttgcacatagggaatacacagcttaacgtgggaagcagtaaatacacagacttataaaagaagaaaaactcgacaaggtagtaagtgccacattgagtggttaaggtcattcaaagtaaggccttgatgtggcatgccaggaaataataggtgtaacactgggatcagcttttgaaccaggacttcagcatgacagccgagcaaagaagcaaatcaaaggacagtgtacctgtgttctggggcaaggcatattggctagttatatctttttcagccaccactatactcaca

SEQ ID NO: 69376 - DNA, 1025 bp, Homo sapiens
gcctgaactctcctcaccatttttgttgaggtaaatttagaggcagaatggtatagtaattaagagtggatcttggaatcagacaaaattagattcaaatcctgcttctgctaattaccagttgcatgtttcttgtaaaattgcttgtcttctctctttattttcttcatctgtaaagaaggtaatgacatatggttttcaagagaattattatttttttggttgtcagtagaattaaatgagataaatgtaaagcacctggtattgtacaaagcatatagtaagtaccaaataactgttagctgctattaataatccattatcataatcctaataatatgaacactcagggctgccttagaggaaaagaggtttacagaagaacaacttgctgcctgaggtgcttgtgtagagggatgattgttaccatgagtttctgtgctggtcgtaggcttatgagcagcgaaatcttttttcagcttcagcatcagcatcgcagagacagctcctgctgcctgagtgggaggtgaagctggagcaaggcaggggccctgaaccatcaatttggatgtagggtgaagatatgggggcacaagaatagtattcatattagaaaagtcagtgtgactctgagataatggttcactcttccagaaaagagcaccctgatgacctaggtcagggatttagattcctagatgcccttattttaggtctcagtcagtatatggggatcttcatttagtccactcttttcatttagtccaatcttaataaaaaatgtctgcttttgagtatctgtttcagaatatcatggcctagaaattgtgatatctgtagaattatctgtctaccgtaccttcttcacttgaacatctgttgcaaatatagatagagtgctaataaaactatttgataatgaaaagacatgaggagcgtttggaaagggtcccacagatgtttgaaggtttcatattatagtctggtaaagaactgactaaagtagggatttcatgaatgtgtta

SEQ ID NO: 69377 - DNA, 1084 bp, Homo sapiens
tagggaagtggtggggggggggcactgttaaatatggagagggagaagggagtctcttctgtgatctaagggtcttagaagcttccaggctttcaaatcctatttgaaaaggaattgaatgagttgggtgtggcttgtggctgacaattgccctgaatccctctgttgaggttggatgggttcagggtttggaggctggctctcttgcttccctgcaagctccttcctctgtctccccagaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggtagggaggccagcaaccctaaaggagctgaggggagcagccttgagagtggggtttggcaaggagagtaggggcagaggggcttcccctgaggccagcactaaacattccctttctcccttgttgctctgtgccaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtga

SEQ ID NO: 69378 - DNA, 1289 bp, Homo sapiens
accatccccagcacagtcttggaagaattttaagaagcttacttcattgaaaaaagaggaaagtgaaaatgtgctaagtatatgaaagggaaagcttggattaaagatgagaaacatttttagactataacatgttaaagagagatactataggctttatgttttagtcaacttcttttacctatagggaccaatagataaagtcttaacctggagacaggggttggatgaaatggtttctaagaggtttatccaggttttgtggaaacaataggaacaagacagataaaataaggggtcttattaaaaaataatgctctaaatatttgagatactagaacactattttgttttctgtctcttttgattgggagtttttatgtggaaggaagctactaactatcccaccctatgcagagaccccagaatccaacaatagcgtgtatacttccttcatgaagtctcatcgctgctatgacctgattcccacaagctccaaattggttgtatttgatacgtccctgcaggtgggtgaaatcctcttttcccttccccctttggagcctgtggtttaatacctctcatcctatctcatcctaagggtaatatccttatccttctgtgaagttagtctcatgttttacccaacatgcccaaacactgttctttttttacagtcctgcccctgtggatttgcctttatgattattactgtcttggctacaggtgaagaaagctttttttgctttggtgactaacggtgtacgagctgcccctttatgggatagtaagaagcaaagttttgtgggtaagcaaaagtttctggaacacaatattattggcatcttgtgctgggcagggagacaagcttcaggcagtgctgagggctctgtcttgtcctctaggcatgctgaccatcactgatttcatcaatatcctgcaccgctactataaatcagccttggtaaggaaccttaacccaatgaccaaaatcactttccctgccctaaatccctcattctcatttctttttctccaagcaagccacgagggcttaaggaagcagagagatcaggtctcaaattctgttgcttctgctttcaggtacagatctatgagctagaagaacacaagatagaaacttggagaggtatgtagagaattggggttataaaaggataaagggatggcgggtttctgggaaacacttttccatggtggtattttgtgacccatcccttttcccttcagaggtgtatctccaggactcctttaaaccgcttgtctgc

SEQ ID NO: 69379 - DNA, 1047 bp, Homo sapiens
cagggttgttatgaagattaaatgagatcatatttctgaagagccttataaggctgggtgcagtaactcgtgcctgtaatcgtagtgctttgagaggccaaggagggcaatcacttgagcccaggagttcaagaccagcctgggcaacatggcaaaactccatctctactaaaaatacaaaaattagctgggtatagtggcttgcacctgtagtcccagctactcaggaggctgaggtgagagaggatcacctgaccccgaggaggtcaaggctgaagtgagctgtgatcacaccactgcactgcagcctgggtgacagagcgagaccttgtctcaaaaacaaaaaaaaaagggtttggcgggggcagtggctttatagtgctttaaagaaagtcattatttgttcaccagcccttcccctaatgttgctaggctaaaatggatggaaccaggttaagctgaatctgttttcttatctctccaggtcatttcttcagatagctccccagctgtggaaaatgagcatcctcaaggtaagtttactgaagaaaggaaactgggcatgaaaacaatagcctgaccctaacaatgtcttcaacaatgcttttgaatctctcccctggaaaaatcaaagcagggccagataatgtgccaaaccacaaaaatcagtgacagtagtttggcaagatcacccaggaataaatcttgggcagagtggggatgattaatatcttcaattatcaaaccacttgagagaaacatctgaggtacaggcaaaacttccataggcaactctgggctggctaccatgttttagaagtcctgggtattttctgcatagtccagaaacagtgctaccaggattttatcacccagcaagctcactaaagccactgaatgtacaccaaaaattatgcaaagggcttggtgcagtggcttacacctgtaatcccagcactttgggaggccgaggcaggtggatcacttgagctcaggagtttgagaccagcctgaccaacctggtgaaaccctgtctctactaaaaat

SEQ ID NO: 69380 - DNA, 3637 bp, Homo sapiens
agaatcgaggcatctacatgttccgaataaacaatgaacatgtgattgatgctacgttgaccggcggccctgccaggtgagagatgacgaggaaggagggatttagtggtccctgagagtggcactctgggggatagacgaacaaggaatcaaaattgtcccaagttagttgcctgacatccctgactctgtcccactgcccaggtacattaaccattcctgtgcccctaactgtgtggccgaagtcgtgacatttgacaaagaggacaaaatcatcatcatctccagccggcgaatccccaaaggagaggaggtgagaggaagtatcctgactgagtgacaaagcagctcctcctcctttcaccccttctctgccattccctaaatgtggattcctaggctgggcacctcagatcatatcttctctggcctcccctcttcctgtgggggactagcattgattctgccctcttctcttttcagctaacctatgactatcagtttgattttgaggacgatcagcacaagatcccctgccactgtggagcctggaattgtcggaaatggatgaactaagaagctttgaggctaccaggcaggggagtccccctacccacaacctcttccctgaaagggatgagggggaagagaggtagcagccagagccaggacccagggttggggctgccggctgacccggagcccctggagcaggaggctggggcagagggccctaggccaagcccaccctgggcaccagggacaatcctcttccccaccaccggccctcaggctggcatctctgcccccagctccaggaggggccagacagaagcagccattgggcatctcaggtttgagggggatatgggccgggaactacccagaagcatctgggaggcagcagggtgggggaagaggatgtgtggccgggcctcacagccctgctgctcccactgacctctccggcccaactcacggctgcaaagagacttgactaagcttgacaatcccaaaggccgggtcccacacctggccctgcctgccgggtcctgcccccaccctcacccccatccccctccctcttgatctgtctctgtttccctcttttcctctgtgtttctgtctctctatgggttgtgtttccttgttttccactctgacaaatgcaacatgaacgggaaagaggcgcccagctgcctaggagggcaagctgggcaagccgggcaaggagaccccgcacccacacctacctcatttaagtgttggattttttgctgttttgaaatgtgagaccctctccaagccccctactgccccaaccctctcccccacctcactgccctcttctgagtgggtggaaggggggtaggaggaggaagaaaaacaacaacaaaaaatccatctttgtttttaattatgggcatgggatggtggttgaggcaaatgatgatgaagattggggatgactggcccctagttgctctaggacttccttctccatctggacatgggggcaggagggagctaaacctaggaccaggatatctccctcctgttttcccaacctcatcatgagcctgtttgccctccagcccctggacgggttgggtggggggtagggtgagggctatccctgagtggcatgcccatacctagtgaggcagggtgtggcccggagctcccactttccctcagtcaccaaactgctgctggtctggtgggaaggggtggtgatgtgggggtgggggagcttagtgtcagcgcggggagggtggggggtatttatctatttatacatgggattgtacatagtcttgtggggcatgggggagccggctggaggtgagaaccctcccctctccccccaccccccggggagagcaaatgtaaaactactaatttttgtgctttatatattctatataaatatatctattttctttttacaaaaccagtttataaatggtaggggggtgtggggcggacacatggagctccccttgtgggggggccccctccattacccgacctaccgcccttttcctcaccccccaccccactccccaccccctggctgtgactgctgtaagatgggggtatagaggctgggcaattcccaccccctgttgtatagttggactatgttataacgcacaaaagagagctgaccccagggggagccagagggtgatgggttccttgcctccctttccttcccctttctgcccaagcttgtgctgcagttgaacctcttcctgggggtgggagtaggtaaggggtgggtgaggccccaaacccctctctggtagggaaccgtggggatgaagatgaagcttatatgcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcaccggatgtggggcggggcctgccccaagagagtttcctaaagcgaggaaaccaagccgggcgcctcttgcaatggagacggtgaggagtgcag

SEQ ID NO: 69381 - DNA, 1649 bp, Homo sapiens
tgagactaggaggccaagagaggatctggaagaccaacacaacttcatgatagggaggcttgaaggcctcagaaaactgcagttctggattggggttagggactggaggtcagtgagcagaagttgcctctgaggactgctctcttccctgcttcttagccgtgtggaatcgcatcattgagcctgtggctgccatgagaaaagaggctgacatgctgcgactcttccctgagtatctgaagggcgaggagctctttgggctgacggtgcatgccgtgcttcgcatagctgaatcagtaaggaaggggctgggagctggggggcttggcgggcactgagaactttggcctaaccccaaaaaaactcaggctaaggtgagtatgaactgtgcccacagctgcccggggtggagagctgtcaaaactatttattccgctatgggcgccacccccttatggagctgccactcatgatcaaccccactggctgtgcccgatcagagcctaaaatcctcacacactacaaacggtgagcttgtgatgctggagccaagggatgtgggtgtgggtgttgacagggatcctctggtcccattatgaggatttaggatacagatcagagttcccgtggagaaaatggggaatcactcttagacttcctaattagagggcatgcaggtattagtagggtatccttttcctcctctcccaacctgctcagatgcacttgggatataggacagaattatcttgggcaccctggggaggtaatgggtaaactggtgaaattttatgaaatatataagggacttggtcacctctttcttctcctgttttacttctgggggagggcctgtgattctcccaaacctcagataccccatgggtgctagggtcaccttcccttccccatgagtgttggtgtcaaaaataaatagttagagatataatagaaaaataataaaaccttacatttgtatagcactttatactttttttttcaaagcgttttcacatccattatctcatttgatcctcacaacaaccttatgaggtaggtagggcaggtggtatgacccccattttacagctgagaaaactgagacccagaaagattaaatgactaggcaaaggtcacacagctgggaccagacccttacttcttcactgcaggtccttgttctttctgtgtaccagggaccttagtccctgggtagagggaggcagaatctgtggtagcagggctttctcgaaggtctttggtggctcctaggctgttgtagaatgtcagagactctccatccctagccagccttgtccttgatgccctgcaatggtggttttcaaactgtgagtgcctgtgttccaaaaagtcctggatcacttaaactgatgggttgaacttttccttcccatgcatatctcttccttccccaaattggattaaaccagaagagctccattgtcatctagtttatgtattggagttccagtcaacattttgttaaagaaaaaagcaaagatttctgctaaataaaaaaagaaccagaaacgtttgaaaaccactgctctgggatggcaagaatttggctggtgccctaaggtggtaaaaggcatcctgccaggcagccgtcattcccctgcactgag

SEQ ID NO: 69382 - DNA, 1311 bp, Homo sapiens
acctgtgggtgcacctcaactgtgccctttggtccacggaggtgtatgagacccagggcggggcactgatgaatgtggaggttgccctgcaccgaggactgctaaccaagtgctccctgtgccagcgaactggtgccaccagcagctgcaatcgcatgcgttgccccaatgtctaccattttgcttgtgccatccgtgccaagtgcatgttcttcaaggacaagaccatgctgtgtccaatgcataagatcaaggggccctgtgagcaagagctgagctcttttgctgtcttccggcgggtctacattgagcgggacgaggtgaagcaaatcgctagcatcattcagcggggagaacggctgcacatgttccgtgtggggggccttgtgttccacgccatcggacagctgctgcctcaccagatggctgactttcatagtgccactgccctctatcccgtgggctacgaggccacgcgcatctattggagcctccgcaccaacaatcgtcgctgctgctatcgctgttctattggtgagaacaacgggcggccggagtttgtaatcaaagtcatcgagcagggcctggaggacctggtcttcactgacgcctctccccagggtgagcagtgggcccttgaaatggataatatggaatgggaaaagtttctcccagggtcactgttacaatgtctataagaggacctgtagcttctatgtgaatgatcctccttcccccacctcaggcaggcagggggtctcttgaaaactcccagtgaaagtgtttgagcctctcttgtcaccctaaattcccttgtagttgaaaatattttgctggtctaatctcacatattctagttctgttgctatccccagtggaacaaaaggaaacagttctgagactatcatctgcctcacccaacctaatcctaaccaagttccttggggttgtttttccctggacgaaatcagaattattttgattttagttttagtgttaatgataaaataacagtaagagcaggtacctttttttgagtgtgtactgtgagccacaaactaagctaagtgatttgtgtagtttattttgttcatacaaccctatgaggtaagtattatactacgattatgcccagtttgttcataaagaaactgagtctcagatttcagtacagtcgtgcattgctaaatgacagggatacattctgagaaatgcattgttaggtgattttgtcattgtgtgaacttcatagagtgtactacacaaacctagatggcatagcatactacacacctaggctctgcggtatac

SEQ ID NO: 69383 - DNA, 1044 bp, Homo sapiens
gagcacctgtgtgtgtaatgacacaggtactacatgacagcattgccccagtcatgtttggtgggactctgtcagctgttttgaaaatattaacgggcttttgtggtcaaagaaagttggaaaacacagttaaaatgacaatatgggtttctttactacaagagtcctcaggtccttttaatttgctaacgtgtatcatgagcctccaagtcatggatagagcatgcatcatttcctaaacgtagttgatgtagttcccttttcgtggagctcccgtcagtgcccacagcagtttgggaaaggctgctgtgagggaagtgtatgaaaagagctgggtgacataggatagaactaccctggggagtgggttctaggtgtccttgtccccacccagctggtagtagagctcacctcagacacttggctgatatgtttcttccatcccttccctggccctggcagaacctgaatggcgtgatggtggcagtggcggagctgctgagcatgaagatccccaactcctatgaggtgctgttcccagagagccccgcccgggcaggcactgagccaaagaagggggaagctgagggtcctggtgagtgtggcagggaagccctttgggacttgaggggagtgattctggtgggaggctctgatccactcctttctgcaggtgggaaggaaaagggtctggaaggcaagagcccagacactggccctgattggctgaagcagtttgatgcagtgttgcctggctataccctgaagagccaactagacatcttgagcctcctgaaacaggtaggtctgggggagaaaaaggggtgggtgttagaaaaaaggggctgccggccaggcgcggtggctcacatctgtaatcccagtgctttgggaggcaaggcgagtgaatcactttaggccaggagtttgagaccagcctggccaacatggcgaaaccccgtctctactaaaaacaaaaacaaaacagtagccaggcgtgatggtgcgtgcctgtaatcccagctactcgaaaggctgaggcat

SEQ ID NO: 69384 - DNA, 2127 bp, Homo sapiens
actaagaacattacctttgaagaatgctttccgagtcataaagtgtacttatattcttgtcacatttgatcctcttaacacctctgtgaggtagacggagtagggatcatcatctgtatcaaataaaagggtaaactgaggtgaaataacacaggttgactcaacaaatatttacggagcccctttttgtagcacggtgcaagtaaaaacaggcccacatgtcctgtgaatagagctgattcacccaggccgactggctcctaattcagtggtctttctgccttgccgtgccattgttctgcctggcgtggttgaagtcaggatgttgaagggaatcgcagatattcactggagcattggccccatagcccagctcacttggttctcccctctccagacctggacaaatttgctgcagaagatatcattgatcccattgcaaaggccaagatggtggctttgaaaggcatcaagaaagtgatggctcagggcagcattggggtggcacctggtatgaacaggtaagactcagggctggaatggggttggcccttttctttcccagtcacaccccttcttggctcccctccctacttgtcccacgtctctttgctttccaactttcttattgccaacacttatcttctgtgctttggtggactccagacagcaagtgtctctgctagcccagaggctctcggggggacctagcagtgatctgcagaaccatgtggcagctgggagtggccaggtaagtggtcaggtgggagtaggaacttgtgtcttatgccactgggccacccttcttagggcctagcagggaacaatgaccctttagcagcctctctcattgcaggagcggagtgctggtgatccctcccagcctcgtcccaacccgcccacttttgctcagggagtgatcagtgagtatggggcgtgggaggaaggtgcaggggagtggtttgggtcatatggaggaagagggattgggattacccttttgcaggtcctgacacccagcttcttttcccagatgaagctgaccagcggcagtatgaggagtggctgttccatacccagcagctcctacagatgcagctgaaggtgctagaggagcagattggtgtacaccgcaagtcccggaaggctctgtgtgccaagcagcgcactgccaaaaaagctggccgtgagttcccagaagctgatgctgagaagctcaagctggttacagagcagcagagcaagatccagaaacaactggatcaggtgggggaaagcaaacttcagcctagcacccagaaggcagggaagagggttggcatggggggagcatgccccagcctgacctctccgaccctcccatgttaggtccggaaacagcagaaggagcacactaatctcatggcagaatatcggaacaagcagcagcaacaacagcagcagcagcagcaacaacagcaacagcactcagctgtgctggctctcagcccttcccagagtccccggctgctcaccaagctccctggtcagctgctccctggccatgggctgcagccaccacaggggcctccgggtgggcaagccggaggtcttcgcctgacccctgggggtatggcactacctggacagcctggtggccccttccttaatacagctctggcccaacagcagcaacagcaacattctggtggggctggatccctggctggcccttcagggggcttcttccctggcaaccttgctcttcgaagcctcggacctgattcaaggcttttacaggaaaggcagctgcagctgcagcagcaacgtatgcagctggcccagaaactgcagcagcagcagcagcagcaacagcagcagcagcaccttctaggacaggtggcaatccagcagcaacagcagcagggtcctggagtacagacaaaccaagctctgggtcccaagccccagggccttatgcctcccagcagccaccaaggcctcctggtccagcagctgtcccctcaaccaccccaggggccccagggcatgctgggccctgcccaggtggctgtgttgcagcagcagcaccctggagctttgggcccccagggccctcacagacaggtgcttatgacccagtcccgg

SEQ ID NO: 69385 - DNA, 1341 bp, Homo sapiens
aattctatccttcctcactgccctaagcccatgttcttgctccttttcatctgatttcatcctactgactactgtatattcttccaggcaactggtaggaggctcccaagctttctatcagcgagcaccctatcctgggtccctgcccttacagcagcaacagcaacaactgtggcagcaacaacaggcaacagcagcaacctccatgcgatttgccatgtcagctcgctttccatcaactcctggacctgaacttggccgccaagccctaggttccccgttggcgggaatttccacccgtctgccaggccctggtgagccagtgcctggtccagctggtcctgcccagttcattgagctgcggcacaatgtacagaaaggactgggacctgggggcactccgtttcctggtcagggcccacctcagagaccccgtttttaccctgtaagtgaggacccccaccgactggctcctgaagggcttcggggcctggcggtatcaggtcttcccccacagaaaccctcagccccaccggcccctgaattgaacaacagtcttcatccaacaccccacaccaagggtcctaccctgccaactggtttggagctggtcaaccggcccccgtcgagcactgagcttggccgccccaatcctctggccctggaagctgggaagttgccctgtgaggatcccgagctggatgacgattttgatgcccacaaggccctagaggatgatgaagagcttgctcacctgggtctgggtgtggatgtggccaagggtgatgatgaacttggcaccttagaaaacctggagaccaatgacccccacttggatgacctgctcaatggagacgagtttgacctgctggcatatactgatcctgagctggacactggggacaagaaggatatcttcaatgagcacctgaggctggtagaatcggctaatgagaaggctgaacgggaggccctgctgcggggggtggagccaggacccttgggccctgaggagcgccctccccctgctgctgatgcctctgaaccccgcctggcatctgtgctccctgaggtgaagcccaaggtggaggagggtggacgccacccttctccttgccaattcaccattgctacccccaaggtagagcccgcacctgctgccaattcccttggcctggggctaaagccaggacagagcatgatgggcagccgggatacccggatgggcacagggccattttctagcagtgggcacacagctgagaaggcctcctttggggccacgggaggaccaccagctcacctgctgacccccagcccactgagtggcccaggaggatc

SEQ ID NO: 69386 - DNA, 2210 bp, Homo sapiens
ttgggccagctgtccaccatctcacctgtgctctatgccaacattaattttcctaatctcaagcaagactacccaggtacctgtgggatgagggcaagggagacagcctggcaacatggcaggtggaggagtcgcctgccaagtcttctctgactcactctctctgccctccagactggtcaagccgttgcaaacaaatcatgaagctctggagaaaggttccagcagctgacaaagccccctacctggtgaggcagaaaggagcatggattagcgtgggaactgagagggagggagggatctttgggtaatttacctcagttctttccgctccccactcctaaagcagctgggccagaagggatctgcttctgggtagggagtgtgaaaacactacagtatgggggcggggcatgagaccaagcactaggccctaaggctgtgtcccatatccctcagcaaaaggccaaagataaccgggcagctcaccgcatcaacaaggtgcagaaggtgagtggggctgggctggggtgtagcagtcctctagtgggtggcctctcttgagggtggagggccatggggcctgcctgcagcagcctgactgccctatgcctggtctccccctgtagcaggctgagagccagatcaacaagcagaccaaggtgggcgacatagcccgtaagactgaccgaccggccctacatctccgcattcccccgcagccaggggcactgggcagcccgccccccgctgctgcccccaccattttcattggcagccccactacccccgccggcttgtctacctctgcggacgggttcctgaagccgccggcgggctcggtgcctggccctgactcgcctggtgagctcttcctcaagctcccaccccaggtgcccgcccaagtgccttcgcaggacccctttggactggcccctgcctatcccctggagccccgcttccccacggcaccgcccacctatcccccctatcctagtcctacgggggcccctgcgcagcccccgatgctgggcgcctcatctcgtcctggggctggccagccaggggaattccacactaccccacctggcacccccagacaccagccctccacacctgacccattcctcaaaccccgctgcccctcgctggataacttggctgtgcctgagagccctggggtagggggaggcaaagcttccgagcccctgctctcgcccccaccttttggggagtcccggaaggccctagaggtgaagaaggaagagcttggggcatcctctcctagctatgggcccccaaacctgggctttgttgactcaccctcctcaggcacccacctgggtggcctggagttaaagacacctgatgtcttcaaagcccccctgacccctcgggcatctcaggtagagccccagagcccgggcttgggcctaaggccccaggagccaccccctgcccaggctttggcaccttctcctccaagtcacccagacatctttcgccctggctcctacactgacccatatgctcagcccccattgactcctcggccccaacctccgccccctgagagctgctgtgctctgccccctcgctcactgccctccgaccctttctcccgagtgcctgccagtcctcagtcccagtccagctcccagtctccactgacaccccggcctctgtctgctgaagctttttgcccatcacccgttacccctcgcttccagtcccctgacccttattctcgcccaccctcacgccctcagtcccgtgacccatttgccccattgcataagccaccccgaccccagccccctgaagttgcctttaaggctgggtctctagcccacacttcgctgggggctggggggttcccagcagccctgcccgcggggccagcaggtgagctccatgccaaggtcccaagtgggcagccccccaattttgtccggtcccctgggacgggtgcatttgtgggcaccccctctcccatgcgtttcactttccctcaggcagtaggggagccttccctaaagccccctgtccctcagcctggtctcccgccaccccatgggatcaacagccattttgggcccggccccaccttgggcaagcctcaaagcacaaactacacagtagccacagggaacttccacccatcgggcagccccctggggcccagcagcgggtccacaggggagagctat

SEQ ID NO: 69387 - DNA, 1059 bp, Homo sapiens
gctgtgcccctgagcattgtcagtgttggaggctggaaactgtcccatggccctctgtggttcagagtggccatgacccatcctggccttgacccatgggtttctcctggcatttacaggacctgaggatgggggcgtgaaggcatccccagtgcccagtgaccctgagaagccaggcaccccaggtgaagggatgcttagctctgacttagacaggatttccacagaaggtgaggctgtgacccgtacctctttgtgtataagggttttctatgggagaaggaggaggtcctatctttgggactgtgatctgtacagcttctctggtggggagtcctggactgttcctggccatgatcatttgtagacctgtggtgtcacctgaacttcccagtcttcctcaacagtgtccttcattcccccacagaactgcccaagatggaatccaaggacctgcagcagctcttcaaggatgttctgggctctgaacgagaacagcatctgggttgtggaacccctggcctagaaggcagccgtacgccactgcagaggccctttcttcaaggtaatacaggtgggagtggtctgaagactgacataaccaagcttgcctccaggatgggccagttgctcttttctctgatcctgtccgtcttgtaggtggactccctttgggcaatctgccctccagcagcccaatggactcctacccaggcctctgccagtccccgttcctggattctaggttggtgtctctgcgtaacctttgtgggcagtcctcgttgtcctttccctccatctgagttcatgctttgcctccctcggactcctgcagcacttcccctgctcctccccattcccttgttagtgaccctcctcttttggggcagggcagtggcctggggctctaggcagtttgtctggggtgggacttggcatccctgcgccctgtgactctctgcccctgcgccccagggagcgcgggggcttctttagcccggaacccggtgagcccgacagcccctggacgggctcaggtggcaccacgccctccacccc

SEQ ID NO: 69388 - DNA, 1096 bp, Homo sapiens
cccgtcagccctgatgtggagcctggcaaagaggagaccgaggaaagcaaaaaacgcaagcgtaaaccatatcggcctggtgaggtcctgggatggggttgtggggtggtggggtggtgcggggcagctcaataggtcccccagcggcttctcatccacaactctgcctcctcataggcattggtggtttcatggtgcgacagcggaaatcccacacacgcacgaaaaaggggcctgctgcacaggcggaggtgttgagtggggatgggcagcccgacgagggtgagacgggtgagggcaccagtggggcctgggagaaggtggggcaatgctagagagacccagggggtggactcattgaaagggccaagagggtggtagacccagctggtgttgtgggagagagtaggcacaaagtgtcaccctgcaagttgggagcagcatgctctcaacccgagtctgacacttccgttctgtccacagtgatacctgctgacctgcctgcagagggcgccgtggagcagagcttagctgaaggggatgagaagaagaagcaacagcggcgagggcgcaagaagagcaaactggaggacatgttccctgcttacttgcaggtgggtctcaggctccaagcagtgagggaggtgtctgtgccctgcagggcatgaagaaaactgtttctccttgactgccccacaggaagccttctttgggaaggagctgctggacctgagccgtaaggccctttttgcagttggggtgggccggccaagctttggactagggaccccaaaagccaagggagatggaggctcagaaaggaaggaactccccacatcgcagaaaggttagttatgtgggagtgagtggtgtgagagaatccaactttcttctggcttaggagctggcaagttatttgatgggaaatggactggcctccaggagtcaagggtggggtcaagggtcctggcctgtagggctgtgggactggagacctgttctgggcatcagatgtaggacatctctgattggaggggggactcttgctcataggagatgatggtccagatattgcagatgaagaatcccgtggcct

SEQ ID NO: 69389 - DNA, 2581 bp, Homo sapiens
ttgggctgcctccagcctcacccttagaagttccacctcctaggctgggcacggtggcgcacacctgtaatcccagcactttacttcgggagggtgaggcgggtggatcacctaaggtcaggagttggtgaccagcctgactaacatggtgaaactctgactctactaaatacaaaaaaattagccaggtgtggtggcaggtgcctgtaatctcagctacttgggaggctgagacaagagaatcacttgtacctgagaggcagaggttgcagtgagccgagatcgcgccattgcactccagcctggggaacaagagcaaaactccatctccaaaaaaaaataaaaagaagttctacctcttttccacctcacaccctgagaagttcccatcttctgccccagatcaccaaggtgatgctgctcaagggctggcgttgtgtggagtgtattgtgtgtgaggtgtgtggccaggcctccgacccctcacgcctgctgctctgtgatgactgtgatattagctaccacacatactgcctggaccccccactgctcaccgtccccaagggcggctggaagtgcaagtggtaaggagactgggatcttcagtggagccctggggccttgagatgttaaagtggatatgatgttgagtatgtgacagaggctgggtttaggaggccaggctggtggcttgggtttccggtgaggggacttctgggtacttcgggtaggttgggtgctaaagctctgttttcctgctcctatcaggtgtgtgtcctgtatgcagtgtggggctgcttcccctggcttccactgtgaatggcagaatagttacacacactgtgggccctgtgccagcctggtgacctgccctatctgtcatgctccttacgtagaagaggacctactaatccagtgccgccactgtgaacggtgagaacatccctttctcctcactttggccctgttgccagcctcgcattgcctgagcttatttcctccagtctctgttctccaggtggatgcatgcaggctgtgagagcctcttcacagaggacgatgtggagcaggcagccgatgaaggctttgactgtgtctcctgccagccctacgtggtaaagcctgtgggtgagtaccagctgctgggtagggggaggagtcagagcaggggtaccttgctttgggacaggacctcagccacctccgtttgtccttctctccatagcgcctgttgcacctccagagctggtgcccatgaaggtgaaagagccaggtgagtcacagaaattttgaatgccaaagccagaccagacgtcggacatcatctagtctagctccaaccccctagcttcatctccttattttaagaggaggaaactcagacccagagaagttaagtggcctgcccaaggtcacctagtaagttagtggcaaagttatgcctagaaccaaggtctccagcttcccgggcaatgttcctttcatcaggcaccatggtctcttcactgctaggatttcgtcttcagatctcttttttttttttttttttgagatggagtcttgctctgttgcccaggctggagtgcagtggcacaagcttggcacattgcaagctttgcctcccgggttcacgccattctcctgcctcagcctcctgagtagctgggactacaggtgcccgccaccacgcccggctaattttttgtattttttagtagagatggggtttcaccgtgttagccaggatggtctcgatctccggacctcgtgatctgccagcctcggcctcccaaagggctgggattacaagcatgagcaccgcgcccggctgagaacataactctttttcctaagtgaaaggggccagggacatctccatcgtgatatggcactgctgctggcatctaggacactgtgtgctggcattcagcaagtaggggccctcatagccccagacagcaagagaatctatttagtgaacctagggttaatcatgagcaaaggcaggcttctgagttacagttcctctctgaatctccctgggtcactgacagagaactcgggcctcagccagtgccccttggtggcctgttctcctcagcatttagaccctaagctggacttttgtcactgcctttgtctcagctaaggacataggttgaaacttgcagttctggtttccctggggcttccatccagggatcacatactctttcctcttatgcagagccccagtactttcgcttcgaaggtgtgtggctgacagaaactggcatggccttgctgcgtaacctgaccatgtcaccactgcacaagcggcgccaacggcgaggacggcttggcctcccaggcgaggcaggattggagggttctgagccctcagatgcccttggccctgatgacaagaaggatggggacctggacaccgatgagctgctcaagggtgaaggttagcttggggaatcttagggagcggcagagtagggggagcgtgactctgggagtgggatgttgggtgggggctacattgccactcagttacccttaagcactgctgtctcgtctaagtggctctgaggca

SEQ ID NO: 69390 - DNA, 1215 bp, Homo sapiens
gaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcct

SEQ ID NO: 69391 - DNA, 2443 bp, Homo sapiens
tctgtccttagttctgggagtcccaggcttcaggagactcctcaggactgcaggtagcttgtttgagggcacatgaggatttgagagtctagggctttcaaggaagagaatttaggaaaatgagtgttggggaagcatgggcatgccagatcatggggttgctgggggcctggcgtggtactgatgcttgtgtgtccacagtgggggtccggtgcggcgttgtgctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggaggtgagtgaggagaatggggcaggaaatgggataagggctgggtagtcctgagccagcaatcctctttttgttaattctttcctttctctttacctcttcccacctgtaaagggtcctgctgggctcaccattggtgtgctgcatggtcggcaggcgtatgggggcaggagggcccagaactatgtggtgtggacaaggccatcttctcagggatctcacaggtggggctgggccaggggattgcataggtgaagggcagggctggtgggcttctgagagtcaggttggaatgagaaggaccatgggtatactggggcagagctagtgcctgaactgtttgtctggggagagctggctgacactgaggctcttttttcaccctggcagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctgggtgagaagtcctgatctttggtcatagggcaaatgagagaccaaatgtgccttggatttttgtactctacagagcactgatcaaagtatagcattatttactgttggtctgccccactaaaataggtgtgaactttgtgagcaccagggttttgcctgtctcatttatcattttgtctccagtgcctagaacagtagctggcagacgttgggcaggcactcagtaactttgttgtttgttcattctgtgcccatggagtgcctgttttgtgtacagcaatgtgctgaggcttacaaggaatccatagctgacctgtggtgtctctaccccctgcagaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggtaggaatggaagggcaggaggaaagtcttaggcacaacacaggttagggttgaaaatgagggcagtcggagaaggcctgttaacatgaaaacaacaaaaaagaaaggaaatgagggcagagaggacactgtaatgttccatgtgcacctgcaggaaacctgggaatgactctaagatgttggtttgtgagacgtgtgacaaaggataccatactttctgcctaaaaccacccatggaggaactgcctgctcactcttggaagtgcaaggtgagtgtaccctgattctgccctattgtccctaactgtgtctgctacagcattctctgtcttgacaagttgtgtactttcgtttagtctttgctgtctgaccaatgcctgttttgcccactcccttcccttaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcaggtaagtggtggggactgactgagattgggctggcaggttggaagaactgacattggcaggggccttgttaaattgagtggactttgagaggagagccctaaggtgggcagtgccatccacagcattcgtgcctccccccagtgtgctctctaggatttgttagctggtgagagccacagtgcctgctcccctgtaccctctgcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactaggtgagtagggtttgagggtccctgaaattcatccccttttattctatggcaaga

SEQ ID NO: 69392 - DNA, 1898 bp, Homo sapiens
cccaaacgtggcaagagtccaccctctgcagcgccaggcgccgtacctcactttctccatttgcggactccagttcccaggatgctgagcagcggccaatctcctggctcttcttccatccccctcccgggaaagactgcccctggccaaagcaaggggcagttggaacttcagggaccaacgactgcaagggtatggaattagacagcggccagagtcctagtttcgcggcctgggcggtaaatgaggcggctccagggccgcggcggagaggaggggggcttcgttcccacgtgtctgccctgctgccggcccggcgcggtcggggttaacccggagcggaaggatcccgcagcgtgtgcgtagaactgcagagtcacagcctttcctccgagagggcgggatccctccgccgctccgctccaacacaaaatagggccgcctcttctcctttctccccctctcgagtggggtgccccgggcaaaaggcccccccggatctagcgccgaaggcttcacgaatcttcacgaccgctgcccagctcttgggccaggaaatagccccttcgcaggaaccaccctaccggccgaacaggaggcggagggggggaggcggagcggcgccgcgctgcactactttcctctccggttgcaaatggctgcctcgttccccactttccgctcagtttcctgaccccccggtgccgggagccggggttgggccatgcacctctaggccgcctgcgatcacagtcagccgggggtcgagggggtgccaccgaccagagccggccaggccgggggcggggcagctcccgaggccagaggggaagggaggcgagcgcagggcctggagcggccggaggggagcgggcagagggctcgcaccgcccgccccttccttttcctcgcctacctagcctcctcccttccccggggggagcagaaggtggggggctcgaagccgccgagggtgagcgctcggggtcgagaagcccggcgctgggtgtgtgtcaggttcagccccgcggccccgccggccccgcgtcgccgtagctcgcgcggccccgggcgccggccggggcggggagaggggctcggcgctcctgcgagggtctcacgttccatccgggccaggcgcggggcggcgcggcattccttccgggctgctggggaggcgcctcgacgttccatctggagagcctcgacgttccgcccgagcccggcgcgggcggccggggcgctggccgggccctaggactgagaggccgcccggcgacgcggatgcggagcctgctcgcccaagatcaaagccaccggtgctctctttgtgtccgctcgggattcgccgccctggggctgtccatggaaacctaaactgctggaacctgaggcagagaacccctctttggcttcttgctgtttttttgtggggggagggtggccactccgacctggatttaccgttcttggcccccctaagcccccccgtgcggggggcggctgtgatcgctctggcggttggaggtcggggagcggcccgggctctggccatgttctcggatgaggatttctggatcgccctgtgaagaggtgagtgaagtccgcccggccagggcccagaaagggttggactgggggcacagccagatggactatcttagccggagctggcctttaggttggagaagggggtgccagagctggggagcgttcctttggcagggtctgtcaagggaacctgagccagtcaccagggcagaactgaggcctggtgtcttggggtgtgcctctttaaagactgggggttcagggaaccacgggagtttgggaacctggccagatagcctctctgcctgtttatttttgtgttgggggagctcgactaaactaggacc

SEQ ID NO: 69393 - DNA, 1308 bp, Homo sapiens
gtgttgtccaggctggtcttgaactcctgagctcaagtgatccaccacctcggcctcccaaagtgctgcattacaggcatgagccactgtgcctggccaggaagtcttgattctgaagatttttcagagcacttactgacatttctatcctccatctttatgtcccaaatttgcttccagagaggtacaggcagttgaaggaaagaagctggcagagtcctggggtgcgacatttatggagtcatctgctcgagagaatcaggtgctgggcctgaagactagaagggtggtgatggtagctgtgttttccttattgtactgcttggtggtgggaatgttgcgggaatggggctttcaccccagagctgggtggtattggcactgaactgacttttgccctgaatcctctcctcttatagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggtgttggctgggtaaggggagccggggacttctgaaatagagctggctccctggggtgacaatgtatatatgcaaataaattgagaaatcttttgttgttgacttctttttcgtgtgtgtgtgtgagacggagtttcactctgttgcccaggctggagtggtgcagtgctgcaatcttggctcgctgcaacctccgcctcccaggttcaagcagttctcctgcctcagtcttctgcaggcacccgccaccatgcctagctaacttttttatttttagtagagatgaggtttcacctaggccaggatggtctcgaactcctgaccttaagtgatccacccacctcagcctcccaaagtgctgggattacaggcgtgagccactgcccccggccttattttattgttgacttctatgtatctagtgagagctcagagccaagatctctttttccaaggagtgatggctgtggtctt

SEQ ID NO: 69394 - DNA, 1030 bp, Homo sapiens
cgtgccccagggagggtcacctggatgttgtcccaccaacctttgccatcttagtggtttggatctaggtactgatgtttcccatttcttgccaggatgagtacagcattctgccctattcattcatcattggggtccatggttatgtgcttgtgtattctgtcacctctctgcataggtaagtgaccaaggttgtgagtgcgggacttgggagaacctgaggactgtctcataaagttatagctccaattcttgtgtttaaagcttccaagtcattgagagtctgtaccaaaagctacatgaaggccatgggaaaacccggtaagtggccctgggggatagggacatagtgtgggcatgagggggtgggagagagcagaggggagaattgtcaagttagagaggaggctcggatatagatcctgcctggtctgataaggagtcgtccagccttgatgtaaggagttggggaatgcggggaatgaggggattctgaagtaactgctgtttcctcacagggtgccagtggttctagtggggaacaaggcagatctctctccagagaggtatgtaaatctctgctactcagagcaaaaggaagtgaaatggactgggaatcagtcaggctctcatcctggctcttccactgactcaaacaagtcatttcacctctctttgtctctaacctgaagcttaaggaagataatacttctatcttaaaagccacaatttcatatttcaagcctcagtcctagattcacccattgttcctttgtttacctatattttctccttccacagccctcctcccaaaacttggggaaatggcatgggtcagagaaagtctttttcttctctattttttttttttttagacggagtcttgctctgttgcccaggctggagtgcagtggtgtgatctcggctcactgcaacctctgcctcccgggttcaagcgagtctcctgcctcagcttcccaagtagctgggactacaggcgcgtgccaccacgcccagctaattttttgta

SEQ ID NO: 69395 - DNA, 1022 bp, Homo sapiens
cgaggttgcagtgagcctagaccttgccactgcactccagcctgggcgatagagtgagactccatctcaaaaataaattaataattaattaaattaaataaccatgtgaagtttctaggtcagaaatactcatttttcagccgggtgcagtggctcatgcctgtaatcccagcgctttgggagactgaggtgggcggatcacgtgaggtcaagagttagagaccggcctggccaacatggtgaaaccccatctctactaaaagtacaaaaattagctgggcttggtggcagatgcctgtaatcccagctacttgggaggctgaggtaggagaatcacttgaacctgggaggcggaggttgcagtgagctgagatcgtgccattacactccagcctgggtaacaagaacgaaactccatctcaaaaaaaaaaaaagaaagaaagaaagaaagaaatgctcatttttcaaggacagctgattactttcactaaggagagaccctgtctcagcactggtctctttctacctcaaatatttctggaagcttgaactagtttgctagagctaacataacaaaataccacagactgcgtggcttaaataacagaaatttattttctcacagttctggaggctagaagtccaagatcaaggttctagctgatgtgccttctggagagggctctcttcctgtcttgtagacagccaccttctctctatgtcctcacatagcctttcctcaatgcatgtgctagagcgagtactcgagcactctggtgtctcttcttataagggcactaaccctgtaggatcagggccctacccttatgacctcatttaaccttaattacttccttagagtccccttctccaaatacagacacagtaggggttaaggcttcaatatatgaatttgagctggggggaggagacacaaacattcagccataacaaagttcaatcttccctctccttctctagtccaaaaagagctaagggtcttcttatgctttctgtgttgg

SEQ ID NO: 69396 - DNA, 2350 bp, Homo sapiens
ccctcaccttttttctaccttccattctcctgttggatgcgaaaccagagggcaaagagcttgtgggatgcagacctcggaggtcagcctcccagagcacacaatgacaaggaataggtctggggaaaggagatgcaaatgaagaacacctggtatgtggggtgaccttagactggggagtgggaagacagagcaacttagcagaataagaggaaaaccctctctcttacctcctgaatccaaacctttctggttcctgcaggctgcctgccatctccaatgttcccacactgccctgatgttaaccttcttcactggttgcctcctcccgtagggtgtcctgggccgggtctatgagacagtggtgatgttgatgctcctcactctgctggtgctaggtatggtgtgggtggcatcagccattgtggacaagaacaaggccaacagagagtcactctatggtgagcggcccagcttcctccaggctgcatggcttttcagttggcccatgtccccctgcctggaatgactgtaaccttctaaagtggaaaatgttggcaccttctcccttagactgaagtttcaaactgatagacatctggccaaatgcaatctgcagaaatgtttcattgggcccatgcaatggttttaaaaatatatattattcagttgctaacattttaaattgggaggtttcacattaatatccagatatctaactttgtttgacaaggagaagatctggctacattagtccctggtgatgggggccaaatagcagttgtaccctttagttaggggttaggatctccagtttactataggccctgccactccctattctgctaatgctggccagctttcttcatttgtattaattgcctaacccctgtggggactgtgcccttgtctagactctgaggcctgtcagcctggggacagtaagtaaggagagatgagctgacatgcctcttttttttatccttagacttttgggagtactatctcccctacctctactcatgcatctccttccttggggttctgctgctcctgggtgagtgtacagggtctgggagggaatgggcagggtccttggaccagagtaaccaggctagaaggaaagggaatggggggcatgttagggaaggggtggagagcagggtctggcaagtgactggctcttgtccctacagtgtgtactccactgggtctcgcccgcatgttctccgtcactgggaagctgctagtcaagccccgggtatgtggtattccttgctctttgatcctgcagggtgagcttcctgcagagctggaaccaaacaatgaaacaaccctatggttgtgtagtacacaacttgcagagagctacagcctttgttggttcctgtattctgtacccctatcatgcagagctggtcactagacatgcagggcagaatacagggcaattgggagggactgagcaaagctgcgggccacagggtggtgaatgagggtctgggggaagcctgggactacggagccctgggaagaacagggttctcctggggcctttgggtcagggagcctctgacagttagtctcttcctttcccctgcccctagctgctggaagacctggaggagcagctgtactgctcagcctttgaggaggcagccctgacccgcaggatctgtagtaagttgcagttcttccctgctggggtggtaggcttggcctgggcagaaactgcaggacttgagagcaacaccatcttctctgccctcagatcctacttcctgctggctgcctttagacatggagctgctacacagacaggtcctggctctgcagacacagagggtcctgctgggtatgtggcttcgtagggcttgggatacctgggtttccccaaggagagtagcccctggttccaggtgcttgctgacagcctcccatccctgcacagagaagaggcggaaggcttcagcctggcaacggaacctgggctaccccctggctatgctgtgcttgctggtgctgacggtaggtataccagccctagaggtgaggagtggaccctcagtacttgaggccttctcagggagaggggaggcaatgcagggacctggttatcatcagtaatagtggttgcttctcactgagtgcctacttttatgtcctgcctgtggtgagcacaaatgttgagcacatcaatccccattttgtagacgaagagacagagttgagtgacttgcccaaagacacagggccagtgaggagttgtgcaggtttgccctggcattaaaataataaacattgaaattcagtcgattcccctatggactcagttatagatctcatcagt

SEQ ID NO: 69397 - DNA, 1013 bp, Homo sapiens
tcaccacaggtactttgatttccctccctcctgctagagtccctgttgccatggaccagcctcaggggaatgggcctatggtacccactgggaaaggagcagtggctgtgtggggctgttctggagcctttgcctcttcagcctccctttctgcaagataggggcaagggcggctagatggatgtgtctgctgggcaagtcatataacatttctgatcctcagtttcatcctacaaaatgggcgtaacaatgtctacctactccattgtgtggaccaaaggagatggttaatgtgaaagccctttgtgaacctgaagtgagcaactgctggatgaatgtcattacgggcacaggctctgtgtcatctcctctcctagtgcttccacagccaggaccagagacctccctgatgactggggaacctggtgatggtggcctttctctttatggggagcctgagtatgctcagatcgcagctttccttccctagacattgtgtaattgggggtgggggcacacttgccccagttcctagctccagcctttcctcctcttaggatggctcaggatgagtcccccctcaacaaggcagctacccaagagtaattcccctggggactttctgtgtgaatctccccttccccctcctctcttttccctttcctggacccagccactgatgtaaccaacctcacagactagttgtttattatattaatagtttgagcatataaagaggaacttgtgatgggagagatctagggaggagtaaagaagtataggaatgtctggcctgtattctcttcacctgggaccactgatttttaagctgccaccttggctggagaacaggctatggagttcataatgtgtggtctcctggagcctcctgttcagctctgccttctttgagggggcagggatggggcagggagcacattgtaatactaacggcctcagagctgccccctgatgtcctcctgcctgttccccgtgcctctgtctcttacagt

SEQ ID NO: 69398 - DNA, 1135 bp, Homo sapiens
agcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatcaaaagctttgtttcctgcgtttttttctaaaagtgccttggtttttagattcatctatacttggagtatagagagtctggtgtcaaggatcccacttactgtgcaggcacctctagggaaaagggagctcaacagactagaaaggcaggagccctagattctcagactagtttaccacctcaacgcttgcatagggggtggggaaagtcattctgctaatctaaagctcatttagctcttcagagtaagactgggtagttactaatgagtaatgtataggaagtgtaagttttgaatatccactgagatgctgctgtttaaagtggcctgctaacttgttagtgtaattaagaaatttccaagtgatctttggctggtcatggtggctcacacctctgatcccaggcattcaagaccagcctgggagacatgatgaaactccatct

SEQ ID NO: 69399 - DNA, 1102 bp, Homo sapiens
tctggaagggatggggggctcgggctgccctccgccgtatccggagctctcttttgtcgcgtaactgtgtcctgggtgcggtccctcgagtccccgcagtcctttccagcgcatgcccttactccgccttgggtggacgcgcgcgcggactcttccagccctcacttcctcttgagcgcgaaaagcgggggtgggaagcagctggagacaaaagcgcgcacgcgcgaccgttaccttcccgccgctcctgggcgggaaaccgccactgcgctttgcgcatgcgctctgggtcgcgacgcgactagggctacagggcgtgtctcctgttaacctgagtgttctttttttgatgaaagcaataagaggactgcggaagagctccctgtcaatgtaccgctctacaccagtgtattacgacagttcgtacacaacagtctgtagaggccacctgtctctccctgctgcgttaggaattcaggggagcaggtggtggcagtaagggattttgagggaacggaaatcggatcttgacccagatctgggccgccgataatctcctactgcgctcagactgctgtggaggtgttaggctgagcccgatgccggcaggcaagggaggatgggcggcttgggcagcgcctttgcagacgtggccatttcgtgcctctgcagcaccgccggggggcgcaagagcgcgcgcccggaattgctcattcatcctgtgccgcagagccccgccccttgtccctgcggacagacatttcttctgcgctggtctggccacgtgcttcctgtgctaggagctgcccggaaatgtgaccacctagtctaaagtgggcttctggggcctgagcgctggatggatgcccaccttcctgtcttggtcctccaaaggaggaagctgtgactgagctgtcttggtctggaaggaggccttcccggtttaggatgggaaggtaacattcattaaaagcaacgtagactatagtgtagctgttctcaaaagtagtacatcttagaaaaggatctttagaaaagatcgctttagaaaaggaaattcgttttcagattacgtgagtagcctaggtaacacagccagacc

SEQ ID NO: 69400 - DNA, 1205 bp, Homo sapiens
acctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatgaattcagtcctgtgttttctatctgggtgtctgaagtttttcatgtatttagtgcattgagaataaaaaataagtgttgcctgtggtttatacatatcctaggaagtgacgtttgtatttaaagtatcttagtaatttaaaacttttatttatgaaacacaaaatgtatatctaaagattaccattacagagcatcatgtactttttttttttttttttttttttgtgagatggagtcttgttctgttgcccaggctggagtgcagtggtacgatctgggctcactgcaacctcaacctcctgggttcaagagcttctcctgcctcagcctcccaagtagctaggattacaggcatccaccaccacacctgactaatttttgtatttttagtggagactgggtttcac

SEQ ID NO: 69401 - DNA, 1062 bp, Homo sapiens
acctttgtgacgttttaactttagtattcctctccttcttcctcaccctctccttcaacagaatccacaccaacctcctcataatccttctcaagggcagccatgtcctcacgggcctctgaaaactcaccttcctccatcccctccccaacgtaccagtgaacaaaggcacgtttggcatacatcaggtcaaacttgtggtccaggcgagcccaggcctcagcaatggctgtggtgttgctcagcatgcacacagctctctgtaccttggccaggtctccaccaggcaccacagtgggaggctggtagttgatgccaaccttgaagccagtggggcaccaatccacaaactggatggtacgcttggtcttgatggtggcaatggcagcattgacatctttgggaaccacgtcaccacggtacaacaggcagcaagccatgtatttaccatggcgagggtcacatttcaccatctggttggctggctcaaagcaagcattggtgatctctgctacagaaagctgttcatggtaggctttctcagcagagatgacaggggcatatgtggccagagggaagtggatgcggggatagggcaccaggttggtctggaattctgtcaggtcaacattcagggctccatcaaatctcagggaagcagtgatggaggacacaatttgacctattaacctattcaggttagtataggttggacgctcaatatcgaggtttctacgacagatgtcatagatggcctcattgtctaccatgaaggcacaatcagagtgctccagggtggtgtgggtggtgaggatggagttgtagggctcaactacagctgtggaaacctggggcgccgggtaaatagagaactccagcttggacttcttgccataatcaactgagagacgttccatgagcagcgaggtgaacccagaaccagttcccccaccaaagctgtggaaaaccaagaagccctggagacccgtgcactggtcggcctataacaaaagagaggaacagaggaaaggttaagtttttattctttgtagtacaatcata

SEQ ID NO: 69402 - DNA, 1049 bp, Homo sapiens
gggcgcggtcgccctcttacctggagcttcccctcgctggggttttgcccacctgacgcccccgcacccaccggggacggggcagacgtccggcctgctccctcctcccagtggacacctctgtccctgtcccggcccattctccagccccagagcccttcctgcccttcctccccttcctccccttcctccccttcctccccttcctccccttcctccccttcctccccttcctcctcttcctgctcctggctccttccgacgagtttggtttgaacttttgaatccgccaatcagcgccgcgcgcccccactccgcgggtgcggccgggcgcaggccagggctcgaaggtggggccgcagcggcacggggcggggtctggggcccgccctcccgacacgtggccggggaccgggtatataaggcccttcggggccggccaccctttcactacttctcccccggactccttggtagtctgttagtgggagatccttgttgccgtcccttcgcctccttcaccgccgcagaccccttcaagttctagtcatggtgagtggggttccctcggggctggggaagagtgcgcgtcccaggggacggcgggcccggaaactactgcctgcacctcgggccgcgcccaggacagctccagactaccccgggcccctccggttaacctggcttgtggcggccgggctggaaggtcgagttcacttggcagacaccagttcgggccggaaaacctggcccgggtgcggccatcagtggaaatggaaagccctcttgatcctagtgagggctttccccgcagggcccgctactgccctagggaggaaggtcagggagcctgctcattggcctccaagaacttaaactaaaaatccctccccacgttttctcaagcgacctctccttcctactgccttacaaactgggccccggaggccctcgtgcgctcccgcaccgacggtgcagcacttcctggctccccctctccagcgcccagtgactcgctgctgagtcacctgtggccctgccctggggag

SEQ ID NO: 69403 - DNA, 1045 bp, Homo sapiens
tacaggtgtgagccagaaacaactaatttcttaacctatcagtaaagtcttggtaacatttctagcctttattattatggtcttccctcttccggagatgttttgacggtgaaggaaaaacgttcttcctatagattagattcttccacttggttaaaaagctgcctctgaccacagtttttaaaatacagctaactgctgcttatccagcattttcttcatgagtcatggctatagtttgctggtttaagctggttttaaaggagggagagagaagcttttgtctcctaaagaataggattaaagcgggaccagaatgagctcagtagttacacaatcattcagagaatgaatcagagctggaaaggggaattttgccttagtttaaggaatcatatctactgtggctacaaagcaactgtctggtcttgccgagtagttcatgaacacatctttggttttccaaggcacttttgctgaattaggtcttcaaagatttttgcttttgaaattatagtccctgagcaggagtggcctgctgaaagatggttatctttttttgtttgagatggaatatcttgtcactcaggctggagggcagtggtgtgatctcagctcactgcaacctccacctcctgagttcaagtgattctcctccctcagcctcccaagtagctgggactacaggtgtgcgccatcatgcctggctaattttttttgtatttttagtagagatgcagttttgccatgttggccaagcagatctcaaactcctgacctcaggtgatccacctgcctcagcctcccaaagtactgggattacaggtgtgagtcactgcgcccagccagttatctgtcttgaaggttaatcagtcattaggtgtgaatcattcctaaatgtcccatctgatgtattataccctgacattttcctttcttcctcccacagcgtgagtgcatctccatccacgttggccaggctggtgtccagattggcaatgcctgctgggagctctactgcctggaacacggcatccagcccgat

SEQ ID NO: 69404 - DNA, 1490 bp, Homo sapiens
ttctcagatgtttacgtagtcttcccagcaaaactggactgatgtttccgatgcttaaaaactaagctttaggctgggcacggtggctgacatctgtaatcccagcactgggaggccaaggtgggcggatcatgaggtcaggagatcgagaccatcctggctaacatggtgaaaccctctctactaaaaatacaaaaaaattagccgggcgtggtggtgggcgcctgtagtcctagctactagggaggctgaggcaggagaatggcgtgaacacgggaggcggagcttgcagtgagccgagatcgtgccactgcactccagcctgggcgacagagtgagactccatctcaaaaaaacaaacaaacaaaaaaaaccctaagctttagttataagcactgacttggaaaatcagggacctgcctttaggacaaataaacctagtagctatttagggttctggaacgtgaggtttattgcctaccaaaacaattgcatttgtccttgtcattactgtgctcacaggaggcttaactggtgtaattggtaggcgagagtctgccctgtgcattgatctcatgtagttgatggacccacaggctataagggagctgagtagagaatgttcacaaatctgaggcccatcacttggagaagcaagagtttacaacagaatactttatttggaaggtcaaaatcattccttcgtaaagtagcagtttgctaaccaaaatagcccagttaggtggaggaaatccccaacaacctgaggtctcatggaattgtggttgtgtcactttacccaaaataaatgggcttcttggtacctagtgtcatatattggcttactgggccaatactgtgcttactgtgccaagcactatgctgagtacttacttaattctcaacctaaggtgattactattctcacttaatcagtggaagaactgagaaatgaatgtggtcatacagtaaggaactggtacagccggatcctgacacagcctgactccagtaccagggtgttagaactttggctattctgttgttccacctcagaaagcagctgccaaatctttacaagacatccactgtaccaggctggtggtcctgggcctgccccttaggacctctccaactaagaaactgccctgttctgtggccacagcaagagaaccagaggctgccttcccagttaccaaaacttgagccctgtatgcaagcccaggccttgtgattcctctgcctaaggcaatagttcatcttaaaatagtcttagcaaaggtttttctgctcaaggacttgattgtgaaaagttgttctgaatcacttagcacttaaaagcttttttttttttttggagacagggtctgctctgtcatccaggctggagtgcagtggcctgatcatcagtcttgaacccctgggctcaaatgcaaatggtcctcccaccttggacccccaaagtgttgattacaggcgtgagccactgc

SEQ ID NO: 69405 - DNA, 1195 bp, Homo sapiens
ccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttccattttaaatgtcgagctgacttaaatacttgatccagttaaagttggatgtatgaggctggtagatgaaaccacctgagtcgagggtcttgctctgtcacccaggctggagtgcagtggcatgataatacatagctcattgcagcctcgagctcctggactcatgtgattctcctgcttcagcctcctaagtagctggggactgcaggtgcacaccaccatgcccagctatttttatttcttgtagagatggggccttgctatgctgcccagggtggtcttcaactggcttcaagtgatcctcctgcctcaacctctcaaagttttgattataggcatgagccactgcccagcttcttggtttatctgtttaatttgggcctgaattaagtggttatagaatcattttgtaagtgaggaaacgggttcagattgagccagtgcttctctaactaaaatggatgtgaatcacctgtagatattaaaatgcaggtttggggtcaacctggtg

SEQ ID NO: 69406 - DNA, 1027 bp, Homo sapiens
attgtcatcaggacttcagtgagccaggcctcaggattgctcctggagaccccagtccagcctggtaagtgtttctggcgtggggagagaacaggggcagttgggctgcctgaagcagggaacaagaccagagaaaactcagcaggctgggagggagcatgaggaagtgggaggccgggaggctaggtcagaaggagaaggagaagagaccttctagataggccagcgattggcacagttgcacttttgtctaaggagatggtctccatttcggccctctctctgccacttcctgcaagatttatcttccactcactgtttatccccagcccctaagtgccatcaccacatccccagcctactcagacgttcagattaataagtgtttactgagatagtgttgggtgttgaggggctgctggatgggttcctgtccctaatagtgcaatggggcctattaaactaatataccctcttcagaagttgcagaacactgtgccaaactttggtgggtgttctagagtctacaacaaatgtcctgtttcttcctagctttctctcttcctaaaggagaacgcgaggttgtcactcactcagatgaaggaggtgtggcctctcttggtctggcccagcgagtaccattaagagaaaaccgagaaatgtcacataccagggtgagatgcgactctcctgggatggtgggtgggaggtgcaggagttgcttggaagaattttgctgcagcagccaacactgagaattgtaggtagagccaggaagtcctgggcctcaggatgttactgggtaggtttaccccagatgcacccagtccctctccaatgtgagactgacctctctttatcagatgtctggggcctagggtgagaggtcatatttgtatcaccatcagatcagtgctaagggtgagacagatctgacacttgtcagccaaaagcattcatcccttggctccacaaatatttactgagtagcaccagcctactgagtgccaggctctgttctaggctc

SEQ ID NO: 69407 - DNA, 1510 bp, Homo sapiens
tctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaagtgagtctgtgtggccaacagctttgatgtctattgaacagtgactgggctgaggaagagggaaaagagatgggggatcaggaataggacagtgtgggtagactactgaacgcacatcttgatgtcacactggggtgctctctcccaccacagcgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgaggga

SEQ ID NO: 69408 - DNA, 1041 bp, Homo sapiens
cccagacccggagtcaatatcccagaggagaaatgaggggtctgacagctctctgtgcagccgatccccacatttcattaactggaggctggagctggcaagcggtggaggcagaggggggcacaaagggaggtggaggagtcaaaggctaggagcagcacctggccaggggtggagggctgccgaagtaagtcagcaacagctctgacctggcagacaccttggaagcagtctttacccactctctgagaagccaggagcttgtcttcagccctgtggaccctggtgcgatactttgaacttaaggttgcactgagttttggtgccagaggcactggctgatgagtgggagccctgggcctggccgtgatggcagaggcaggagggtagtctctgcaaggaggcaaaccatgagcaggttcttgggctgggacggttttcccagctgcagtcggagaacagccggcttcaggcttcccttttgtcccttaagcaaattttccttgactcgcttcgttttcctttgccttcctttttctctgccctctcttcctccatctggacggttgttctctgaaactaactttggccatcctttagccaacagttgagcacctgttgggcatcatgcttaacagtgtcagggtgggggttgggggatacacggagccaagacccaacccttttggcctcacatacaaaaggctcccggaagccattcaaatctcactgcccactcctggcctgcctctctcactcttccactgccttgggtgccatttgtctcctctagggaactgagaaggaagccaggaggtcataactctaattccaggactatcccttacagggtgataatggacaagccatttcccctttctgggccccagtttttttatctttaaaatggggacaatagatctaactctaaagggtgctgtgaggatgcaacgagaagttgcatgttaaagccctaaaatacaataaggactcaataatgttgtttccctttccatgccgtcccctgtcctctcacgtgga

SEQ ID NO: 69409 - DNA, 1735 bp, Homo sapiens
gagtcacctttcaatttgtgggggtgggaggaggtaatcaaggacgtattcttgcatttacaggagtttatccttttttttagcactacagataggagcgtcccttgctcctgccaggcagcccctccataggggcagtcctgtgctgctgtgcctcggtacccgcacaaggtgtctggggaccgcccggacccccccttccatcggcggcagcgccacctggcggccatggtgcggtggtgtgggaggagctgggcccgggctgggcactgagcccaccggagctgcaggcgtctgcagagccttgcaccgagtttccccgcgagggcgggcgggaggagtcccaggcgggaatgtgatccccagggggccggggagggccctggggaggagcctggcctggggaagccggacttccgtgacacaacagacacaaaagacaaagtccatttggatggaagtgggagcagggcgagacgggccattttcactctgtggtcaaaggaaatgactggtctgactcggtctgggagcggggcacccaggtatggccacttgatttggaagtagcgggtgctggctggtggtcgctccagatagaggggacactggcaggcacgcttggcgtccagtttgatattgtgaggatttgtccagctgctgtggagtggctttccaagccggcctccgaaagaggtggttgaattgtggggtgccaaggtctaggtcaaacgaagttttccagaatattttaataaagggaattcaggacccctttcaagtttgacctgtgggaaaatctcatggcctggagagttaggaaggcaggagagtggctaaagcctgggccaggtgtgggagggcagccacagttggagttaagtcaggggtaaggcagaggctttcaaaatgtgtgggaactttggaaaagcatccaatgcagccctgcccctccacacatccccccatgagtcatttggggtcatgggtctcaggggaagtctgaaatttaaacagctttctcctctaaatctggagtcactgtggttgtaaagaatgggactgaggtgctaggacaagggatatgagataaatagcactggggactcaggcagatctgtactcaacttttattggaaagagaaatggttgctgtgttggagcctggacatcatcttatgactctactttttcccatctcttagggtctaaggataactctggggccatgacagccatgagtctcacagaggaccccgagacttctgtgctgcgagtaaccggacttgttctgagacctttgccctagaggatggccaaggggctcctggtgacctatgccctctgggctgtggggggccctgctgggctccaccacctgtacctgggaagggacagccacgccctgctctggatgctgaccctggggggaggtgggctgggctggctctgggagttctggaagctcccaagctttgtagctcaggccaacagagcccagggacagaggcagagccccagaggggtgacaccccctctgagtcccattcgctttgctgcccaggtgatagttggcatctattttggccttgtggcactgattagcctttcttccatggtcaacttctatattgtggccctcccactggcagttggcttaggggtcttgctggtggctgctgttggcaaccagacctcagactttaagaacactctggggtcagcatttctcact

SEQ ID NO: 69410 - DNA, 1008 bp, Homo sapiens
cttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgcactccagcctgggcaacaagagtgaaactccgtctcaaaaaaaaaaaaaagaaagaaaaactgcttgcaggggacatgagaaaacaatggggtgagaaaaggttgtggtagaaggatgtgtttatattctgaatttctgaattcttggctattgcattcttgacaatttttcttaaaaccagagagtgaaaggcatattataaaacaatcaaatatcttttagagtatggacaactattatatatcaataaaaaattaattagaaaaaatatatcttttagagaacacaccaccttatcccacccatgatatattgatgtgtgatggagaaagattatttaactatttttttaaatgtgtaaagcagcagggcatagtggcttacgcctgtaatcccaacactttgggaagctgaggtgggaggatcaccttaggtcaggagttcaagaccagcctggccaaccaacatggtgaaaccccatctctactaaaaatacaaaacttagccagccatggtggcacatgcctgtagccccagctagtcgggaggctgaggcaggaaaatcacttgagcctgggaggtggaggttgcagtcaactgagattgagccactgcactgtactccagcctgggcggcagagctagattctgt

SEQ ID NO: 69411 - DNA, 1034 bp, Homo sapiens
tcagactttacataggtgattggactggctgacttctcaggtcttcccagtatttgaggtctgattctgggctacataccctactcctagaagcatacaatctgatgggagataatgacacaggtacacagatatcaaagcccttgttcagtgttttgaactaaatgtcataagagctgtaaatagtgtattggcacattggaggagggacagataacattgttttatggggactcagaaagattcattattttatatgtcatatgtccctttggggactttgggaaaccctagggaaccagcggctagagcatctcaagggggccttattcaattctaggtaactagccaggtgtgaaagaaagggcccagggtgtctcactttgcagaggaagattggagaccaggaacatgattttaaattatgtgcctttactgcagctttcttgctctctttgtgtgtgtgcattctttccatttttttcttctttctggatgttaaatctgagtaatatatatcatttttaaagtggaattatgaccaggcatggtgcctcttgcctataatcctagcactttggcaagccaaggcaggaagattgcttgagcccaggagttcaacaccagcctgggcaacatggcaaaactccatctctacaaaaagtacaaaaatgagccaggtgttgtggggtgcgcctgtagtcccagctaaggaggctgagattgggaggatcacttgaacccaaaaggtggaggctgcagtgagctgagatcgtaccactacactccagcctgagtgacacagtgacagcctgtctcaaaaatataaaaataaataaataaataaagtggaattatgttgatgactattctctctattctctctctctctctttttttttttttggagatagagtcttgctctgtcacccaggctggatcttggctcactgcaacctctgcctcctgggttcaagcaattctcctgccttagcctctcgagtagctgggattacaggcacctgccaccacgc

SEQ ID NO: 69412 - DNA, 1075 bp, Homo sapiens
ccaaatcaagaaattagaaacgtgtatacataaaatcagtttatctttggcagaaatcagtatattatcaatgtttaattaattcctaagaattaatggcaatagtgcctctagttttagctgagatttagatcatctttcttcattctgccctgttatgcgacatttgctataaatgccacaatgagaattttttgaaacctgggtcagagaagcctactttttatatttaatagtatgtgattgatgtattatcattgttttatgcttattgcatcttggttttatggggtgttcaaaagaagatagatgagaataggtgatccaaagtaatttagaattttatcctccagttgggactgaaccatcttgaactgatgaatatattctaccaggtttataggtagatatgccgtttcattatatcgtgatttggagtgagacagtagcttttaagcagaacaaacagccatatgtaagtctaaatttggttattttctttgaataagcaatggaaactgtatgcattcaggaactggtgattcagatatcttctgaaggccctctctccctgtgctccacagctttgtcctgaactctcctgtctcttgcgatgcctctgtgcctatacctattttgtgaactctgcctgcaatgccgtccaagtcagttggtgactcctcaaacctcactgaagtctttcgggtggattcaaatgctgcttttagccattaaaatctgttacatctgttacatactttcacaatagcacttatcctagtgtagttttaaaaatgcacttaaaaatttttaaagcagtgcatgcatgcagtaaacaaaattggacagtacagaaataaatggtgaagacagtctcccagttttcttccccatggatagcactttctcttttttatccttccaaagatattttgtgctgatacaagaatttttataccgtatgaagtgcttattcatcttatcttttacttcagggtaatttatgagtaatgaaaaaattcaagcattacaaaaatgtagagtgtgtgaagcaaaaggtcccctttactttgat

SEQ ID NO: 69413 - DNA, 1043 bp, Homo sapiens
tcgcaaggctggagtccttttggcgcccctggcggaggcggttagcagaggtgtctcccccgccggtggtggggctaaacgctactggcttcacggccacacctccgctgcctccgtctggttcagcgtctgctaactgaggaggcagattaggggcgcggagtctcttcccttgggtgcataggtcccggttggtagaggctttgagtcctcatcgccacagctgacggctgcgagggactaagagcaggatatatctttagaaatgagttgcacaattgagaaggcacttgctgatgctaaaactcttgttgaaagattaagagatcacgacgatgcagcagaaactctgattgagcaaaccacagctctcaataagcgagtagaagccacgaagcagtatcagaaagaaattcaagagcttaatgaagtcgcaagaacatcggccacggtccacgttagttatgggaatccagcaagaaaacagacaaatcagagaattgcaacaagaaagaaaagaattgcgtacatccctggaagaacatcagtcggccttggaacttacgatgagcaagtatcgagaacaaatggttagattgctaatggctagcaaaaaagatgatccgggaaaaataatgaagttaacaaaagcagcactccaaggatacaggcacatgttgaccagataaatgaaatatggcagcagtaatgaagaaagccattgaaattgacaagcaacaggattgcaaggaacaagaactaatatttcaacttgaacaagaaaacaaaggcgttagagagatcctataaataactcgagaatcacttttgaacctaaggaaagaagatgtgtcggaaagtacttctttgtcagcattagtgaccaacagtgacttgagtctgaggaagagctgaagagcttctgagtctgtgagcttcttacatggctcccagtggtcaaataagtgaatgaatgaatgaacagaaaattcaatccattatttttttctctttaaatatgtacagtgtactggctatgagat

SEQ ID NO: 69414 - DNA, 1034 bp, Homo sapiens
cacattttcagattctttagtgttaaattttaccatggggagctatttacttgtgacatttttagaaggccttaaggtgggataattaacaacgatatcaaggattacaggacagtctaatatggttgatgtatttagtgtttacctcaagctgtgacagtttttattaaaattaaatttctgtattataagtttaattcaaaaggcagttatatgttatctatgtaacagaatttgccaaatagcaactaagttgctgttaattgttttatgggacgaaagcagccagtcttggcccttctgtcttagggatggattatatttggatcatgttgaatatatttttcccttattctttcagattcatcaggattcatttttgatttgcagtccaataccgtactggcccagggaggagcttttgagaacatgaaagagaaggtaagactagtcactatggatagtaaacttaaatgtcataggaaaatttaggtactaatacgactagtggctaccacaaactcattatgagactgaaattttaagaataaaacaatgccactatatatcagagagtgacggccataaataggttctgattgcgcagaacctattaacagaacctattaaatgcaaacattttctttgcctatctccatgtatattcattctaaattcttttgaagatattcagtattaattagttgattaatatttatgtggctgagtgtatctcacttggcaacattccttaaggaacaatcgaataggatcttcccaagtacttgaagagcattcttaagtccaggagccttcagagccaagacaagaaataggtctttttttttttttttttgagacggagtctcgcactgtcacccaggctggagtgcagtggccgatctgggctcactgcaagctctgccttccgggttcgcgccattctcctgcctcagcctctccaagtagctgggactacaggcgcccaccaccatgcccggctaattttttgtatttttagtagagacagggtt

SEQ ID NO: 69415 - DNA, 2334 bp, Homo sapiens
gcccatctctgcctcccaaagtgctgggattacaggagtgagccaccgtgcccagctggtgttaacagatgtttaaattctagctcctttgtgggaggtattttataagggattttttgaaactagaaaagacttaaggaccatattaaaatgacaggaagacaagcagctagggtgatgttttgagacttagaacttgttcattatacttatttttagtaactgtctagatctgaaatatgacaggaagtgttcatgaaaagaacaaaccatacatgctttcttgctgcctgtagactgttccctcaggttatacctaactgtgtctctgttcacaaatttagtctagtcacttttgccacaacatataagagatagaggagagtgtaggtcccctcagtcctcctggtctctggaattgcagaggagtagttaatcaaaatgaaataatgcctccaaaaagttaaatcatcagaaccaaaacttactttggggctagataattcatcttagtctacccatgccttgtcctgaactctaagttttacttttcaggttttatggctaggaatttaatgtcatgtcttctgtttttctttgtttgtttgagacagggtctggctctgtcacccaggctggagtgcggtggcacggtcatggctcactgcaacctccacctcctgggctcaagccatcctcccaccctcagcctccctagtcccctagctgggactacaagcatgtgccaccacacctggctaattttttaattttttgtagagatgaggtttcaccatattgcccaggctggtctccaattcctgggcccaagcaatcctctcatctaggcctcccaaagtgctgggattacagccataagccactgcgcctggctgtcttctgtttttcttgacacatatttttgctcctgccagattactcattgtctcaaaacttaacattcacatttcctcttccatctactagttaatgccactttcccagcctgaaaatgttctcctattcctctgtatttatctaaatcccaccatttctccaaactttccttaaattaaggtctaacttctggaaattattttaggtaactgatttttcccctttctgaacctctaggaggaagcaccatgccctttgcactgcattcttgtcatataagatattgttggcttgtttagaaaataaagagctggctgggcacagtggctcatgcctgaatcccagcactttgggaggccaaggcgggcagatcacaaggtcaagagttcaagaccagcttggccaacatggtgaaaccccatctctactaaacattcaaaaattagccgggcgtggtggcgtgcacctgtaatcccagctactagggaggctgaagcaggagaattgcttgaacccaggaggtggaggttgcagtgagctgagatcgcgccattgcactccagcctgggcgatagggcgagactccatctcaaaaaacaaagaaaaaagagctgggcgcggtggctcatgcctgtaatcccagcgctttgggaggccgaggcgggtggatcacgaggtcaggagatggagaccatcctggctaacaaggtgaaaccccgtctctactaaaaatacaaaaagttagccgggcgtggtggcgggcgcctgtagtcccagctactcaggaggctgaggcaggagaatggcgtgatcccgggaggaggagcttgcagtgagccaagatcgcgccactgcactccatcctgggcgacagagcaagactccatctcaaaaaaaaaaaagaaaaaagaaagagctaagtgtagtaggtcatcacaactttgctttgataagcctctggtctccatgattgttcagcttactgattacttagtcacaggatctgattccattcggaacaagcttgaaccagcaggaaacgcagttccgggagagagatttgtgaattcctgctgactggaacccagccaggaggagcctccttcaataaatgacaaatgaaatggtttcctacctgggaactgtgtatttaggattgattagctgacgtaacaaccaggtcaatttaacttgaggaaagagattacctgccctttcctgctagtataaagccctttgctctggttgattgagtttataaaccaccttatttcaatgttccttgtagccgctacttcaagacataattggcaagtgagctaactccatttggcaccaaaccagagcttggagttaatgtcacttagaaagacatttctgtgttggttatagcataaaaaaaaggcaaagagttctaacagatttgccccagtaaaa

SEQ ID NO: 69416 - DNA, 1642 bp, Homo sapiens
tcttttttccaaaatgagaatatgttcaccacctcctcaatagcaatacctccaaagtctcatctagttagttaatattcagctgaaaggccaggtcttcagagtgatttcagatcttccaaggatggggtctcataaattaaaagaaaggctaaatgcccccttctcccatattacatagttggagaaagaaaaggataattatagtaaaaattcccacttggaaaagcaatgatcaaatcttgctggatgggaaggaatagcagagtcccttccctggtagtagagaacattcgttgggtggtttatctgcttcctgggaggatttctttggttttgtttccactgtagcccctgtctctctgggagatttttattgtatgttctctgccatgaccatatccaagttatatatcagaaagcatgccagagaaggtggttcttaaaagggtgtaacaatctaaatacccatcactagggaactcggtaaataattgtggtatatccacatactgggtggctgttaaacagaatgaaggtgatccagatgtattaatagggaataaatttaaagatatattaagtaaaaatagctaaggtaaaagaaagaccatgtgtatgatatacttccatttgtgagaagggaaaaaagagagctacatatgtatgcatgttgtatgtacatacacaatatttggatgtgtacgtaagaaatggtgaacagtcgtttcccctggagaggagaccacaaaatcagaaataagagagatgctcttttcattttatacccaacttactctagatgaatattttttattatgtgtacatatttcctttttaatttatatgcatcttgataaaatttttttgactggaaggagaaataacaatgatttatgagtgtttgtgatttataaaaaatatttaccacttaactgccttcagagacccaatggaaggtagagaccagacttttgatattttcattttctgggtggataggcagctaagcctttggctgaccaaatacctactgcaaggcttatatttctagttcttctttatcctatttagcagcaacataaggttcacactcacttttcctctacagtggaaattttgctcagccgacaaaagaaggctgaacttctaaagaagatgactcatgtggctgttcaaatgtcagagcagcaattggttgagctcagagctgatatcaaggtaaaacttctttctgctttctgcctttcttcttatcctcaggggctaaagtaagaaattttcataattcatggccatatctaatatattaaactcatgatcttcctttcccaaacctggccctcttccaagtccctttctctgtaagtggtattatcatctacccagttgtcccagctggaaaccttaggaaatttctccatttcccaccttaaatctgtcagcacactccatccatttgactaaatctcagatctgaccttatctcttcatctccaccaccaccattatgatcaggttaccaccatctcttgcctggacttctgtaagagcctcttaactggttctgttcatccattctgtctctgccccacccgccccaccctccatgtatgttccccacactacagcagtctgcttc

SEQ ID NO: 69417 - DNA, 1031 bp, Homo sapiens
tagctgggattacaggcgcctgccaccacgcctggctaatttttttttttttttgattcggagtttcgctcttgttgcccaggctggagtgcaatagcgcaatctcagctcaccgcaacctccgcctccccggttcaagcgcttctcctgcctcagcctcccaagtagctaggattataggcatgcgccaccatgcccagctaatttttttatttttagtagagatggggtttctccatgttggtcaggctggtctcaaactctcaacctcaggtgatctgcctgcctcagcctcccaaagtgctaggattacgggcatgagccaccacgcccagcggctaatttttatccttttagtagagatggggtttcatgatgttggccaggctggtcttgaactcctgacctcaggtgatctacccgcctcggcctctcaaagtgctgggattacaggtgtgagccaccgcgcccggcccagttaccacccttgacctcctcatccttcctgacttccccatcatatctcctcattctgtggtttcagagcgtagttatgactttatgtgcattggttactttgtcttccccactagatagtgaacttcacagtggcaggcaggagctcctgtctctccaagtgcctagcacagcaccttggcatgtacttggtcttctgtaaatagttggttgaccaattctgattttatagagaaaaattatctttgagatgtttgttataatctatttataacaattacttgggttcaacatttatacctttttaatttttttttttttttgagtctcgctctgtcatccaggctggagtgcagtggcgctgtcgccactcactgcaacctttacctcctgggttcaagcgattctcgtgcctcagcctcccaaatagctggaattacaggcatgtgtcaccacgccctgctaatttttgtatttttagtagagacagggtttcaccatgttggccaggctggtctcgaacccctgaccccaagtgatgcactcatcttggc

SEQ ID NO: 69418 - DNA, 1024 bp, Homo sapiens
ggtcattggcattctaaataattgcttataaactgcaagctgtaacaaagggagttggccttctccacacctgtgccctttacctcttctctttctgaacacataagatttattgtcacactgagagaacacttgctgcagaggctgtacaacagtctctctaaaataaaaacagaggtggaagatcatccaggaccttacagggatccttactatcgtctgacccagtgttagacctgtggagtggtgttgttctctcactgcctcccctttaattctattggggtgaactagccaaaccatgcaaatgttcagttactgttttctgtttaactaaaactatatgattaaattttatagaaaggcctcctcacattgatgccagtcagtctcattcaactctcggggagaagccggaaacccctttgcaattagatgagaatgctggctctcacaggcttcatctgttcctcttcccacgtggctgaaaagctgctagaaatatttctgcaggctgactaaggatctgtttctctccactttttcagtgtactgaagtgggtgctgtgcaatttaaatgtcttatttccagatcattttatttccgtcattcctattatgtctttgactcaacaaaccctagaatttgtttcagaattaatctcagactgatattacatgtctgaaggctttgtaacaagaggttcgtgtgctttcctaagccacaacatactctgaaactttaggaattcaaggccggaaggtcatttttctctctcctttccctttcagtgcttctggttgcttcccgagaattctgatgcagagtggtattagcccacccccagttaagaggagtgctctgaggggttcagttcttccaaattatatctaggcctttcacttctcttttttatctccttttcatctgaaaaaaaaaaaaatgattccagtctaccttagacattgtttaatgaaatagacccccagaagcactttattcctgacatgtttctagtcccat

SEQ ID NO: 69419 - DNA, 1047 bp, Homo sapiens
taggagccctgtgaaacagccagggtgggggctccttatgctccatttcacaaaggaggaaccagagctgagagagagggagagaggaagaagaagaaagaagaaagaagaagaaggaggagaaggagaagaaggagaagagagaaaggaggaaggagaaaggaggaaggaagaagaaggaagaagttaagaagaagaagaggtggaggaggaggaggaggggagggagagggagaagaggaggagggggaggaggagggagagagagacttgctcaaggtaacagagttgataaatgacacagccagggttagaaccctgacagtctcccagccctaggtcgttgggtctacctctctctagcctaactgtgtgggcactcagaggactggtcatctgggcttgtgtagcatgtctgggtggccttacacttatccctgtaaggcctaagtgtttagactttcaggcttccagctcacctgctggggctggttttgggcattaagccaaaccagacaccttgggttagggtgatcagggtgagatggaatgtgtggggtgcccctgaggattacagcagcttacacttattgagcattaactttgtgccaggcactgtgcaaagtgctttacttggatcgtcccattaatcttcataataacgctatgagctagttattagctataactgccaattcacggatgaaaaacttggggcagcgaggtcaagtccctagtctgaggtgcactgcctcctccagcagctccaggcacaatgcccatgtcaccctttgctgccctggttcccacttccaggagaagaaaatacactaatatttatggaatgttattaccattcttattgcagagtgaaaagtcaaaggcctgtttgggcctttaaaccccttcccccattgcccctcaaagaactcatgtgaatgcgtactgggagggggtaccgccactgaccctttcctttatgtggcctgttttagatgagcgtgatcaggcacaggatctcagcccactatcctctctcttcacctt

SEQ ID NO: 69420 - DNA, 1043 bp, Homo sapiens
agagaaacagccagggtggagtcaggagtagttatggagtcctggtcaaagctcagagaagccccagtgactgcaaggtggcagcgtaagtaggtggacacgatctcgcaggtgtccctggggccgagcgagtggagggccagcctttgaaaggagccagtctatgggggacagaggggagctgcccttccttcaggaggaaaatcagaagctagggatggaagtgctggggagagtgtcaggcagggctaaaaaggggaggaacaaaagctgtctttgtggtcccccaggaacagtgagatgtgactttcctgaggcagatcacagagcaggcccagagcccagatgggtgacagagctcagtctccaaacagtcagggagactcattctgatgaaatggtatctacagtgtatatacttcccttcctgggaaaagaaggaggtgaaaaaggaaatcagttccctagacgcagatgaagaaattgcaggtgtggaatggacacaatagtagtgctgataacagggggctcacagcgtgactagccctgtcccagctccttactgctttgtctcactctaacctcacaaaacccattattcctattttgcatagcaggagaccaaggtcagagaggttaatgaacagctaggaatcggccagccggggctggagccccatccacctggcgccaagtctcatgcttcttccacagggctcccaggtgctctggggggaattgggactggcagggaggaagccatcgttaggagggttggacctgcactctaggatttggagagttgggagcacattctaactctcagggaaacatggggctgtgtctgtgaaaagccactaaaggaccgggcgcggtagctcaagcctataattccagcactttggcaggccgaggcaggcagatcacttgaggtcaggagttcaagaccagcctggccaacgtggtgaaatcctgtatctactaaaaatacaaaaattagccgggtgtggtggtggacacctgtaatccaggctacttgggag

SEQ ID NO: 69421 - DNA, 1142 bp, Homo sapiens
agggccccacggtctccccagccccagctgatgagccctccagccccctgctgtcccctggctgcacctcctcatcctcagctgccaagctgctatccccacgtcgaacagcaccccggcctcgtctaggtggcagagggaggccaggcagggcaggggctttgaaggctgaggctggcccctctgctcccccacgggccctagaggggctacggctgccccccatgccatggaatgtgcccccagatctgagccccaggtgagcagaccctaggcccccgtggcagagatggtggtgatgaggctgaggccctgggcaggcgcaccctgccctaggtgcccatctaaccatcttaactcccgctagtctatgtgggccaagcctgcctcctccaggaagccttctgtgctcctcctttctcctgctgtcccactccactgtgtggtgtgtggcacacgctgctctgaactcttgcatctcatgctgctcaagcttggccccccagctaaactgtaagctcctaggggaagggaccccatgttagctttctcctgggctcctggtcagttccacgctcctgcagcctgtgtgtgtggacgctggggcatcccgtcccgtatgaccccacagtggctgcctgtccattgatttgttgtcctggtacctgggttcacagggtagtagatggcattgaagacggctgtggctcggaccagcccaagttctctttccgcgtgggccagtctggcccggaatgtagcagcagcccctcccctggaccaggtaccagggccccgggatggtctaggttggtggggcagcccctttgccttgtgaacctcaagcactgttgacctctgagccttcaatgttagagaaactggcagactgcctggaggccgtctcaccccactaccccttggtgtcgtgcgggcaggggagtttggtggtgaagaccagcactttaatttcgacgcagccaggaactgggtttatatccttgctctgtcagctttctagcagtgtgaatttggcttctctggccccagcttcctgtctgtaaaaaaatgggttgatgtttacgttatataatgtaactgaaagccttagcccaatctctggctaactgaagggatagagg

SEQ ID NO: 69422 - DNA, 1095 bp, Homo sapiens
cacctggcaacgctgagttctagggctggtactcagacccctgtgccttcttcctgggtccactggactgtgccagagccatggcagccaataagcaccatctccaggctgtgggggtcccagggcaaggccaggccccctgaccctggtgggggctctccagtgctggtagcctcagcctggctcacaggctctgcgggcccagtcctagccccttcctcagaaggaggaggggaggcaggggtgctgggctcagagcagaggtctcctgaggcagggggctctgagtctgaggtggaggtccagaaagctgtggctcgaggccagggggagctctgagacgctgggggaccccagggccagggtgccatgaggggaggaggccccggacgagggtggggccaagtcccactcaagacagagccagctgggggctgcaggcagtaggaggatgccccagtgtccacacacagaggctgcagaagcccggaggtgctggctgggcacggcccctctcccgatgcccgagggcacggaccctccctgtggggcgccaggacaagctgcacagcctggcgaagtgactgcagtccttcccgcatctgcagcacctgctctgacagctctgtcacctttgggggagggaggaggcgaggtcagaatggagtcagccatggagtgccttcccctggtgcccccctcacctccaccttccccctcacccaccgcctgccgaagcttgtccagtgtgtctgtgttccttgcctcgctgggcccatggggaacagtgagcaggccgctctctgtgggtagtaggatggggttatcagctggggctggtaagaggagataggcaatttgggggtctaggccttgccccagttagagcacattgacctggtaggacctgactcctaggatcatctcttctggccttgcccaaggtgctgaattttgcccaaacttccaggggcagggaaaacaccacccagcagccctcagccacactgcctagtgctctccttcccctcaaaaagttgttctttgtgcctgtcccttgctctgtcctccaggcaaatggacattcctaggagc

SEQ ID NO: 69423 - DNA, 1534 bp, Homo sapiens
gccccgctcggtctcgccctaagtctcgcctttccctttaaccaacccctcaagccgggttacctctccggtgcctataatccttaacgtttccctatatgctgtcccaactaggaaagcctttactttccgctattggtaaaatatttacactttccgtaccatggccacgcccccttcacacacgttgccaagacgaaccggaagagattgccagccccctggttcgttaaccggaagtagacgtacctcacggaagccggctttggccctgcggctgctaccgtcgccgcggagaaattgttggatctggcagtctaggaatggtgagacctcgcggttcgcctctgagggttctcagaggagttggggatgaaatggagttttgcagagtgccgccggggacgaccaccccccaagtttggggccccgccccagtggcgccccgaaaagctgcgcatgcgtgggccggaccgggttagaatctggctcgaagtgttacgcatgcgcaaaggcatggagaccgtggggtgagaatgggcttgcgagtttacccccacctccccagccaccagcctgtgggtctcaaaccaaggctacttggtgctctgctttgagttgcagaggtgacttcatcaatgctcctaccccgagttcttgagacagacctggaccgatcccctaccttgggtgtgcactcttgggagaacgaggggcggagggtccggtaaggaaggggcacagaccctacctcagtttgccggcaagctcgggccccttcgccctctcctcagatgtcaagattcttagtcgtagcctatggagcggagagcgacaggctcacctggggacagggctagaacactgagctaagagccaccctggttagaagtggggactcacgagaggagcgccccgagaaagtccagtacctgggttctctaggggttgttggggcacagcgtggttgataatcacgcagttcccaaacagtggtttttggtttccacgagatggtatctcatggaaataccacttactaaatcttcagtaaaaaccccaaatggaaaagaaaaacaaaaaaaaaacgagatggactggttggagttttgtctccctttcttttttcctgctttggcctgggaggggaaggctggtgctgctgagctgagtggacagctgaagtaaagaaaaatgtgggccaaagaatcccttgtctcttgctagtttatagtcaaggcgcttaacctaggagataccagtagaattaaagggtctatgaaccctctaaaatagtatgtgtttgcacccttttctgcagtccatagctgttatcatactctgaaaggtgccagtgaccttcacaagactgatgtctaaggctattattggcagagtggggccttatgcctctttcctgtccttatgtcttccctagcttatgggaccctgggggacctgagccagtataaggaagtgaggctggccagttggaaatctgagcctcagggagcctcatttctcctttgcagaa

SEQ ID NO: 69424 - DNA, 4221 bp, Homo sapiens
ggagggatggaagaactctaaggagaggaggaggttgaaacctaactccacaatgatggagaccaaaagtaacattcgcttcttcagagggagagtgatgagatggcaggatcagaaagaagcaacaggggccgggcgcggtggctcatgcctgtaatcccagcactttgggaggccgaggcgggcgaatcacctgaggtcaggagttggagaccagcctgaccaacatggagaaaccctgtctttactaaaaatacaaaattaggcgtggtggcccatgcctgtaatcccagctactctggaggctgaggcagaagaatcacttgaacccgggaggcagaggttgtggtgagctgagatcgcgccattgcactccagtctgggcaacaagagcgaagctctgtctcaaaaaaaaaaaaaaaaagcaacaggaagatactttctagtaaggcagatctttggggagcaagaggaagagtagggctggtccaggaaagttggaaactaggatggtctttgaaacggaagggcaggtgctgtttggggcagctgaagaagggccgcaggtagatcacagggtaaccagctggtctctcagccttttttttgatgatggctaccactttctgagagatgtgcctcccagccttcatcttcaggaagtgggaatgagtcagaccaagcagaccttgggaacacctggctcgctgaggatttctggattgtgtaaggattggggttaaaaaagaaaaaaggaaatgtatctgaatgtaagcagtatcatctgtggcgccatcatccttgctgggaggcagctttgtgaactggttgaaagcacaggctttggagtcagactgcttggattccaaacctgcctctcccatttaatgtcttggaaccttggtcaggttacttaatctctgaacctcagtttctttatctgtaaaatgggaataataacctctgagatggttgccaggattaaatgagtgtttgacacagtatctggctcataataagtgctcagtaaatattagctattagctgttatcattccctctttctgttttttttcctactgcctctccattcttgtccttttctccttttattcttctgagtgctaagttctgagatgccccttagatgtgaagtcccagaagtattgattgcatctttggtggtgggaaaggggtggcccctcactggcccaggtgaacatatgatgatcagatgatcaagtgtctcttcatcatctctcagcccacaaatgtgtttttgttccagggaagacacaggatctgcttctctttcagcaaccatttctatatccttccctgtcactagttaatgtcttcatattctcacccagaaataaaataagacccaaagttttatggcactgcagcaggtaggagagggacggggtgtttcaggaaagcagggacacaacacgggaagctcagcgaaggaagggctttggaagttctgtagtagtttatgtttattccattgttctgtcctctgtggggaactgtccagaataggccagtgtctgaatcctggccagaggtcttcatcccaagttgaagatgactgtatacagttagctttattaggttttctcatgccaacatttcaatccaatttcctttttccaagccacaaagacttctgccaagctacctctctctgtcacagcctgtatgtcagagaatttatacagatgtacatatgcacacgtgtatacactgttttcaaagtgcattttaggatattccagtatgcaaaaatctaataaggttagagatgagactgcattttatcacagcactttgtgtgcagggccctgactaaacacttgggggaggtataaaaggagaaaactcaatccctgaatgtagggaaatccccacatgagtgggagacaagcagtcccacatgaaacacccagcaaacattcacagagtagcatgtcactctgcaaagtagtgcatcatttatcctgaagggacacaggtaggagtgtgtgtatgtgtgtgggatagtcataagggtaacctgaaggaggtgaatattggatcatcttgaacaaagcatgagactgtagaataaaagaaatgtgtttcacttgagggtaatctaacaattctgtgcaaagagaggaggagggaagccattgagtcaggatgagcaaagaagagtgtggggcggccttcgttgcaaggctttgactgttagatgaaagattttgtagggtaggcaatcgggaaccggtaagttctcaataaaacgttgaatcattggtgatttaaccacttaggttgcaggggatatactagattgcaaacagacctgtttcatgtggtaggagctttgcttttaagggaggagggctagagggcagattggatccagtcccagttctgtccctaaccagtggtggctccttggacagattattccctgaaaaagggggataccttgggtgactgccagagtctcctccagttctgacattctatgttccctgaataactactagacctaacttaccagtggccccctactgttttgtaggacttgccaagaccatttagtcattcagttaacacatacttattagcacctagtttgtacccatagatggtggtaaggaaaacacaatgggaactggatatgaggtgagcaaaaacagatgaagtccctgcccttcagtgttttcagtctagtaggggccacggatattatatttcattaattctgagactcatatttgaacatttgtcaagtcaggatgcatcttcaaattgacaggatattataatttaattggcagcatttgttttttattcatgccaaatagaaaaataatataatcaggattatacaaataactataaaattctaatggataattgccgaaggagaaggtacatggtgttgtacaagtatataaaagcgggctctgactagttcagggagttgggaaaagctttcgtgaagaaatgattggtagatgtgaagtgtagtaggcaaggtgtgtggggttggcagggccaacccagttttctcaggcaaaggtggatgcctgaggtgggagagctgagagaaggtgagtagggctggaactgagacccaggagctcagcatgggggagattggcaaggtagctgggtagcagaccccctcatagtactgggtagggggtttactatttaccctaagagcagtgggaagccattgaagagttttaagcagggggctaacagtctgaggtgcactttgaagagcttgttatagctgctgattggagtggatgtggggaaaacagttgggaggccactgcaattagatgaaaaaagatggtggcttgggcaagatgggtggtggaaaaggaaatggagagaaatggatagattcaagaaatcttgaggaggtaaagttaacaagacttggtgatttattggcaaggaagagggagttgtggagagtgactcataggtttccatttggacaattgaatggtgtggtgccagtctctgagacgcttctgaggctcccctggagcctggtaggacccaaagatgttagagaggctcctgaggcagcttgagatgggaaagtgtgacacagaaaattgtatttcctccactattgattagtttctgacttcccatgctgaggaaagcgtcaggggcaagagcaagtctgaatacagaactaaagcagttgagcacttagaaaagatgagtcacattggagaggtttagctcatacccttttcttcttaggacaagatgaaggacagtttgttgttgttgttgttgttttgtctttttgagagtgtctcactctgtcacccaggctggagtgcagtggtgcagtctcagctcaatgcaacctccgcctcccaggttcaagcagttctcgtgcctcagcctccccagtagctgagactacaggcgtgtgccaccacacctggctaatttttgtatttttagtagaggtttcaccatgttggccaagctggtctcgaactccttacctcaggtgatctgcccgcttggcctcccaaagtgctgggattacaggcgtgaaccaccgcaccaggccaggaacagttttttttttttttttttggagacgaaatctcgctctgtcgcccaggctggagttggagtgcagtggcgcctcggctcactgcaaactccgcctcct

SEQ ID NO: 69425 - DNA, 1232 bp, Homo sapiens
accttgctttctttcccacttgttaatacatcttagagatcatatcgagacaataagcttcttcattcttgtttataactgtatagcactgcattttatgtgtatatataatttcatagctccttactggtggctatttaggctgattccaatcttctgtttttacaaataatactgaaatgaaaaccttaaacatacagcattttggccatgtagggctatacctataaaattaatttttagaagtagaaggttctatatagagatttgttctgtttgttcttcgttcgttcaatatttgctgaatacctattatgtgccagatgctggtaggtaccaggaatacagcttccaacaagtcagatatgatccctgtcttcatggaatgttattacactcttgttggggaaaacatatccaggcaaacataataattacaaaattatgtacatgaggaaactaaaaaggggatcagatagagaaataggaaggagctactttaaatacagtcaggaagttgtcttaaaataagtgatacttaagctgagaactaaaggatgggatgcagacagccattaggggtaggacagggcaacctaagctgttcaaagcctacatccacagggagatagttcaggatttgtagaggaggggatggacaccaaaaaggggatggagataaagccaaagagatgaagttggcgattggaagtggaagatgtcaaagaaagtaggtggctaaggatgaggtcagttaggggaggaagctggtcatgaagagatgagaattagggagacaagcattttaaaggactagcgactatttgtgttgagagagctttggactgaatctctgtaactgggataattaggggaactagaaaagaggcgactccctccctagatactttgggaataaaagagacctctaacttatttgagagaggcacagccttgcccacaggcaggataatggattagaagccttaggtagagccagtctgtgcctgtagtgaagcctccttcatcttttctgttgctttgacaaaatggaaactttcaaaataaagatgacattcaaggggctcagccagctggctctgagctggcacaagagagagcaaaagcacaagagagagcaaacctaccaagggctaagggcttggggtgggcaggaaatcgggcttgaagaccctcctgaattttgtgctcctttttcatcctcaccactt

SEQ ID NO: 69426 - DNA, 1048 bp, Homo sapiens
tgctgaccttggaagagggatggttttacttgagcattgggttggggagagctgttgtgaagccctcagtacataacattgacaattccccctttgtctttttgaccttaggacacactggggctagaggtaggagaagtggaagggaaaagaccccattaatgtgagggcagggtgggactatctatctctttcactactccttacctatgctctttaaatatgccacagaattcgggctggaatggcattggtggtcatgagttggagagaaagggatgggaggcaggggactggggtacttgggtacctggatacctgccttctgccccttcatctgagaggcctctttgggggagaattgctgaagaggtggagccttccagtctcagtctggtgctgttaaacctcccttattcctttcctttcccgttacaattaagaagctgtgtgcttgcctgttagaccccagttgtcagtctttctcagtggtgaggagggaggcagtttcatgccttgtgcttctcaaactaaagccttggaattgcctcagagcagggtggagggttggggagggaggtggtggatatttcctgacaggtcctctctacctctgacaaggcgatgtcttccctgctcagtatctcttcctttactcatttccagatgccccctccagggatccccccaccctttcctccgatggggctaccccccatgagtcagagaccaccagctatcccccccatgccacctggcatcctgcccccaatgcttccaccaatgggggcgccaccaccactcacacaggtaattgtctctcctcccctggggcctcagaaaaccctgtcagtttagctgggggtggagataagagcgggcatgtaggcctcagaaactggggaaggaagggagctttgggccaaacccatgtggatttgtctgctgaatgactgagacaactctcaggcaaggtgagaggccagaatctggggattgcctgaggaagtgcccaagtgagggtcatggctccagtgagatgtctcag

SEQ ID NO: 69427 - DNA, 3515 bp, Homo sapiens
gtggacacatgaatatagttcttcacatcctctttgtccccagaagagtcagtagcacctggggatcttgctgtgccttcttatgctatcgctcagtgtagcagagtctgggtaggatatagaatttggcatccactgtgaaggaatgagcctcgggagttgtctcaacaaaatactctcacttgaggagaacgaagaatggagctgctatgcgattctcccttgggatcccagagctatggccctgaagggtgggggaagcctgttagggagcagagatctctaggagcaggacacatggattctggcctggcctgcttctccatcccccatggcctgggtcctgggggccactgggcttggccccaacccttccccctcctctttcttcggcagacggctccgggtgcggacaccgccagctgtgagtcttctgggggcctgctccccccaggctcggaggttggggggcataggggagaggggaccgtggactggagcccaccctggatcatgcctgttgggatgccaaggagtctgggatattgatgggaccaggggactatttactggggctggaatacgggaggcataggtgggaataagatggaggtcggagcaaggacttagtatgtatcctttggcttttttctagctgctgtggctgggacaggccctccggtgagttcttccagctcaggggtctctgggtagaaagcctgagagtgggggactgatagttaaatctttggggtgaggagaggctttggaaaaggggccttgaccaccattctgtgcccccccccccacccagagggccctatggagtgagcatgtggccccagatgggcgcatctactactacaatgctgacgacaagcagtccgtgtgggagaagcccagcgtgctcaagtccaaggcagaggtcctgagctgggctttctggcccttcctttcagctgccctgacccttccaagtccttggccttcccttagtctctaaccatattcatgatggttcctctgatcccaaggtccctgaccattcctcaccctccctggaaatgcctccataggatctcaagaagtccaccttccccagtttgaaccaggccaggtggtagctaaaggttcctgtgtcctctactcactaggtccccttagctcccctgactggctggagaacttgcccatcccactgatggctcctatcccatccacttgcagctgctcctgtcccaatgtccctggaaagagtacaagtcggacacaggcaaaccttattactataacaaccagagtaaagagtcccgctggacccggcccaaggatctggatgacctagagggtgagatgtcctacgggtgggccaggtcaggagctctgggggctccctattgcccctgtgactgactgtgttatcttttcccatcacagttctagtcaaacaagaggctgcagggtgagtgacttgcccacctatccatttatagttggggcacctggagtgtggaagtagactctgtcgccatgatctctacactgtgggaggaagagccagctctgtctccttgtggagtcatcccctctggccccagtccttcccaggatagagaaaccagccagcccctgaagtcctccattcttgctctcctcctggacaccgcccttctggctcatctgcaggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcaggtgagggctgccccccatggcattcccaatgttggcctcagactcccagcctggttcaacccttgtcctctgctgggcctctctctcaggaggggtttgaagatctgggtgtgacctctgaagggcagaaaaaggctgccctggggaacaaggagggggtgatatgttgccaggagttcagggcactgaaagctgtgagagctgggggaccctgtggctgagtcccctgtgccctccagttctggacagcatcagccacagcaggaggaggaggaatcaaagccagaaccagagaggtctggcctcagttggagcaaccgggagaaggcaaagcaggcattcaaggaactgctgagggacaaggtgctggagtggggctcccagggaaggtttggagggggctggagcggggcaggccccatgactcccacctgcttcattccaggctgtcccctccaatgcctcatgggaacaggccatgaagatggtggtcaccgacccccgttacaggtaggcctgggcagagggagccaggccctgttcatgagagcagctgtgctagggactccctaaaaaaccccagctcaacactcagccctaagggaaccagagtcaggacagtgatagattgggttggggtgcaaggggaagaaaagctggagggcctccaggagaaggaaaggaaaggtatctgacacaacacgttcaataaatgcttcctgaattgaatcaaacggaattgaattaattggggaatgagggtgctggatagggtgacttgagaaccccaaaggaaaagggcccagtatttgcagtgtcttggagctgcatctcttcccctcacttcctgtcacccctacttctccatgaatggtgttcagatcccagacatctgtgcccttggagcccctgcagcctgcagtgtctcatgaccctccagtgtgggctgtgcagagtggttcgggtgacttctctatccccaccccactcctaccctctatcccagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggtcagggggccaggctgggctgggacttgggaaccctgagaacacaaaggtccagggtctctgttctctgtctacctactcacagcttatatgctccacaggcgggcagaacagacctttggggagctggaggtctgggctgtggtccctgagagggatcgaaaagaggtttatgatgatgtcctcttcttcctggccaagaaggagaaggtaatggtccctgggcagaatccttcagcccatctcatcctggactttccttgtctttgctttgttatggaccctcgccatttacttctctacttccccagtgtcccagcttctgacttggaagctggtatgggacttgcacatctcatttctgctctgggcctatagtcctgggtgtagcagggaggaggagtctctgagagatgggtctgtaacctgtactccctccccttccctgaga

SEQ ID NO: 69428 - DNA, 2455 bp, Homo sapiens
gagctctgggataggaatcttaagtcctagagatgtcaatgatgattttagctcatgtgaatatggtcttaaagcatcatagaactacaggccttaattggtcacgttacaatagactgttgttggcctgtaattactgatgatactcaaattcactttctgaaattgcatcaaagcctgattgattcccagttccctaaggtgtgaaacctcagatcccaagacaaccggtttcatgttatggcttctaataactgaattcacaagagctgaatacttgcttatttattcttatacaattaatgatcccctcttaagaactaccattgcagtggctgctcccacagagccccctccaggcccttcccccaccaccctgggtatccctagcacctgtaggacagcatcgttgaaacattaggggtgctggggtctgagagggtatcctgctgggacaatgcccgcggaacctcctgcctgtctttagacatggacaaggaagatgcactgatctgttttgaggagcacatccgagctttggagagggaagaggaggaggaacgggagcgggcccggcttcgggagcgacgccaacaacgcaagaatcgggaggccttccaggtatctttgctgtcctttctagatcagagctcagctctgccctagagcacaacctcttcacccattccctgcccccttctggatacgctgcctgttctttctgtgcctagccctgtccaagctctatgagacctctctctgcctgcagtctgtttctgctgtacctcctcaattctggactgtgctcttctagggagactagatgtatgcaccacccagaaactgccagtagagagcaccctacaggcatgacttggcagctaggccatgtttatttcccttggtggggcacccgacaggcagagtttattccctcagcttgggggtggcagtggtggtggtagtgctaggggttactgcaggcaggtttctgtttctttgcatcccgggactggcttgttctcacctttttgttctgtccctctctgtgtatttactttctctctttttgcattgttctcagccttccatctgcatctcttcatctctgcctctcttgcctgcatttcctcaatcttgattgtccctgcctcttcctctgccattccctctcttccccctcagtctgtggctctgcctccctgtctcactctccctataactggcctctccctgctcagaccttcctggacgagctgcatgagacagggcagctgcactctatgtccacctggatggagctatatccagcagtcagcactgatgtccgctttgccaacatgctgggccagccgggtaaggcagccaggctcccccttctctggcctggcttcctgccctgccagcctctctgcaccccctactaccggctcctgtcctcggcccagcccccaggccttgggaagctgccgcccgccaggcccccctccctccctccttacaggctccacccctctggacttattcaagttctatgtggaggagttgaaggcacgattccatgatgaaaagaagatcattaaggacatccttaaggtgagggaggctggggttatggatggatacaggatggatgcagggcacactccctgcagaggactccctgataagtcctgttttgcagaagcattacagcttggttcagcagatatctactgtgatcctttactgcacactagggatacagtaatgaatacacaatttctaccacaggagctcatggtctaataggaagatatacatgagaactgttatacaaaggggcaagtgttattacagagacaggaatctgaagaactaacatttgaactgtgcatttagaaatttgtaggtggaagaggttggagtgtacacggggtactaagagcaaaggcaagggggtggaaagggcatgccaggtctgaggaggaagaagcatagctaattgtaaactggtagcacacagattgttctttctggcctgtacagtgttctgtaaaaatttggaatttgttgctaacattttaaaaccaggaaacttcacatagaaaatctgaatctttagcttctcttgtcaatatggattatctagcagtactgagctggatttgcaaggcattctgcagactcaagctgagatgccactttagaaagggcaagtcatccttctcaccattccttagtgccttcttgatactgtcgcaagtgtcagctgccatttaccatcacacatggcctgttgctcttcttctactggagaagagaaatagttctcaatatttacatcttatcaaaagtggaaaagtgagtgagtgatggactaaaccttgtgttccaaaagaaaaaaacaaagagcatatttctttatggaagtgaagattctaatgcatttgaggagataatacagtacagtggt

SEQ ID NO: 69429 - DNA, 1034 bp, Homo sapiens
agaacactgtacaggccagaaagaacaatctgtgtgctaccagtttacaattagctatgcttcttcctcctcagacctggcatgccctttccacccccttgcctttgctcttagtaccccgtgtacactccaacctcttccacctacaaatttctaaatgcacagttcaaatgttagttcttcagattcctgtctctgtaataacacttgcccctttgtataacagttctcatgtatatcttcctattagaccatgagctcctgtggtagaaattgtgtattcattactgtatccctagtgtgcagtaaaggatcacagtagatatctgctgaaccaagctgtaatgcttctgcaaaacaggacttatcagggagtcctctgcagggagtgtgccctgcatccatcctgtatccatccataaccccagcctccctcaccttaaggatgtccttaatgatcttcttttcatcatggaatcgtgccttcaactcctccacatagaacttgaataagtccagaggggtggagcctgtaaggagggagggaggggggcctggcgggcggcagcttcccaaggcctgggggctgggccgaggacaggagccggtagtagggggtgcagagaggctggcagggcaggaagccaggccagagaagggggagcctggctgccttacccggctggcccagcatgttggcaaagcggacatcagtgctgactgctggatatagctccatccaggtggacatagagtgcagctgccctgtctcatgcagctcgtccaggaaggtctgagcagggagaggccagttatagggagagtgagacagggaggcagagccacagactgagggggaagagagggaatggcagaggaagaggcagggacaatcaagattgaggaaatgcaggcaagagaggcagagatgaagagatgcagatggaaggctgagaacaatgcaaaaagagagaaagtaaatacacagagagggacagaacaaaaaggtgagaacaagccagtcccgggatgca

SEQ ID NO: 69430 - DNA, 1207 bp, Homo sapiens
atcctgggatagctaaattttattggacaattaacttttagccacagagtggctggttgataggcctgtaggggcctatcctcactgagtcctgtctctccacacaacctgagaaagcaacttttttagacagttcccttcctctttccccatttgggttcctgcctatggagggcagatgagcccaggagtccctcttgctttccacagccaggcagaccatgatggtgcctttcatcccataggataatgcaaagagccctggacttagaacaggcagacagatccgggtcagggagatccatggaggatgctcatgagaaatatattctcttgagatctgttgaattttaagtgtctgaaatatccagtctaggatgtttgaaaatcaggagagatgaaggatgagattgcgagggagtacagattgggtagtgaaagaggactaagtgctgttctcaggaacatgcatatgcaagagaataaaaggtcagagagggtgtgacctggagaggggagtgttgaagaagtaagtggtagaggcactgaggaccagatgagtgaggacaaagaaggcggccttggatttggctagtagacacaagcaacctttgggagagtagagtcatggaggtggcatgggggcagcacatgttttagagtcagattactcctggttgcttattggctctgagacctccgtaagttccgtgtctctgagcctgtttgctcacctgtaaatcagggataattcataggtaaggttgtgagaattaaataacatctgtaaagtgtctaataggttctcaataaatgtttattccttttcctttctgctgcatttcaagaggttttgaaacaatggaaaagagcagaggtagttagcttgatgaaggggagagcatggtggaaaggatgttccaggttaggtgaggtgtctgcttgatggaaggagccagtaacaagggtgacttggagctttcaattccctgagaatgaatgctgtgttgataaggactgtagcagggttgaggaagtacccttggaaagaagaaagaggagcacacctctgccatcagcaaaaaggccagaggaggtgagagctatgtggagggagagaaagggaatctggcctgtgcttaactgacgtgagagccagactttgaactccagtggcttcatttaccactcatgtcatcttgggcca

SEQ ID NO: 69431 - DNA, 1053 bp, Homo sapiens
gcttttgttatcttctttctgaccacttcaaagctttccgctggagccttaagcaggggccactccagagggagccttcctccaggcgccaggcctggcccagcccagcccttcccagctaggtacagtgggagcaggaacaagaaggggagcagtcgctctttactcccaactccctcaagctggccccagaggtcttgtgttttgtgtatgatgtatgtgaagtgcttagaaaaaaatcataaagctctctatagacatgaggtagctgttatttctgccccacccatgaaccctagggcaggcctgaggcagtttcattttggagaccagcagtctctgtggcttgcctgcctttgctactgtgttctttggggtcacaagctcagtttccattccattccctccccctgtgagggatcagctagcttggtgtgtacttccttatgtccatacaggtatgtgaacctgagtgagcccatgctgagggggagggccagagtttgatatagctctgggctgggaggtgagcatgccaggccctaggcattcctcagccaggcttttggtgaccagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggcaagcacggggtgcaggcggtgggagcaaccagggccaaggcaccaggcccctctaggtggccctagttctatttttttttttttttaaatcaagcagctggctggctacatgtaggggagagagagcgctttgggagtgccaggcagctgcctctggagacatgtaggggagagagagcgctttgggagtgccaggcagctgcctctggagactcatactcaggagctttgggagccccaggttccctccagctcacaggggcctgggtgcttggttttcctccctttggccctgggctctgctttctgcaggc

SEQ ID NO: 69432 - DNA, 1046 bp, Homo sapiens
cccaaagctcctgagtatgagtctccagaggcagctgcctggcactcccaaagcgctctctctcccctacatgtctccagaggcagctgcctggcactcccaaagcgctctctctcccctacatgtagccagccagctgcttgatttaaaaaaaaaaaaaaatagaactagggccacctagaggggcctggtgccttggccctggttgctcccaccgcctgcaccccgtgcttgcctcagccgtcttggcgtcccgctggagcttgtctagtttgccttcattggtactgaggaagttccggaggacgctgttgtcatggatgctgcactcacgccgaatcagctccatgccccggcccagctccttcacgtccagcagcacgttctccagggacactggtcaccaaaagcctggctgaggaatgcctagggcctggcatgctcacctcccagcccagagctatatcaaactctggccctccccctcagcatgggctcactcaggttcacatacctgtatggacataaggaagtacacaccaagctagctgatccctcacagggggagggaatggaatggaaactgagcttgtgaccccaaagaacacagtagcaaaggcaggcaagccacagagactgctggtctccaaaatgaaactgcctcaggcctgccctagggttcatgggtggggcagaaataacagctacctcatgtctatagagagctttatgatttttttctaagcacttcacatacatcatacacaaaacacaagacctctggggccagcttgagggagttgggagtaaagagcgactgctccccttcttgttcctgctcccactgtacctagctgggaagggctgggctgggccaggcctggcgcctggaggaaggctccctctggagtggcccctgcttaaggctccagcggaaagctttgaagtggtcagaaagaagataacaaaagccagaaacaaatggacccaagtgttctctctcctcatagcttcctgggattgtcctgggctggatgtgagggcag

SEQ ID NO: 69433 - DNA, 1061 bp, Homo sapiens
aggtactcttcatatttcattctcttctgtattttctcctgactttttgttcattataaagtcatgcccccatcctactttctctttcagaagaatatatgctggctctgttgagctcaatatgtatctgcccagcttctgctgagcattgtattgggagctatggaggatacagagatggttaagacagggtcttgtttatagggggcttccaattgagccattatacaaggccaagtgaaattaaagcaaaatgaggcccaaagggttatggagagagccgctatgtcagaccggtggtagattaaggagagtttcacaggggcaaccttttttcctgggctttgaggggcccatgcagtgagaattggctggagcagagaggacacttcagggtgccagcggagggaggcagcttctgcttgcctcttttgttttgctgccttccagcttcctcattcccccacctgggtttctgccactctgagcctctgagtaccctgacagagaccctcgttaagagaaccctgggtaggaattctcactcttggggcaatgactatgccttcagcccacttttcccttaatggtgctgtctgcctgccaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccaggtaaccacgacgacccctgggagccaacaggggcagcctctttgtggggaccaaaactgtagtcagcagtgtcttcctcagggagaagctgggaaaatggcattatctgaggacttggagggatataaaatcagggtgagggaggcctggaatctgagggaagctcaagttatc

SEQ ID NO: 69434 - DNA, 1063 bp, Homo sapiens
cctccatcagcttcccatctccttagactgccctccttgttgctgcctgtgctgcttctgccgctgttctgtgttagtggctcttccagctaggatcaggtctctgctccccagttctgctttctctccttgctacccctgctgcttgttgccctagaggcctgaagggtgggggtgggctcacggggggccttggcactgaatttctcctgtgtatgtgcctgtgtatgcgcatgtgtgtcctttcatgctccaggtttgactttgagggtctggaaagtggtgacgatggtgcatttgacaaactccggtcctggagcaggtcaatcgaggacctgcagccacccagcgccctgtcggcccccttcaccaacagcctcgctcgctctgcgcgccagtctgtgctccggtatgtgtgcttttgctctgcccacctgcctcccaccctacccttcagtgcaggtctcgggttcagcagtgagtgctcatgctcctccctccactcttgcttccaggctcagctctcttgccctctgcctgccagtctgtctctggtctgtcttctctgtctccttgactctgcccagcggtctgtcctgggtaagtacatggtctcagctgcacttacccaacgtggggttccagctctccccattcctcacccctctctgggggagcccttcattcctctcactctgccattcctcctgggtctcttgagcagggcacatctcatacaggtccatggccttcactgggtgatccagctcctactctcattctgtttccctctagttcttcactctgcccctttagctgcttggagaccagctcccacccaacctggctgccccttgcattcccttcacctcttccttcaggcctttctctctgaggctgccacatgctcatttgtctgcggtgtcttaagagccgccctgcctggaggtaggcggatggactggatgacttctcagagccccttcctactctgggaggctttcctttgggtcccatggccctttccttggtttctgtctctcttgtggccatgctttcctcc

SEQ ID NO: 69435 - DNA, 1085 bp, Homo sapiens
ggctttgagtggaagacattcccacagcagttgagactggagtctgcctgtggcctggtgctgggccaagcgaggctcagagaaggctgagggtggggagaacatactatattgggtagctgagacctagttcccattcggtgactatttggactttttggtgcctggaagtttatttgcttgtttgggagaagataatcttagttcatgagcagaagcttccttaagcaccaggaaagatgtaaggcactgggggcaggagctgaatgttttctatattcacagaccctggtgtccccaacacattgatagggcccttaggaactgtgtgagtcttttttttttttttccagtccctgagtgggaaaccaggaattgctgaacaagcaaagagctaatgtgtaaggtacagtgaaagagggtattggcctcagtgttacgaaactgtaatcagcaaaggtatatgcaaaggtatatgaaagtgagagagagagagagaaagtgtgtatatgtgtgcgtatgtgtgcttatgcaaaaggacagtgagggacacgtgatgtagaactgcaggcaggggtatagacctgatgggagggcctggcacaaatgtccagtgcttatgagtgagcagtggaggcccaggtgggggtggggtgcccaggcttcctgacagggggttagagacagccaaatgacatcattagcctttcccctcctgttgtagcagcagccctcatccgcccccagggcaagccttcccaggattctttagagggaggggacacctgtgtgtagccagctgtagcagcaatcacaagggaaacagcacaggagagaacaggaaagggatggttcctggcctcagtaactgtgctctggtggccagagtatggcttctgtacctcatctgtgaatcagacattgaaagtcaagctgctgagaaaggtgtggccaagcctcttcctttgtttggtcagtccttcactgacttcactgactgaaggacaaagtggcaggggctgcttagtacccctgtgtgtgagggcaagaaggacaccgatggcaaccctgagtgctacctgcca

SEQ ID NO: 69436 - DNA, 1083 bp, Homo sapiens
gaggtttcagccttgttgactcaggttctctcctcagagctccatgaacctgcctccagacaaggcccggctcctgcggcagtatgacaatgagaagaaatgggatctgatctgtgaccaggtatggggtttgggaaagaggagggaggtagggagttgtgtcttgggctggctaaggctgtggggccaaaggcattgagtgcagccttgggttccttgaggaaccctggcctaagcttggcctcatctgtgttcactttcttttccaagaggattctcataacagagacagagctggcaggccaagttcccctctagctcccacaaagagctgtcttgatttcttccaatgggcaatagtataaggggatttgtgtagatcaggggtataggattggctgtgcaggttcagggctatgcccggtagggtgctcaaaggactgttgatctctcactctgtcttagccctggcaaatagcagggtctttctcattatctcagggcctctaggaatgagaagccccagactctagtcttttgttcccaaatctcagaagagtcaaggtctggaaactctctctgcatgaacagtgttgagagctggaagagaatagaaatcattactttgctcagagttgagagtcttctaacacatatgacctggctctttcccttgcatgcatttgaagatcatgagtcacgagtctgtgaaatgagacaggactgtatgcagggctgggagagttggcttttacctttttacatcttggtagagatggaagtatctggcagtgtgggtagtgtgtttacccagcactttgccatgtacaattttattatttcttttcaggctctgggtgaaataataataggtaacatttattgagtgcttgttatggaccaagtactcaacacactgaagtatctcatttaatcatcacagaaccctctgaggaaggcagtgttggcattttatagatgaagaacccaaggctcagtaacttgcctaatgctagtaggtgatgaagccagggctgagctcaggcaagcagatgccaagtctgtgttaactgttctgttcca

SEQ ID NO: 69437 - DNA, 1010 bp, Homo sapiens
actggggctgtcaggggtcaggtggagagttaggaaaccttgctggagggaccaggccttgctcacatgcaccccattgtgcagggagatttgcctggcctcaaactggcaaacagagcagccttgctggagaagcaccagctccatgcctttcggcttcttcccattatagatttttattattagatgttttgctggttccctgtgatttaggaatcggtcccagagttgctttcagtttgagttcatcttccccttttcctcacatctcctattgtgactgttttggctgtgacttacctcccttacttcttccttggagtctcctgccatgtcccccacccctcaagataatgataccaaaattggcgcctagtcttagaggaagccagagcaggatcagtgaagggataatggattgctctgtagtcagagtgttgcgaagcaattgctgaaggtgggatggaggcagagagagagagacagcctagaagcaagagggcaggtccctcggacatcagaacatgacacaagattttcgggaggaagcaggcggtgagggggactgtgttgaacacccacagtgttccagacacatacagacataaaatatttatcttttaatcctcagctaaaaccctgtgaagtagtgagattatctcgtttatggatgcgttcaccaaggctccataactctgaagagcccaaagttgatcttgggccctctgacttcacccacatttagtgccctctcctttccaagacagccactgcctcctttctgctcagcaagggtctcaatgaggagttagcaagaacttagctcagcttctgccttctgggagcctacagtgtctgtggaaccactgaagaaaaaatgtcaaggaaacaaacttttgactgagaccggaactgtgtcaaatttgctactttgctgtccccggaactcaggaagttgtcattcctaagggcagagaggcttccttaggacattggagccctgccagact

SEQ ID NO: 69438 - DNA, 1035 bp, Homo sapiens
aggctgaggcaggaggatcccctgactttcggaggttgagtccagcctggacaaccccgtctcttaaaaaataagagagaggggccaggcgcggtggctcatgcctgtaatcccagcactttgggaggtaaaggtgggcagatcacgaggtcaagagatcaagaccatcctggccaacatggtgaaaccttgtctctactaaaaatacaaaaattagccgggcgtggtggcgggcacctgtagtcccagctacttgggaggctgaggcagcagaatcacttgaacccaggaggcggagggtgcagtgagccgagatcgcgccactgcactccagcctggagacagaatgagactccgtctcaaaaaaaaaaaaaaaaggaatggggaagatatttagataagatgataagattatcaggcagttttgggggttgagctataagagaaagtgaaactttccatgaactttggatcccagtgcctgagtgtgtctccgaggaaggggctccctatggcagtgcagccagtctgggtggggatcagagtcagtactcatctgggggtccaactggctcctagcctcaggtgggccccagtcagagcctgtggttgattcttcctggctccagttgtcagaactgtctgcagggccgggtagggtgctgattaactgtaaatagatacttgtctttcctaggcttctcaagtctgattctctcaagatttcctgaagtcactctgtgtgttctggtcttgaagagaaatatgaagtctggtctgggaagcagctgcaaggagtgtagggatggatgctcagccaagccttttttaagagttttggggctcagtgactgacataaaggtgctcaatacttttttttttttttttttttttggagatgaagtctcgctctgtcgcccaggctggagtgcagtggcggaatctctgctcactgcaagctccgcctcccgagttcatgccattctcctgcctcagcctcccaagtagctgggactacaggcgcccgccaccac

SEQ ID NO: 69439 - DNA, 1022 bp, Homo sapiens
gggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaacggcagaggcgggaagtgagaggagtctggggctggggctgccttccaggcccacggggcggccccgctcttttcggattggttacctttgggcaggtgaggtggctttgctttgcttggtcttgaggttttgtgggcgtctttctaagtctgctcagcaagggcgtcgttgggcagtttttatcttgggcctacttgctggacctgtggtaacaagtaggctttggtatctttgtatatttactgagtgtagaattactacccggtgccagcccgggctgcttggggtcatcagcctttcattgaccacccccacaacaaaaatcactatgaacttgagactgtgttctagcaacttgtgaatgtgtaacccagtagaagggctgactgtgcttgaaacagacaaggattttaaggtcaaaggtaaataaatggcaaatggacttttctagttacttattgatatttatttacagtttatcttttgtatgtgtggtttaagaattgaattctggaaagataccggaattgcataaacacatttcttatgacctgcgtatacacacttttttctgtaattattgtatttacactctttggtgttttcttattctttgtgtctaatatttttgttctggcctaaagaatatgttgacatttagattctctgccgccactttcctc

SEQ ID NO: 69440 - DNA, 1957 bp, Homo sapiens
tcagaatgcaaacagcatagtgctgaagtgctgtctagtattcctgagtgcagaaagaccgtaatgtgccttatgaagaaaatgtgtatattagataagcttcattccggcatgagttgtactgctgttgtaactgtgagttcaatgttaaggaatcaaaaataatgtcaaatgaggtgtccttaaacagaaacacatataaaagcaaggtatctattgatcatttgatgaaaatgttgtgaccttaggcttgcaggaacctacctaccttttatttccctcaggaacaagggtttactaattcattgtccactgtgattttataacataaacactgaataatgagaatcaacttcttcctttaaaggaaggaaggaacttcagtgtctacgtccatccttaatgatttctcttttttctaatgcctatagtttttcccacttggcgtttttaaaaaaagaaacacttttttcttactacaaagctaatatgtgttcattttagaaaattcagaaaacagactagcaatgagaaggaagtattttagaaacttccataatcccatcatccagaaataactactgttaacattttagtactttgcagtcttctgtatatgtatgtgtcttggtgttttggtgtttgggggttttgtttgttggtttttgtttttttgagacggagtttcactcttgttgcccaggctgaagtgcaatggcgtgatcttggcttactgcaacctctgcctccctgggttcaagcaattctcttgcctcagcctcctgagtagctgggattacaggcgtgtgccaccatgcctggctaattttgtatttttagtagagacggggtttctccatgttggtcaggctggtctcgaactcctgatctcaggtgatttgcccacctcggcctcccaaagtgctgggattacaggcgtgagccaccatgttttttttaaagtgaccaaagggggatcatttctatttgttctacagatggaatgtactttaagcacttgtcacgtttcattcatcctttctattttttgggcaagactcactcatagtttgacttgggtagttgtactgtagttgaaggactacgcaagccagaagagcctccagcatccaccatggtcctaactctgtgcttcaaggcttctgggttatctcctcagccccatccctgagaaaacactactttttctcctgcctccaggttataagcaaatgttaggaagttcagacgagtgtttgaacccaataaaggtctcttgcaaaataaatttgaaactttcaagtgtttaatgattgattgattctgactctaacaggctggcctgctgtctgccttgggctccctgatattgatgatttggctgatggcaacacctcatagccatgaaactgaacagaaaagactgggacttcttgctggatttgcattccttacaggtacgttaagggatttgtctaattttgaggggtgagctatattttcagtatctcttaattagttcccccccctttttttttcttttttttttttttgagacagagtctcgctctgttgcccaggccagagtgcagtggcttgatcttggctcactgcaagctccgcctcccaggttcacaccattcttctgctttagcctcccgtgtaggtgggaccacaggcacctgccaccacacccggctaatattttgcatttttagtagagacggggtttcatcgtgttagccaggatggtcttgatctcctgacctcatgatccgcccgtctcggcctcctaaaatgctaggattacaggcatgagccaccgtgcctggccctttttttcctttttttttgagacagtgtctccgtctgtcacccaggctagagagtgcagtggcgtgatcttggctcactgcaaactctgccttccgggttcaagcgattctcctgcctcagc

SEQ ID NO: 69441 - DNA, 2557 bp, Homo sapiens
ctacttttgtgtccaaaaatagccattgtgtacttgaatgaatgaggttcaagagcttaggtagcataacctattaatagtaggcatagaacttttaataaactagacttgagaatccgacatagttgcacccatactggcaattatcataggagcttctgttctgagtcttacagacagtgcattaaagctatacattgagatctattgtgcaggacactttgctgattctcaaaaaaagaaaggcacagctcttctagaattgtcataaaggaaacaagactcaagctatgtaataaaaatgtttgcaaaacatttgaattagaacagcttgttctgagtgacagtctaatatacgtaggagaaattttagaaaggaagagatttagggattaaaatttttgcatcagggcaagctagtttttgaaggcattaaggggtggaattatcagaaggaaagaggaaagtaattagaacgaaagaaatgttagagctggaacaggttgccctcctgttggcaggtgtccacctgcagaaccagtctcacctttctttgctacaaaggggagtcagtcctacatgactataaggttgctggccacgaggcactgttttgctctttatcctttttttctaattcctgatctggcctatattaccatcttacatcactctagctctgaaatgtttggcatgcctactttattttcttgtaatctctgtaccctccctgaggtcatccatgattttcagctaagaggacaattttgcagctatttctataaaaaaaaaaaaaacaacgcagtcaggtatacattttattgaaaacaattacagcggaggggagagagatttaattctttagtccacgtttgttaagagcatgagtatgcctatatttcgggatcagcttttggatgaggatcctattcaagaattgatcgtaatactgtgttctgggttttctgttttctaggagttggcctgggccctgccctggagttttgtattgctgtcaaccccaggtaactcttttggtagtgtcttatgtgcttttatctttatgaatataccttctaaatgtagaccgtatacctgtagcccttaatctaatggtctttttttctaacagcatccttcccactgctttcatgggcacggcaatgatctttacctgcttcaccctcagtgcactctatgccaggcgccgtagctacctctttctgggaggtaagtgtgaactgggaaacagggaatgggggctcctttttagccagaattctcactagtactccttccttacccctaactcctttgcgactattgagttgagattaaccttcattctgggggaagttaaggaatggctttaatgggattgctttactttgccttggcttctctcaagacagctttttgctgtgtcttataggtatcttgatgtcagccctgagcttgttgcttttgtcttccctggggaatgttttctttggatccatttggcttttccaggtaagacttagcctggaactttccagcagccatttgcctcacacttctttctttccttttttttttttttttgcacttctttctgtactactttgggcagtgctctctaagccttcccattatccttcataggatggagccttctgccacaagtgaaaacaggctgcacaaggttgggcattgctaagagaaaatggtttgctcagacaccatttgtgtaaggccagtctggcagtggctgattgttaaaatgattgaaactcttccagtgaccagtgcagtattgtgcctagggaagtaaagtggtcttcaccctaggctgcagttctcgtgaatggtaatgttcatagggttcacatttgatgtactttcaagtgactatgagccagaaagtatggctggtttttttttctctgcaacttctgctgtatagtaacttcatctcttacatttgttaggcaaacctgtatgtgggactggtggtcatgtgtggcttcgtcctttttgatactcaactcattattgaaaaggccgaacatggagatcaagattatatctggtgagtgtgggaactagtctttaacaagcatgaaggttgaggcataccgttcagcagctgaacttaggttggcattggctgaacataggtggccaagctttgggagtgtatgtggtaggaaacccacggttttggaactgtgtaccataatcttcctcaattcctgaaagatttcagattttttaaaaatctgggctaataggccaggtgtggtggctcacacctataatcctagcactttgggaggctgaggccactggatcgcttgagctcagaagtttgagaccagcctgggcaacatggcgaaatcccatctctactaaaaatataaaaaaattagctgggcatggtggcacatgtatataatcccagctactcaggaggctaaggtataagaatcatttgaacctaggaggtggaggttgaagtgagccaagattgcaccactgcactccagcctggcaacagagcgagaccctgtctcaa

SEQ ID NO: 69442 - DNA, 2793 bp, Homo sapiens
cactgttgggatctgagctgtagtggctgtgaatagcctagagtggtcaggcagcccacctcggcactcctggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctggtgtttgtgttaaattcaagggtacagctggtcatggagcttgtgatactgccagggtttgctactgggggctgggagtgggacacgattgagttcgtgtcataagtatgaacagagacaaagacctcccactctgtagccccagcatgccacaaatgttgagaattttctctgtcaaatatgtaagccagttttttttccagtcctctccaccccctgccacctttgctatatgttgtttgtggtgatatgtgcagttggttcagatgtgcagccaagctttggagtttgaggatgcataatggaaaaaaggcaaatgatacccactcattctgcaagtatttttgttcacccactgctgcccggctgtattctaagtgcattagttaataaagatgtaaaagttggccaggcatggtgg

SEQ ID NO: 69443 - DNA, 1041 bp, Homo sapiens
tccacctcctgggttcaagcaattctcctgcctcagcctctccagtagctgagattacaggtgcatgccaccatgcccagctaatttttcatatttttagtagaaagggggtttccccatgttgctcaggctggtctcgaactcctgacctcaagtgatctgcccttaagtgatctgcccacttcggcctctcaaagtgctggattacttacaggcatgagccaccacgcccagccaagaaacaatatgttctttctaagcatggtgagcagatgaggggatctgtcttgtttaagctggggataaagatgtagaagacagttcctgccttggagtccttcaccactgagtagtgctggagagccacatgtgaacattacatgtgaataggagttaagcatagtgggccatgagacaacagcaggagacacagcctggtctggtcggtcagagaaagtgctttgtagatgacacctcagctaagtctaaatctcaaagtttgagtcaaagtgaggcaagtgaagagattaagaaaggcagtgggagtggatgtttctgatcaagggatcagcacgaggaaagacaggagtacgctccagcatggggagtgcaaggaaggagctgcaaaaacaggttttgctaactaggaaagttggaggaaactagtaggaaatggagggggtaagtcaacagttactgaagacctggtatgaggcactgttgcatcaaacctctgatgaagctgggcgcagtggctcacacctgtaatcccagcactatgggagaccccaggcgggtgaatcacctgaggttgggagtttgagaccagcctgaccaacatggagaaacctaaaaatacaaaattagctgggcgaggtggtgcatgcctgtaatcccagctactcaggaggctgaagcaggagaatcgcttgaacccaggaggcaaagattgtggtgagccaagatcgcaccattgcactccagcccgggcaacaagagcgaaactccgtctcaaaaaaaaaaaaaaacaaaaacactttt

SEQ ID NO: 69444 - DNA, 1061 bp, Homo sapiens
tgcatactggccaggcgcggtggctcacgcctgtaatcccagcactttgggaggccgaggtgggcggatcacctgaggtcaggagttcaagaccagcctggacaacatggtgaaacccggtctatactaaaaatacaaaaatgagccaggtgtggtggtgggcgcctatagtcccagctactcgggaggctgaggcaagagaatcgcttgaacctgggagtggaggttgcagtgagccgagatctcaccactgcactccagactgggtgacagagcgagactccatctcaaaaataaataaataaataaaaattaaagatgcatactgaaataagtatggattaattactatgatgtctgagatttgcatcaaaatactcagttgggcttgtggagtgcctggagtgagggttctggatcccacccgtgagatttaggattgttaaaatgagtcttcagaagcaaatccctagtgacttcttatagcaaatcatcggatgaccaattgtggtaaaattaaattatagagtggattattgaggggtcctggcttgcctggatggctacatgaatatagccttggggtagacagaagaatatatacaaccaaagaataagtatgggaagctgggtacagtggctcatgcctgtaatcccagcactttgggaggctgagttgggcaggaatttgagaccagcctggccaacatggtgaaaccccttctgtactgaaaaaaaaaaaaaaaaaaaaaaaaggccaggagcggtggctcacgcctgtaatcccagcactttgggaggcagaggcgggcagatcatgaggtcaggagatcaagaccatcctggctaacatggtgaaaccccgtctctactaaaaaatacaaaaaaaattagccaggcgtgatggcaggcgcctgtagtcccagctactagggaggctgaggcaggagaatggcgtgaacccaggaggtggagcttgcagtgagccaagatcgtgccactgcacccccagtctgggcggcagagtgagactccatctcaaaaaaaaaagtacaaaaatt

SEQ ID NO: 69445 - DNA, 1079 bp, Homo sapiens
ggggccccccagggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctccctgaagggaccaaggaggcaggtggataagaaggtgaaaagggggtccctggcacaccccaccacccactgcttcggcggatgagatgaccgtgctcagctcagggagagaccccgcccttggtcccttctctcacccagagtaaggctcttcctggaagggactgggggttaaaggccactgtgtcgcagccctccagtccctacttcaggctgagccatcttgtggtgctgggcttcctgcccaccagccgtgccatctctgcccaacccggctgctcctctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagcccccagccccgcactgcggttaatttatgtgttgtttaaaatgcggctgctctgcttcctgcctctgcttctgccgtatccctaataaaatgtggaggccccctccctgcccctgagtcggcttgttgtgtgggaggactcaggcaggccaggtcgggggacactgcatgggtgccaggttgagggaccccaggcccccttgtgacacagccccctcaccagggcaactggctggagtcatcccagaaggtaactgagggttgggagagtagggcctgcttaggcccggaagggtatctgggctcggagagattctcctgggccagggcttgggcacggcgcgaggctgggtggccccttggagagggagctggggaagatggctgtggacatgcactcaggccccacgtgt

SEQ ID NO: 69446 - DNA, 1132 bp, Homo sapiens
ggtgatgatatgaaaagtctccatttatggaattcacgccagacactctacatatattatctcattttgtcctccaacaaccctttgggctaagtgttcttatccctgttttacaagtgagaacaagagaaaagagattctttagtgtcagatttctagcccaagtttctagcctccagggagccttagggctgtacggagcttaaatgtctgttttactgtggagcttacagtgaagcttgggtgtgtgcagaggagtgggaaaatctaggcctgtctggtgtgctttgtgaagtagtcatgtgacttgggcaatatcctctgccccagagcctgcctcctcccgcaggcgggtgctccccttccagggttgttaggagaactggatgggatggtgtggaagaaagcgcctgtgctattcatcacactgggtaaacacagtgtgtgcaagtgtaactttctgttcctcggtttcctcatctgaaacacaggcactgataatagcatttaacattgttgtggttaactgttgagcacgaggcaagacaatgtatgttgtagaaccgggttgtaaagtaccaggtgtgacttttcagtctcctctgttgtctgatgattcctggctgagagatggggacctttgcactggctctttctgctgtcccaaatgctttcccattccaggatttcatctggacttcattcaggtctctgcttaattgtcatctctcagtgccttatcacaacccaacgctgtacattgtcggcctcgtccaatagagtggaagcatcatagcggctgggctgtctctggctgttcgtcccgtgtcccagtgcctggcacatagcaggagcccagtaagtgcgtggctgacgtctttttttttttctccacaggcaaggtgaccgttctggatgctagagtgagtgtgcccacctgcgtaagggggcagagacaggtgaggggctttggggcctgtgcatgctgggggtgggagaggcacccctgggctccactgtggaggataaggaagcaagcactcagatggctcgatggtgagctgctgaggacacctctctcctatagtccaaaagctccaagcctttttatttttgttttgaaacggtcttg

SEQ ID NO: 69447 - DNA, 1056 bp, Homo sapiens
ggatatttacatagtccaaagtattgcccccaaaaatatttaattacaaaaggaaaaatagtgactttataatggagaaaccaattaatagatactgcctaaccaagtgatgaggttaaaacatcaccaggaacaagaaaccttgatatcatgtgtgtcctcagatataatgccctggggaaggcatatcacctccgtggtattcttctcaaagcatataacctcagtctaattagtgagaacatcaaacaacccaaattggaggacattctccaaaatgttgaccagtcccttcagaagtgttacaatgatgaaaggtaaggaaaggtcgagggattgtcatgaattgtagacactaaggagactgggtgaccaagtaccctgtggaatcctggattggatcttggaacagaatattgatagaaaaacggataagatccatataaaggctatagtttcattttctaaaaattgttctgctaaagaaagatgtggaaccatgagaacgtgctactatgtcttttttttaagtatgtatttatacataaagtaacacataggcacacagaagaagaggtggaagaggggtgggaggagcaggggaatgtaataggcaagggaaaagtcatccaggaagaagtggataccctcaagaaagtgaaaagacagcccacagaatggaagaaaatattttctttttcttttttttttttttttgagacggtgtctcacactgtcgcccaggctggagtgcaatggcactatctcggctcactgcagcctccacctcccgggttcacacggttctcctgcctcagcctcccgaatagctgggattacaggcgcacaccaccacacccagctaattttttgtatttttagtagagacgggctttcactatgttggccaggctggtctcgaacttctgacctcgtgatccgcccacttcggcctcccaaagcgctggggttacaggcttgagccaccacacccggctggaagaaaatattttcaaatcatatatatatatatatatataaatataaaataaagga

SEQ ID NO: 69448 - DNA, 1044 bp, Homo sapiens
gtcaggccaggactgcagatgtgggtaccatgtggcctagaatgctggctttctcaacttggcttgagtggcttctcttctccccactcccgcagtctgtgggatgtcctgggccccttgagttttattgtgtccaagacaggagacccccttctctgccagatggtgctgatcatttctcttcccccacccgcatcacatcgtcttctatttccccagctctgagcctgcaggctcctgaagctggaggctttctttccattccaggctgaggggaagttggggggtggggatgggggtttgcttctcacttcctctgtagacagcacctcacttcctgtcccccaggctagaagaaggctaaaactcttggctttgctgtcccttcctttctcctccctgactgctttcctggaaagcctacaggccttgaaggagcaaggcagcatcaaagccagcagcttatccctgaaggccctgccgagctccttaccccacccttaccccgcacaagggacctggctcctcagctgcagtccttttctagatgggatattcttctctcctgtgccctgcaggggagaggagtcagagtcagagggctcacccccattttacaggaaggaaactgaggcccagaggggtgccagcttcacctagggtcacgcggtttggctgcatgaatctcaggagcagaatcccaaaagcctgactcctgtttgtgatcacaaacaagagcagagcccagtgggggcttgtgggtgaaccagagctgttttctcctcccagcgtagagctgacagcttggggtgtcacctctgggctctggctggatggtgcccactagctgagcactggagttgcttgagtgcagaaggcatattggctggccagagcctattctttttgtagaaagaagccaggagatgggggcctgggtgcagtggctcacgcctgtaatcccagcactttgggaggccaaggtgggtggatcacaaggtcaggagatcgagaccatcctggctaacacggtgaaacaccgtc

SEQ ID NO: 69449 - DNA, 1188 bp, Homo sapiens
tggcagcagtgaggagaagctgcccccaccccacctttcccagccccttccctccccagggtaggacttctcaggagttgggctctccaggttgggacttgctttccagcccaagagccagaggtcttgaagttcttcttgtttgttttcatcctcggtctcccaggtgaaggggaatgttgaaggagaggtggtggttaaggaagccctgggtttgctcatgtaggggcacattctccctgggttacttttccctctgctggctctcctgggcctgggaagccctctgccctgggccctgctgcctatgaaggtgaagctgcagcaggaggtgtttaggttaaatcccaaggaagccttccttaccgctgtgagccgttggaatggataatggaagctcccagggaggtcagtttcccagaaagtggctaatgctggagtcactgtcagactgaaggatgcagctgttactaggcagaagctgctgttccctcttggggtgtggctctgaggctggccagccagaggccccgttagaaggaggaagagaaagggcccttgcctgacagccgaagtggggtccctgaccccatcatgcctgagtcaccagagctgcatctctcaaaacaagtgccctttctagcccctgcttctcagccccctcccccagttcaccaccgctctcactgtctccttcgacaaccctcacccgaacctggcaggttccccgagccccagtctggctgcattaatggactgattggattttctatacttggagtttgggatttctgattgaacatgcaaatttatgtaaatcaatctgggatctgccactacatcaaaacaacacagagcataggctggaaggaatcctagagacagtctagtccaacgccctcatgttaaaaatggggaaactgaagtccagagggggaagtgattcatgcggtggtgagtgtcagaggcaggactcctgattctgctgtgtagttttacatggtcccattctgcgttaatgttttatgcatgaggtagcctggctggatttaaggcagagagggccagttcttgaacctgagatagcagaaagctgggcccttggagagtcagagtgttatcgcaggaccctccaggggctctggtcagctttgtaacataccgaggaaaagcagcttcaaatccctg

SEQ ID NO: 69450 - DNA, 1031 bp, Homo sapiens
cctggggagcagtagaaagagtgtcaatgccttaccgttttgtggtcagtactttcggggaaaatgaacatagcccatttgccttgttgcagaccctcccttgcagacattacgccatctggctctctgagactccttgtgtgataggaaaattcacttctcaaattggtccccccatcttcctaaaaacaacctgggattagtgggtttcctatcccaaagaaaccgtgtgtattcctttccggggagatattcccatgttcaagcttgttttcaaagtctatggtctgtgcatgaggtggctttgtccctccagcatctttctccagctctggccctcacgaagagagtgaggacctggaggggcaggtgctgtggttggcagggaagaaggatcttcatgataggccggtgaagacctaagtgtttggggagcaagcgggtatcaataaagacagagtcagaagctctggtccctacttttcctagcttgctgtatgaccttggccaagacagtttgctctctggggctcagtttccccatctttaaatgtcagtagttggactagatagctctaatattcccttccactttttgacattgaatggttccactgatgggtgaatctataggggagaaaggtcctctggcagaatggttccatttagagggagctaaagtgttgggtgtgctttaaattgcaattagttaggattagaaccctgggtagagagaacagattcccttattctaagcctgagagtagaccttgtcccacacacccctggtgccttgggatatgaactcctgctcctgctggcttgggtttggcccacccatcacgcctgtggtgagacatcctggccctttgaagaggagctgagagaggaggaggcagccaagggccagcagggtaagcagattcccaggagacagtttacgtctcagctgttgggacttgttttaggatctgggccagggagcacaacatactcacccacccgccctcttataggaggagggcaaggag

SEQ ID NO: 69451 - DNA, 1056 bp, Homo sapiens
agttgtccaggctggtcttgaactcctgacctcaagtgatctgcccacttcagcctcccaaagtgctgggattacaggtgtgagcctctgtgcccagccaatattttacttttcatttagatgtttactcttgtttaataaacagccagaacatctgtatttgtcagagcaagtacctggctctctccttccttaaaggctattgtgcacttgataatttcagcattcagattttggcagattctctatgcttcacaaaccttcatcctcactgacaggggttgaaagaagtgtagctactattgcttcaagatccctttcagtcttttgataaggcttaaggcactttcattccttagtgctattatttgcataaattaaaaattacacagaagtcccaaagtttgttcttcactcttatgatataccactaatcatatattgttatttacttgagtcgtctgtgtaacaaaacaggctaggcctcttaggtctctgttagctgcaagctgttactactggtttagtaacaaaccagtttggtggtattgtctaactatgcatgtagtgctggtgcctgatagatggattctcagagagaatcacctcgtcactgctaacatcagtactttgaatggggttccctgctttaatactgtgtggtcattcatttaatgttggagcatcttcaattctcagaggttgaaactatagccatttagccattggttgataagctgactctagtttagaactcctggcaacaggagatagtcaggttggtaactagcctctcaaaacattttttctttttttttttccagatagggtcttgctgtgtcacccagattggagtgcagtggtgtgatcacagctcactgcagccttgacctctaggctcaagtgagcccctaccaagcagctgggactacaagtgcgcaccaccatacccagctaattttttcattttttgtagagacagggtctcactgtattgctcaggctggtcttgaactcctgagatcaagcgatcctcccactgtggcctcccaaagt

SEQ ID NO: 69452 - DNA, 1076 bp, Homo sapiens
tccttcctgccttttgctgtcttagtctctctgtctctctctattcatttctctcatcctgcagtttctgtctcctggctattttcacctttcctctgcctcttaatttttgtgcctttctttgtttctgtctgtttctacctcattttccatgtctctctctcttacatgtggtctttctcagtctccccaaagtcaagttcttctacccctggtctgggtgacactttcttccagttcccatcccccttccctctgagcttgtaacccctttgtgacctgctgcctcctcgcacaccaccctctccctcttcccacccactccaggtcgggcatgtggagaacgaggctggagggctctctagggcttagagggggaggacccacccccaggatcccgggagaggagctgcattaaagactcccatccccatgtgtgttagagaagcccttagcacagtgcctggcacagagtaaggctcagtaaagtctccttacgttgtgactgttaattttaaaagccccttgagggtttagtgtggtgctaagctagggggaagagtccagcgggagggtgcagaggaagtagagaacaggtgcctcctctgtcagtttgtcaggcagggctgaggggaggagcctgcaggaatgctaaggacttggaggagcgggctctgggctctgtggcagctaagatgccaaagaaaacaagggctaaagaaaccccgctattgttcctgcccagctctggcatttcctgctggagcagctcctcccccaggtctctcctcttaaggccggaggtcagtctgtcctttcttccatgggtcccagcgctttgtccccagccaatcatgccagctgtacatgccagttgtacgcaggattttcttctgggcctgggacttgggctggacaatgaccctgatgaccccagaggccattgggggccaggctcctttgctgctgaacttgcctccagttcgcaccctttcacttgctttctcatcctctctccccaggcactgtcttcatagtccacaggtctcaaactccagcatctcagaatgaaagga

SEQ ID NO: 69453 - DNA, 1402 bp, Homo sapiens
actcctgaacatcagcttctcaagactccttcatctagttccctgtcacagagagtccgttccaccctcaccaagaacactcctaggtatgcagaattggccttcctaggaaataaaaaacaactactttcttagacttcttattatattgaagcttattgaaagaaaaattgcattcgattttagctagcaactagactttaaaagggaacgtggggctataaggattccttctttaaaaaggttctgaaagtctttactatttcccctctctcgttgttggtgactaagaatacttaagcaactattgcaaaatagttgtctagggtttcctacttataatgggttatatcaagtaatattatagttgtttattcaaccattttttatagaatatttttccagttcattctctttttattgtagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgctgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcatttttt

SEQ ID NO: 69454 - DNA, 2654 bp, Homo sapiens
attggaggtggttcttcgcatgtggtcttcatctgttggtctacatggcgtaaataataatttaaagctcttttttttttccagggaatgctggcagactttgtgtcccagacttctccaatgatcccctccattgttgtgcattgtgtaaatgagattgagcaaagaggtctgactgaggtaagagtcaactgtaggagatggtgaatttgttatttgtgttaattcggaggtttttaaataaaaatgtcatcttgataatagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcaggtaagggcagatgtaatacttgaatatgaattcctccacggcagtagtttttcttactctctttatttttttatttattttttattttttagacagagtctcactctcgcccaggctgaagtcagtggcgcaatctcagctcactgcaacctccgtctcccaggttgaagcgattctcctgcctcagcctcctgagtagctaggattacaggcgtgtgccaccatgcctggttaatgttttctatctttagtagagatggggtttcaccatgttagccaggatggtctcgatctcctgccctgtgatttgcctgcctcggcctcccaaagtgctgcgattacaggcgtgagccaccgtgcccagcctcttttttttttttttttaagacggagtctttctctgtcgcccaggctggagtgcagtggcgctatcggctcactgcaaactccgcctcctgggttcaagcgattctcctgcctcagcctcctgagtagctgagattacaggcgttaacggtgttataccatgttagccaggctggtctcaaactcctgacctcaggtgatctacccaccttgtcctcccaaagtgctgggattacaggcatgagccaccacacctggccaccttcctctttttattagctcctgcctagtacaatgcctgaaacatagtaggtgctcaagtagtttgatggatgagtaactgtatgcgtgtcacccttgcctatcctcttgctttctcattacgttattgtgtacagtgttcttcctttctttccttcctctccagttaggttggagctttttcaattcttagaatataccaagtttactccctaccttaaggccttcacatttgttgtctcaacctgaatgctcttacattagatacagtatggtttgctcctttatttctttcatatttctcttcatataccttgtccccagaaacacctttcctgacaaccttgtctagattaacagctctcatttctttctagcttcttgcctgccttgttttcttcatttatgtatcactctacctgataggtatttgctttttgactgactccaccaatagaatgtaggttccataagataagggctttgtttacttctgctttatcctcagcacttgtacctggcacatcgtaggcccttaaatatgtctcatgaatgaataccttcttggtaattgtagtcactgcaattgtatgcctgtctgcctagcacatcagttgccaactgctttccctaactgcaaaggccgattttttaaaagttttgacttctaatattgagctgttggccagtatcctgcttgttaatgaaactagagtctgatgtagtcatgaactaatcaggagtttcagaagcttactgtatagatgagactttgtggtcgataacttggaagcccgctgtcaagggaaagaagtctaggcctcttggtgctttcttttcaattacagaaatcacagatgaagacaacagcatagctgccatgtaccaagctgttggtgaactgccccaggccaacagggacacattagctttcctcatgattcacttgcagaggtgagtacagcagaaacttgttctgggagttagggaatttttttccaaggggaagataatgtgggttgagtgtttgggagtatgagggatgaattgttttcttatagaatttatattttggtctgcatttaagcaaggagcaagacttctaatttaatattcttttgcttagagtggctcagagtccacatactaaaatggatgttgccaatctggctaaagtctttggccctacaatagtggcccatgctgtgcccaatccagacccagtgacaatgttacaggacatcaagcgtcaacccaaggtaggcaggtgcgtgtgtgtgtgtatgtgaacttgtgtaatgtgataacttgaaagacagttgagaagccctgagctttggaagtttgctaacagatttgctggcttttaggtggttgagcgcctgctttccttgcctctggagtattggagtcagttcatgatggtggagcaagagaacattgaccccctacatgtcattgaaaactcaaatgccttttcaacaccacagacaccagatattaaaggtaaggcccaagatgtgcttcttcagggacttgactctctctttagttttagtcatat

SEQ ID NO: 69455 - DNA, 1569 bp, Homo sapiens
tgagaccatcctggctaacacagtgaaaccccatctctactaaaaatacaaaaaattagctgggcatggtggcagacgcctgtagtcccagctactcgggaggctgaggcaggagaatggcgtgaacccgggaggtggagcttgcagtcagccgatattgggccactgtactccagcgtgggcgacacagcgagactccgtctcaaaaaaaaaaaaatcagtcaggtgtggtggcgcatgcttgtaatcccagctactcagaaggctgaggcaggagaatgccttgaacctgggaggcggaggttgcagtgagccgagatcacgccactgttctccagcctgggcggtagagtgaaaaactctgtctcaaaaaaaaagtatcagactggggtcttaagtcttgactaagactaaggaattttttacctgctccaaaataccctatagtggagggtaagttagattctttgtttgtctttcctcattactacttttgttgcaggggaatgaatccatagttgcaaaaactacagtgactgttcccaatgatggcgggcccatcgaagctgtgtccactattgagactgtgccatattggaccaggagccgaaggaaaacaggtccattgaatttgtgactaaactggcctgtgtaaaacaactagcaaaattttggagagttggtttcttagaaccctctggaggcggggattggatgtattgggtagtttcttactgctgcataccgaggaccagagaactgcttgtgtcatgctttacctttgaattgctagcccactggcataactttagtttttcttgaaactgtttttttacatagccattagttctcacttttggctatgataacagattactgtttatctcccagttaaaattggagctaaaatttagaaggagcaaaatacttaagacacaaagcttaaaagttgcttgttttctaggtactttacaaccttggaacagtgactccaccctgaacagcaggcagctggagccaagaactgagacagacagtgtgggcacgccacagagtaatggagggatgcgcctgcatgactttgtttctaagacggtaaatctgtgattgttgtttgtgttttaattttttaattgtgaaagtaataaataccaggaataaagttaaatactttagtgttataaagttaaatgtcaaatttccttcctcattccaattttactctccagaagtaactattggttacagaggtaagtttctttccattctgtgagtaatactaaattaaagagaccaacttttctgaagcaattgttagtacttttttttttttaatttgagacagagtcttactctgtcacccaggctggagtgcaggggtgtaatcatagctcactgtagccttaacctcccagtctcaagcaatcctcctgcctcagcctcctgagtagtagggatacagatgtgtgccaccacgcccggctaatttttaaattttttgtagagacttggtcttgctatgttgctcaggctggtcctgaactcctgggctcaagtgctccccctgcc

SEQ ID NO: 69456 - DNA, 1013 bp, Homo sapiens
tcaaactgaagaagagagaaaagagggtatgtatgatttgtttagtctttttttaaaacaaagtaataatggagttatttttggaaattttgccatgatactgcattcctgtcatgttgctctagccattgttaagcacatactacagatgaattcatgctgtggggacagtattgatattcttttttttttttttttttcttttttttgagacggagttttgctcatttcccaggctggagtgcaatggcgcgatctcggctgaacgcaacgtccgcctcccgggttcaagcaattctcctgcgtcggcctcccaagcagctgggatacaggtgcctgccaccatgcctggctaatttttgtatttttagtagaaacggggtttcaccatgttggccaggctggtcttgaactcctgacctcaggtgatccacctgcctcggcctcccaaagtgctgggattacaggcgtgagccactgctcccaaccagtactggtactctttgaagtagtaacttaggacagaatcctgtccatttcactgtttaggctgcatttcaattcattcatacagtggaaaaggataaacttaagtttgttttgaattgtcatatgaatttttacacagaacttttgtgctctaatataagcttcatataatgggatatatagagatctatctgtgtatgcttgtttagggtacttaatgtgtttccaagacttcatgtccttagttaggattacagctgtactttttctggtggtgtcatctaaatttctccatagcttgctcattttttctagggcactgagagcatttttgtacaacatattcttttgaaacagcttattcttcatgtggaaataggcaaagagagagagagagagaacacattgtttgttatttactgtagccctaatccccaggacctgtatccaagttgtttgatggaataattttatcttctgtgcttcagatctgcttggcattaaagttacgggtctttgtctcc

SEQ ID NO: 69457 - DNA, 1461 bp, Homo sapiens
taaactcaaattgtctggttccagtgcattatagctttgtatccattttaatgcattttgctccactactttgagaggtgggtggctgctttgatccgtagaagccaatatttgtcctgataaaatgacactaaagtgtttttgctatgtgaaatctattttgggactctcattttgcattattctcctcttggattagcaggttaatccaaaagtcttgtagcagaaacttcgctgttctagatgtagttcattttaccagtcagaaatcagagacacaatctgggtttgatgtgaattaatatgctattggtgtagcagccttcctgaaggtccatttgcataatgctgcattttaatgtcttctggtctgcctgtcccataaacttgaggtgaagctttctcccctggctagttatgatgttttactttgctttggtctgtaggaacgacagattcagctgattcgagagatgctcatgtgtgacacatctggcagcattcaactaagcgaggagcaaaaatcagctctggcttttctcaacagaggccaaccatccagcagcaatgctgggaacaaaaggtggaggaactgcatctgttgttatcctatcacaagcaacacaggctgtcagatattcttgttatctgaattcttaaatatacttcttctagaatgtgtgctgaaaaaagcagaaaaagattttgtggggagagtaggtggggaataaaggcacagggatgtccctgtatattttattttattttatttttaaatctttcctaaggatgttgtttcaccatggatacaattttgatgttggtgctaaattgcacatcaataactaatcctgtgcattgctaagaaacccaaaggtgaaagtggcagttcagcaatactttcagtgtttactctccagagagctcttacagctcttctggtttagaaaggcctctgtgagccaagaccagacaataattttggttccactgcaccactgtttaaaatagtctcaaccaggctttgaatttaacatccccagtacaatatgtagggaaaggtcagctatttattttgttgcctggttgttttatggggaatctttataactaagaagatgtacaggcttaatttcttaaaaagtcagtgttgggtaatactcttgtttgtagaaaccagcacagttgggatcaaattaaacttcattcccttgattttgtgaatttggagtagcctgtaatacaaactcggtagagaatagcacccataaccctgactaactttcaactgcccttataaggtctttgctgaaaaagcaactgtgttgcacctgtactcatgcacacacactcctccgtggaaaccatacaaagtagcctaccacagggtttgagattgtaattgtctctatagtgaagattttgctatgaaattaactgatgttacctgaccagtaggac

SEQ ID NO: 69458 - DNA, 1056 bp, Homo sapiens
cgtgactgtaaaggaaactgtttttgttttatagctgtaactgtcctggtgcatgacagctgccccaaaggtatccccctttgattgccttctgttcaggagctttcagtgttagtgttacatctggagccaggtgactaatgagttacatattccatagcagatgccactggctaagccaaaagtaagtggcctattgaataggaattgctacccacaaagttctcatcagagtgacaaacatatccaggatctgctcctagttattttcagctggatttgcccatagttcagctggttccttaattatgaatttcaaataaagctaaccgtaggactcatttattagagcagttatactctgtttggtgcttgaattattaaagattccccctttcctcagaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggtgtgtattgttttccgtgctagaacagtgatgatgcaggagggggaaggcattgtctgacagtttccacttgccaaatatacctagtttcttcttccacattaaagaactgaaagtgacctgttctttaacagcttgcccatgattagagctgaaattgcagactaggaatcttgttcttcataatttgaaatttaaatgtttttgtcacttagacttgaaacttacttaacagacagatttcaaatgagaacttaaagaattagaggaaaagggagggagggagatcctaacgtacttgatctgtcacaagttattggccatccttcattgtttattttaagtgctacccggaatatccatccttacatgagtagctggtactttgtcatacatacaggcaagacaactgtgactcttcttttcatcacccctctctaattcagggta

SEQ ID NO: 69459 - DNA, 1050 bp, Homo sapiens
ctgaccatgtcctgcattttaaaaggcagttgcaacaggggcattagctaaaaatgaaattaaaaatagatattttaagttacattgtaggtcttcaaagcccacaaggaataaactggcaaaattattatattaatcaataggcttgacttgaagaaccacattttcttgttggtcagtcacttgctaatgaactgacatgctctttcctatttgttttctgctccaagtgattggaggggctgttatattcaaaggtctgaaatggttttctaattttcagatgagtcttaaacattccaagtttgtttttataataagaatcacacaaaacatctgttgttagcttgagattcttataatggtagttataaatggaagagtccagatgttggtcactaatggctggattgctatagaatcttttgttgtgggcgagaaggcaggacccctaatgtatatttgatttcttggcagaaagatggatactatgatgctgaatgtgcggaatctgtttgagcagcttgtgcgccgggtggagattctcagtgaaggaaatgaagtccgtaagtcattctgagctggcctgtccaaaggaaaaacagatttcaaatttgggatttttacaaagctgaagtattttccaatcttaaagttgttttccatttgggttacctaaaaagaaagcagtgatcacttacgtggtcaaagcctaatgggcactcattctaaatggtcactaaaattcttttctatagctgctcttaataggttttagccaggcttttttattatctttatttatttatttttttgagatggagtctctctctgtcacccaggctggagtgcagtggcgacatctcggctcactgcaacctctgctccccgggttcaagcgattccttgtctcagcctctcgagtagcagggattacagacacacgccaccacgcccggctaattttttgtatttttagtagagacgggattttgccatgttgcacaggctattcttgaacttctgacctcaggtgatccgcccgcctcg

SEQ ID NO: 69460 - DNA, 1066 bp, Homo sapiens
tctcagtcacccttcctagctcctctctcaccctcagcggatgaccttggctaccacttacttcactgagaaaatagaagcctcagacaagatcttgtccttcttctgggtaccaagccctagaagggaacattcatcttatctaggataaagtctcaacctagaattttcatcttattccctctgcctttttaagatctttctcctgctaattctgtctctccctgctctacagttggtcgctctttctcaagtgaaaccccattgacaatgaaacatgctgaagatgctcttgtcttaaaatacatagctgtaacgacagctaacatatattgagaacttgctatgtatcggtctttgtgctaagataaaaactaaaacatgtgtctctcaactccacagcacctgccagctcctatagtatctctctgcttccctttacaaagttcctaaaagtgatatgtttatttcactgtttctatttcctcatctctaactcactttctgatccactccaggctgccttcttcccccatcatcaccattcctcctaaatggttctagctaaggccagtggtcaccttcatgttgccgaatccagcaaatattttttttattattcttgatctctcaatagcatttaaaatagttgcccaccaactcttctgctgttgttttttttttttttttgagacggagttttgctcttgttgctcaggctggagtgcagtggcaccatctcagctcactgcaacctccgcctcctgggttcaagcaattctcctgcctcagcctcctgagtagctggattacagatgcgtgccaccatgcgcggctatttttttgttgttgttgtatttttcgtagagacgggttttctccatgttggtcaggctggtcttgagctcccgacctcaggtgatccgcctgtctcggcctcccggagtgctgggattacaggcgtgagccactgcgcccggaccccaccacctcttttttgaactattcgctttcctgacaatcatactctctttgttttcctcctatgtctacccactcctctgtc

SEQ ID NO: 69461 - DNA, 1015 bp, Homo sapiens
tgccagttcattttcttctacttggccatttagtgtcatcactactcaaggctcagtctcaagctttaatcttcttttaaatcataagagtacaatgcaccagcttgaaaaatttttacactggtatgtcttacagtgtagtattttgcatattgcattggtataaaacatttccagtaccccagaaagttccttcaggctgtttcctagtcaatgctaccccataagagttaaccactgttctaacagtatagatcaatttccctcattcttgaacttcttggagtatatgtatcctccatacagtgtatactcttttgtgtctgtttgttttgttttgttttgcttgtgattacgtctgtgagatttagccatgttgttgtgtgtggaagtggttagttcttttttgatgctgtatagtatctcattatatgaatatgccacaattgatccattctactgatgctagacatttgggttgttactagtttttggctcttatctataaagctactatgaacatttttgttcatgttttttggttgatatatgcactcatttctcctgggcacatgactagctatggagctatggttaagtcatagggtatgattctgtttagctttagtggatactgccaaatcagacctttttttctatcttttttttaaactttatattctattcttgggcagtctcatcttcactcatcacttcaattaccatctacacactgacaactgccaaatttatgtctcagcccagctctctcctcttagcatcagctccagtcgccaattttcccacttaacgtctctacttggatgtccctaagactcctcaaaacctgcatgtgcaaaaccaaagtcatcatcttacctcccaaactagttctttacctgtgtgcctgatctagtgagccacccactgttcaccccgtcatgcaaaccagaaatcatccctgacactccatctccctcacctgccttgacaggatctgccaattttgcctcat

SEQ ID NO: 69462 - DNA, 1810 bp, Homo sapiens
gatggggtttagcaggtgaaaccatgacatctctgggtcctctcccctctgtagagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaagtaagatgatcctggggcagagggagggagggagggagcctgggaggacacaggtggtgggagtacctgaaccaagaagtggtggtgctgtgtcagcagatggtgctacagaactcatccttgagaatgcttggtggtggtggtggtggtggtagttctttgagagaagctttgcagtcccttcacattactataaatggacgtgctgacagcttattttcacgttctgactagttctgtcccaacctgataatagtatttattcccaacagtgcaaagaaaaagaagatggctgacaaaattctacctcaaagggtgagtccaggctatatgtcttctggaaagtgtggtgagtttgagtatagagatgatcatcctagatttcaattaatttttctgttcctaagattcgtgaactggtaccagaatcccaggcctatatggatctcttggcttttgaaaggaaactggaccagactatcatgaggaaacggctagatatccaagaggccttgaaacgtcccatcaaggtaacacaggaaagtactaggcagagagccaaaggagaggacccaggaaccttcagcagaattaggatgagaaatcaaaggcacagcacaactctccttggcatttaaattgcatctctcccttccgcctacaaactgagaattacattaggaggataagaacagaatggcaaagggggaggggctcttgatgtctcttgcactacaaatatacccttgtccatgttttcgctgtaactgctctgctaccttgggaacctggcaccttgcatgactttgtccacctggcatcccactatatgcacttgtacttaggctgatggccagtactcctcttctaaatggaatcttcatccacccacccaagggactgggtagacagtaagccagtctgttaggagtaattttggggtttggggagaccgttgtcttcaacatcagaccactgaagccccacgatcaatcctgtttctgccttcctcagcaaaaacggaagctgcgaattttcatttctaacactttcaatccggctaagtcagatgccgaggatggggaagggacggtggcttcctgggagcttcgggtagaaggacggctcctggaggatgtgagttcaaggtccacaatggttggcatctagggtgggagctgctgggaatgaacagtgttgtctggtcagcaggaagcctaactggtgctcacagctccttttgggagcagtaaggagagggacactgttccctgcactgaaagacagtggtcctttgtgtttgcccccacacctttggccctcactggtatcatatggagaaccttattgtcctgggatctgatttgtggtttaccttcctcttggtgctgctggccattggatttagccatatctgtagattatttagttttttttttttaatcgagtttgcacttaatttgaggctgtgtttcctctctgagtccttgtggtatctccatcttctcaactttcactggaggcaccccacagtttaagtaggatagatttctcttgacaggctcttt

SEQ ID NO: 69463 - DNA, 1115 bp, Homo sapiens
gtttgcacattgacctctaggtggcactagcatgtttagttaggaccaagggctcttgtaacctaacttgtcccatctttttaatgttactatcctggtcactgccacctctttcaagggaaagtctactggtggcctcttgtatgtgccaggccatctctgtatcttgcttgttaataatggtgagatgtagttatccatttttcctggcagcagttgctgtaattagagtgattgactgatagggtactagtacttgccaaggttaccattatagatctgggacttcctcttggtctctgctctgtttacatttacattccaattcaccaaaaatcctttattatgatgcctgattgcacaacgttttgaagcccatgttagcaacagtattctttgggaaacaggcaaaaccagaatgacagtccagccagcactccaagtgaacctaacctgctcctttctttgccagtgtagctgcagccccttaacctcaaccactaagagacatggggaggtctttaccatctaataagggaagtaagtcatagaatcaatagaaacttgtaaatatatttaattttatagcagtagagtatagtggctaagaatgtggactgtagaatcagacacatcagagctcaaatggtggctccgccacttactggctgtttgacctaggcaagttactttattatgctgagcattagttttctcatctgtaaaataagtataattgtgcctatcttgtatagatgttcgggaagtgagataatccaggtaaatgtcttagaatactgtcacacatagtaagtactcagtaaatgatagctatgttactgttcacatgtgtattatccattttgtggataaaattatcactggacattgaggcttatttaaatcaaccacaaacaattaaaaggttaatctacttatacacagacagtaatcccaaagccatatgcagttttttaaaatgcctcatgctattactcttctccagtagcctcagtaatcaaagttgaatattcagtcattacagaagctcttccctcccaccccagctcttcctctgggagagcaccccctgacatcttcctctctgtagtggc

SEQ ID NO: 69464 - DNA, 1093 bp, Homo sapiens
tacaggcgtgagctaccacgtccggctagtttttagtagaaatggggtttcaccatgttcctgacctcaggtgatcgcccaccttggcctcccaaagtgctgggattacaggcataagccaccacgcctggctgccaaatattttttttaaagggagaaagatatataggagactgtagcagtgatttcctctggagagaaaggaactacttttcacaggataccttttgtactgcttgaatttttaccattgactttttaaataaatcaactttattgaagtataatttatatataacaaattataccaattgaaagtgtagtttgaagatttttgccagatctgtacaccatgtagctgccacaataaagtgtagaacatttctgtcacacccgaaagttctcgggcccttttacagttagccccttttctcttcatcctgggtcatctttttgaccctgtgtaattaggtcttaggggacaagctctttaccaggctcctttggtttcctgtccagtgttgacccgaatgatcagaaaaagacagcttgttatgacattgatgttgaagtggatgacaccttgaagacccagatgaattcttttctgctgtccactgccagccaacaggagattgctactctagacaacaaggtaggggtctgtgccctggatagttgggtaccaccagcccctatcacagcttcaaggcctccttttgattcttagtgttcattcaaaatacggtgacacccagtatatgtcaggtactgtgcttggtgctggtttgagccagactcaaatgaattctgattgtggggatactctcaacagcactgagcctcggtttctgatttgtggaatagagaccatagtaccttttttttccttttttcttttcaggagtctcgctctctcgcccaggctggagtgcagtggtgcaatcccgcctcacggcaacctccacttcctgggttcaagcgattctcctgcctcagcctcccaagtagctgggattacagtcacccaccatcacacccggctgatttttgtatttttagtagagacgaggtttcaccatgttggccaggc

SEQ ID NO: 69465 - DNA, 1058 bp, Homo sapiens
agagagacagaaacaagggcaaattacttgctgaaagaatgccaagggtcggagcagttggagctctatatgatggtgccagctgtgggcagcatggtgactaggttggaagtggcatgtggagttgtcaggcaccacctgccatttaacttctcatttttctagtttgaaaatggtatgagcttcgttcttcctttcagatccatgagacaatagaaaccatcaaccagctgaagactcagcgggagttcatgctgagctttgccagagaccctcagggtttcatcaatgactggcttcagtcccagtgcagggacctcaaggtaaagaacctaggagaggtctgaagggacttaggtcagtgaggtgcacagctgctttattcatgtagcagctggtaggagacccagaggaaggagtgaggggccagatttttctttagcatgttccagggtccattttgcaattaagcagggaaatgggggcagagccatcaagtgttgatttagtgcttactttgtctgtcactgtgcttcatcttgtcagggatacagagtggaagacctgatctctgctttcaaagcagcctacattctgtctgaagaaactaggctagtatagccgggcatggtggctcacacctgtaatcccagcactttgggaggccgaggccgacggatcgcttgaggtcaggagtttgagaccagcctggccaacatggcgaaaccccgtctccactaaaaatacaaaaacttagctgggcgtggtggtgcgcgcctgtaatcccagctacttgggaggctaaggcaggagaattgcttgaacccaggaagcagaggttgcagtgagccaagatcgtgccgctgcactccagcctgggtgacagagcgaaactctgtctcaaaaaaaagaaactaggctagtatgatacaaagtagtaaaccacataagacattatcaggccaggtgcggtggctcacgcctgtaatcccagcactttgggaggctgaggagggcagatcacctgaggtcaggagtttgagactagcctggccaac

SEQ ID NO: 69466 - DNA, 1252 bp, Homo sapiens
catctctactaaaataaaaaaatcagccaggcgtggtggcgggtgcctgtaatcccagctacccaggaggctgaggcaggagaatcgcttgaacctgggaggtagaggctgcagtgagccgagattgcgccactgcactcccagcctggctgacagagtgagactccatctcaaaaaaaaaaaaaaaaaaaaagacattattagactgaccaggaccaataagatgattcagataagggagatcagtgagactagaatctctggggaaggcttcatggaaaatttgggatttgaagacgttcccagaaaggggagcacagtaagctcagacaagaagataggaatgggcacagagtatgaactcatccgttgtcacccctcctgtgctgactgtgacgagttagagaggctgagcagaggagcaaggaaaaagggatgccaggaaagatccctgaacaaggcaacgacttgttgattgcagaggtgactgggtgttgtatcagtttgctgaggctgctgtagcaaactaccacaaactgggcagtttcaaacaacaggcttgtctcacagttgtggaggctggaagtccaaaatcagtgtgggcagcactgcttccttccgcgagctgggagggagactctgttctgtgcatctctcagcttctggtacctcaggcattccttggcttgtaggtggtggtctctgtgtgacttcacgttgtcttccttctgtatgtgtctgtctccatgtctaaatttcccctctttataagggaacctaccggtcatattagggggtactctaatgacctcatcttaacttgagcatctgtagagaccctatttccaaataaggtcacattcacaggtactaggggttggttagacttcaacattttggggaaggatacaatttacccaataatgggtgtgaaggaaggaaacaagccttttctcctctctcttcctccaccctgcatctccatttccctcagacaatgactgatgtggtgggtaacccagaggaggagcgccgagctgagttctacttccagccctgggctcaggaggctgtgtgccgatacttctactccaaggtaagtacatggggtgcacgggggaaattgacaaaaggcacggggttttcacccctgatgggggtcagtggtgttagataccaacttctggtttgtctcatcttccactcccttcactattttctccttaggtgcagcagagacgacaagaattag

SEQ ID NO: 69467 - DNA, 1610 bp, Homo sapiens
caggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaaggatgggtcctcctacctactgtgagagagctcttccctgagctcttcttccttcaataccattagccacgcttgtagtgtttgttcattttatttgacaagtatttattgagcacctgctatgtgctagttgtgatgctagacacgggagataaagtggaaaatgagatttctacttttgtggacctcagggtcttaccttaagagattgctgtctgccccagtggtccaagcagcctagttgctggttgggattattgggcttcaccactggatcttaagagccctttcccgacttgctaggcaggtactaacaggttggtggcagtcattttcccccttgtccatctgagctccccagagcacttgttggctggagtgagccatagatgcccgtgatcccttaggtttgacgaacctgagccgcctttggaggagtttcacttcttcc

SEQ ID NO: 69468 - DNA, 1030 bp, Homo sapiens
ggtgggagggtggacttcagcccaggaggttgaagctgcaatgagtcatactcacaccactgcactccagcctgggcaacagagtgagaacctgtctcaaaacaaaacaaaccccagcagtccaggctggtccatgccagtcacttctgtccacaggcatggaaggccaaatgttggctttgatgacattcagagacacctggttccaggcttgtttctgtatcttgtaggcacattttatttgcccttttgaatcatagagttcctaaatgatatcttccagtatccctatgagactttacctagacataggggccattcagtatagagtgcagacagaccaagcaggatgcagaagttatggaatggcgttaaacagggagatgggctgggcagatgaggccttatcctcaggtctaaattcaatctgtctttgtaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtgtctgtgtcttggtgttttttgtttacccaaatagcatatggaccacaaaaggggagccttgactaccagttttctgggtatagactggattaccatatcttgagctcttagcacccatgaagtgggtgatgtacagctccaggagtagtatctgccctcatgatcttagaggaaa

SEQ ID NO: 69469 - DNA, 1028 bp, Homo sapiens
agtgggaaactactaaaaaaggcctgttatggatcagctttggggataaagcaaaacagcataaccaatacgaataaatgcattgtccacaaccaccagaagatagaagcattgctgacagtcatacgtattgttcgtgttggccttccctgttctttgaagtggaagaagagaaagggtgtctgaaacctaaaccaggtctcagtgaatgatgtcagttctcttaggctggtcctgaaagacacactcctctaccaaagtagcttcaattccacagagaacagaattggagatgacaagggagaaaactagaaagcaggtaaagcatagtcacaacagtagccatagtccagacaatacttctttgagttagatgtcatcagaaagcagaccagactgggaacacagtgcccacacctgggtctctgagcttaggtgtcttacagttctttcctcacttttctgtctttggtctcatcccacccaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcc

SEQ ID NO: 69470 - DNA, 1056 bp, Homo sapiens
tagtcaaagggctagggatttcagcctaaaggaatacagaatcccaagtgggaggggctctgcttgagcaggtactgatactaggaccaagtgatggaatgtggcctagatattgatgatctcctgcatcattattccttatagctgccattggctcagaacttgctcagtgtgcctgtgcatcttgctgtagctactggacatctctgttctctcctgcttttctttcctgactaggtgacctgtccaggaaggattagaccctgtactctccactctttcctcacctccttccttttttctatgcctggcgggagctggacagtttcatctcttgcatgtaagtgtatctgtgcttctagtattcagtgaggcatgtccatctgaatgtggttctctttcctcctgctctcctttctgttcccttgtgtttgtctcagagcatgccctctctcctgacttttcggggccattattgactagagctgcagttgccagattttttcctaaactgaggcaagaattgagtctacttttttttgtttttcttgagtctctgtttacctcaaatctagagacactctgccctctagtggaaatttcctaaaggtcaggtaatcagttagtcatctaagttcagaggccaacagctataatcaactgtagaagacccatccaacacaaattcaaggagctgatccaaagcaaatgcccacctccttggcaacagttgttacagctgtgttccttttcacttccttctctcctttacttaaaccacatttattatccttcagttctggaggtcagaagtccgacacaggtctcactggatttctgttctttactattagagtccagggtaattttttttttttaatttttatttatttatttttgagacagagtttagctcttgttgcccaggctggagtgcaatggcgtgatcttggctcactgcaacctctgcctgcccagttcaagcgagtctcctgcctcagcctcctgagtagctgggattacaggcatacgccaccacgcctggctaattttttt

SEQ ID NO: 69471 - DNA, 1157 bp, Homo sapiens
agatggtgcgtttccttgggattgagggattagggactgagtccctttaagtcatattcagggtatctatttttttttcccccccactgctaagagtcatatgaggtatctattcctgaggcccccatagcaatgaaatccaatgagttttttgttctgattttccccatttaattccccctaattgggctaaaagaaaagcaagtttctggtatttaatgaggtactttctggttcaggtgtcttttttgtatcaagggtaacttggaatcccagtagagcatcttggttgtaacctatactggaaatatgtctaggaactgctaaaggggtggaagagaaggcctatgtgtatttaatcctgtgaaaagcactaattgcccagaatcctagacatactgatttgattgtgttacagtatgtgttaactgtatctcatctctgcaagatgagagctgaagatgtgtgtgcagaggagcaagggaagaggcttaagtctctacaccaatccaaagtctgttagctattgcatatcttggcagataatggggaggagagatgtctaataatttggggtattggtcctccaaggcagagaaagttggagagatggaatgcacctttgactagccggtaatctaactacttctttctctcttccagcctctttcaagtgggctttatcactattatatcatggaattggccttctattggtcccttatgttttctcagtttacagacattaaaagaaaggtaaggacgttggctccctcaattccccaacttattacatcctcctttctagcagcttccatgactgccattacgatgtattatcttccctgagactgcaaaaggagaaactgggtttgatggactcttagcttgtcgtaatgttcccagaaatgagactgaattaatgatgaagtatatttaagacattcagggaagccccaggatgagaacaattaaccagctaagaagcatacttttttccatattcttctttaagcttcttacatatctaaagctcaggaaactagtcagaattgggggatagcaatgccttattcagaaaaaatgtctgattccagaaaagctggatatggctttcacatggcattagggacccttgctctctctgttctcccttt

SEQ ID NO: 69472 - DNA, 1032 bp, Homo sapiens
cttttttttttttttttttgagacggagtcttgctctgtcaccagactggagtgtagtggcacagtctctgctcactgcaacctccgcctcccatgtccaagcgattctcctgcctcagcctcctgagtagctgggactacaggtgcacgccaccatgcccagctaatttttgtattcgtagagacaaggtttcactatgttggctaggatagtctcgatctcttgacctggtgatgcacctgcctcggcctcccaaagtgctgggattacaggtgtgagccaccactcctggcccctgtctttggctttttaaatgacagtagttgcctattctaggaattgatcctctttctcaccagtaactcttatccccaaatttgctatcttgacttccgtagcctcagaggctttggtttgagtggacatttgtctaacctttactctttgcccacccaggtggagattcacattttatttatgtatattctgctatggaattagatttctctggtcggtgagtcttaactttctctagtcctctgttgggttctaatcatgcctagatctctagaagtaagagttaaatacctttagatttttttcttttctttttttttttttttttttgagacggagtcttgctctgtcacccaagctggagtgcagttgtggaatctcagctcacttgcaacctctgcctgttgggttcaagagattctcttgcctcagcctcccgagtagctgggactacaggtgcacatcaccatacctggctaatttttgtatttttagtagagacggggtttcaccatgttggccaggctggtcttgaactcctgacctcaggtgatccacccgccttggcctcccaaagtgccaggatttcaggcatgagccactgagcctggcctaaatacctttagatctttatatttcccccaacttttcctctgtgatgcccacagcccaggtttatatcctaatagattgtcttctgtctggggcctgacttcagtaactttataacttta

SEQ ID NO: 69473 - DNA, 1050 bp, Homo sapiens
ttaatcacctcctttgtgccagggtctttcatatacattatctcactgaattacttacaagattcttatgaagtagattagtggttctcacattttaatggacatgtgaatcacctggggatcttgttaaaatgcagattctgattttgcaagtctgagatgggctcaagattatgcatctctaaaaagcttccagccagcacagtggcccacgcctgtaatcccagcattttgggagactgaggctggtgaacattgtcaccctaaagaagtgataaatgttgaaagtgatggatatggtaattaccccagtttcatcattatactatgtatacatgcattgaaacatcacattgtaccccataaatatgtacaattattatgtgtcaactataaataaaatttttttaaaaagaattggcccgtgggttttctccattacagatttattgccaaaccctgtgcactctgtattggcatcgaggacagtggtccttatcaggcccaacccaatgccatccttgaaaaggtgttcatatctattaccaaggtaagtgggcaaagaaacagagaggaatattcacataaggcgttgctccatggggcaggggaggatagagagcacgtacctctaagggtaaggataggatgggatggtccttcatatttgagtagtccatgtagctatatggagagctttatcccctcagggaaaacctttgggccctacgtatgtcaagtttacgtacgtagtaggtttgagttttaggcccagcagccacccttacccctctttccccagacacataccatatctggtttttgtttttccttgttccagtttctgtcactgcctagttgtgtgatcgagatggagacagtactgatagcctttgcagtttgggttttttgttttttggagagacaaggttttgccatgttgcccaggctggtctcggactcctgggctcaagccatccttcggccctcagccttcaaaaatcccaggattacaggcatgagccaccatgcctggcctgcaatttgggt

SEQ ID NO: 69474 - DNA, 1050 bp, Homo sapiens
ggtggtagcctagatggagaaggagtttggggcgtgggcaagagaaagagtgagggtctaggggaatgctgggccccttcaatgttagatccggagttggattgggggggtcatataggcctcctcccaacctccaagggtcctacagatgaggaaacaggttcagtgtgagctctggcagaggccccgaagagagggataggaaggggccaggagaaccagagctagttgtgaccatggaagccgaggggtcaacgcaagggccagacgttccaagggaaaggaatggactcatcagactcttaagatttgttaggacgcttgagtttccgagaattggggggaacaggattagtttggccctaagagttggtttggtatgtcaactcatgcacgtttgttggtaggagggtagaaatctggttgggatagggtgtggtggagccctaggcttccaaagtaatggaaagatgtcagattagttgcagaacaggccttggggcctgaaatggaaggaggagtgtgttcgaagggatggaggagagccacagggctttatcagaggacagctatattgagccagattcttttttcttttcttttttttttttttttttttgagacagagtttcgctcttgttgcccaggctggcgtgcaatggcacgatctcggcttaccgcgacctccgcctcccctgttgaagcgattctcctgcctcagcctcccgagtagctggaattacaggcacgcgccaccacgcccggctactttttgtatttttagtagagacggggtttcgccatgttggccaggctggtctgtaactcctgacctcaagtgatccgcccgcctctgcctcccaaagtgctgggattacaggcgtgagccaccgcacccggccttgagccagcttctaaatgagtttagcagaattgcagtatactttgttcaaccacatgatttcacctttaagtgaatggatcatatgtttgtccaagataaagatattcactgaggctttggtgtgtgatattataatgtgaatttat

SEQ ID NO: 69475 - DNA, 3191 bp, Homo sapiens
ttttttttttttaagacagtctcgctctatcacagtggcacaatctcagctcactgcaacctctgcctcccgggttcaagtgattctcccacttcagcttcccaagtagctgagactacaggcatgtgccaccacacccagctaatttttaaattttttgtagagatgaattctcactatgttggccgggctggtctcaaactcctgggctcaagcgatcctctcaccctggcctcccaaagcgctgggattacaggcatgagccactgcacccaacccgtgctttgtgttatgataagaaaacaaatgtgctaaaatgggggtaaggaattcctggtcactgaagggcttttaaagatctttttcttacttggcatcttctgaaaatactggaattgccagattttagcctcctggtataagtgagaatgtgaagatttgctaagtttatgctttttttcttttaatgacagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaatgtttctcttccattattttcttacgttattactgtctctcaggatctacttttgcagtttgggaagaaaaaaatggtaccacttttttaagttttagttgaatagaagcattatcaatacatctcaccactagatggtagtgttgggctgatcttggatttcaatcctccctgaaggaagacaaatttttctggaaaattgcaggcaacttggcaagagaattaatgtgtgcattcaaaatgaggtattttaccaattcgaaatctagtggtggtttttattgtttataacactcaacattgaataattcaccttacaattatgcctagcatgctgaatggatttccaaatgtctctgctgaaaatggacttgtttttcactttaggcagatgctttttttttttttttttttttgtagaccgagtc

SEQ ID NO: 69476 - DNA, 1063 bp, Homo sapiens
agcagagcagaataaaaggggctttactgaaatgtctttcctaattcccaaagccaaatgctcttcctctccttgaaatttatcccctttagaatctgtcttgtgtttacttggcacttgaatcaaacttctttcttctgtgtgtgataacattttctcctaatccctgcactcccccccccgaccccttcccccatcccctgctcctaacattttttatgtgggtcgtgacttgtctaagccattctttgtaatccagacgtagctccacctatccttggtggctgctacatttagagcagccacacagtttgggaagggaatatcaagagagcctcttggctttaaagagtcagctgatagaattgtagcaggtttagtgctccatgagaattgactgaccagctaagggagcccttagacaaagtaaattctagggtccatctcaagacagtgctaactcatcgctgcccatgctaaagttgtctttttgtttttcctagaagtttcaggcacctgcaagagagacctgcgtggaatgtcagaagacagtctatccaatggagcgtctcttggccaaccagcaggtgtttcacatcagctgcttccgttgctcctattgcaacaacaaactcaggtaagtcagcccaaaacaagccatctgtctataactggaactctagagggagtctttggcttttagagcactggtgctaaaagctactgtgctaatgatattctgttgaaggctcttgaataaagtaaaaagcatcatttagtgacaagtctttcataccaaataatgatggtgtttggaacttcttggtgtattgatatgttaatttacatgttaggaccgaagcttaaataatatgagttgcaggtaaacccccctgtgacctaatttaatagaatgttttcccttggtatcacagaatcacaaagttaagaaatctcaagaggttacttgtttaagcccttacttgtcttaaccactgtataaatgataataatggcaataataatagcccctggagagcatgtctttttctctatgttgcct

SEQ ID NO: 69477 - DNA, 1171 bp, Homo sapiens
gggggcaattacagaaaagtggctgagagcccaggacatagaaaataaaggggaggcacagccgcagccgctgtgagttggcattttaccatgtcgggaccctcttgtctttatgaaactagaaggggcccttaggcagctgctgctgcataaaccttaaataatattgaaaagggttgatgtgagaaatgaataggaataatgggactctgataggtctggctagttagaagctcaaggttagtcaattatgtgagctagcaatctattaacttgatgttaaggaggaagacagactttttgctccatgtgggtgaaggctctattaaagagagagccgatgtgggtcaggtgtgggaggtagtaagccactaaagaattgttaatgagacactccttgtgtgggtgaaggctcataaaagctcgctctcctgagctgggatatgttccagcctcaggtagatacgagtgaggctgattttgccatgattagcagagttacttaaaaaggaaaaaaagaaaaatgtggtcttattcttggatctgagtctctgagtttcagctcagctgcagtaaagctctccagggcacgccaaatgctgtgtattcattgaaggttcctgtttgtctcttccagcttctgcctcctgctcctggtacctaatttctgctcctgccttccactttcctcctaatgtgagctcaactttcagctttctcacaggttctcctttccttctgttccctgggctgcttccccctcccacagtgtgtgcctcccctccgtgtgtttgtgatggaggagtgctctgcgtccttcagttcccctttagcagaacagtatccatctcctcttatcccatgtgaagtttctgtctcctgctgtgtctttactgaccagaatgagcacttactctcctacatctatttcaagtgttaaaaaatacagaattccgggccaggcgcagtggctcacacctgtaatcccagcactttgggaggccaaggtgggcagatcacaaggttaggagttagaaaccagcctgaccaacatggtgaaaccccatctctactaaaaatacaaaaattagccgagtgtggtggtgcacgcctgtaatcccagctactcaggaggctgaggcaggagaatcgcttgaacccggaaggtgga

SEQ ID NO: 69478 - DNA, 3164 bp, Homo sapiens
cctggccaacatggtgaaagcctgtctctactaagaatacaaaaattagctgagcatgatggcaggcacctgtaatcccagctacttgggaggctgaggcaggagaattgcttgaacccgggaggtggaggttgcagtgagccaagatcgcgccactgtactccagcctgggcaacagagctaggctcctcaatctataatctgcttttattacccaagttttaaaagtcgtcttttcctcttctatgggcaaatatatattcccataaaaataagccaaaaaatgtttattaaaaatgcaaaacttattttaggtttgttagctgacttgttttaattgactagcttgctaatgaggggctacttcactcgtttggattacccacacttctttagtgtctttctcctctagtgctcttttaagtagcagggttgtgtttcaaaagttttagcatttgagagaaactcaataaatagaatgagttttaaggtggtttgtgctgctcccaactcatgctcatatctgccgtgcttatacctctgactgtgagcatgattggtccacagataaaagttttactgcacacaaagtatgaagaggaggggacatcagggagggtttggaacaaaaggaggaaaggggagaatccaggatttaaagagtggatttaaaaggtgagcaaggtgaaaaagataaaacatgaaaattttaaaggaggcagagatttatgagaagagtaaggtttattgaaaaggaacaaaaggtaaagaaagcagaaagagaaagcaagtccaggaagaatgggcggggtcatggtgattgaatctgtacatgtgctccgcatggctgtgttctggccttgaaggttggctgatgctgccatcagcactttctttgtcagtatctggagtctcacaaagtagcaaaccccacagggttactttcctctctgacagcaatgctgcctagatgtgagtgctcaggttgtggttggggatcaagaacggctagcaaatctaacttggtgatggattctgtgtaacccaggacctggggaaatacaggaactaaaatctgttcttgtgactatttgaattctcaatgcagtcttgcatccctcgttcaactgcttggccagacttccttgtactgggtggggatccctccccactcaagttccacggggtgagcggatgagtggtgtgtgaaagggcacacctcacttaggtctcctttggcaccagggagaggaaacagaggtaaagctgtctctgtctctgcctcagacccatgcctactcctttggcactggtcactcagcagtagaatagtagtatagtagtagacggccctatctgcatagtcacacacctcgggttttgagcattgtgtaatgaccagagtaaactggcctggctgtttgcctctggtccacagctcagatgatcatggtgtacagagcctggtggaacccagttacatctccactgttatttaagggcaatttatttgctcttcctcagagttcccctttacagtctgcaggcaaatatacagatactttagtaaatgtttataggaagacctgctggcagaactggtctcatggctgcagactatgaacagaagttgtttctccactttgggaaattacatacagctaagaataaacttgttcactcagaatagatttttggatcccacacatcctggaaaaaactgtttcttagtgcctgtctgttattgaaaagaggacatctaaggtagagattcaattcatttcaaattttagcttaataaagtaaaaagaaatgatagaggtctttaaggattctgtacactttgaacactggccacagagcttacttggtaagacttggtaccaatgaagttacaggttcattctcaaaaagggtgtcgttctgagagcagagcttagtggaccctgtgagaagtatcaggcctttctacttcaagagactcagagatctcttaggctttatgtcctcccatttgaaagaaatcatcccctaaacgttcccagaggagaggatagggaaggaagaggcaaggagatgtgactggccctagggaacaactgtctgccctcactgtgtacgggacaaccaagtcccaggcctcctcacagcgttttgctgatgaatgttgagagagaacatggcactctacgtgagagggcagcacacactgcactgcccctctcggtaccctgccagctgttcctccccctgaagacacagtgggaggttttatgctggcttgcaaagctgtcaaaattatgctagaagagtgtctagaatcttttctcactcactcactattactgccttttcagaggactgtcctttcttctctgtgtagagcactctatttaagatatgaatattccccaaaatgctttcatagagtttcacagaaaattagaggaagggttaaggctgcacagggctggcccaaccatttgctgtgtggtgaagaatttcagtttcattacctagatattttacacaaattggaaggaatgaaaggcattttgtggtattctgaggaatagaggcttgacgtcaatacagaattttcatcttctttcactatgtctaaaggctagttaacatcaatgtctgttgtcagctgctcccccctacctcccacacacaccacaactggggcctttattagagtaaaaaatatatgagacaagagggtaaaagaatgtaaatgaagccatgcaaatttgttagaaaaacagctttaagtagatggtaatcaacagagggtctgtaatatccctcaaacgggaaagacagtatttatgaacatcaattatttatagattacctcattcactctagaatatcctgaagatattatctacacatttttatttgaaacaaagggaagaccatagtttgttcaaattgctgtcgtgggattaatttcatttgggttagcatctgctctcctccccaaagagtttcccttggctgtggaaatttaacattccaggacaatttagaaaatgctctcttggtttgtgagtcaggagttctgagtttgtgcagtgagcaggtctatgcagacctacccacaaaggctgagggagctgaaaagccaaagaaagaggctgacaaatccagtttct

SEQ ID NO: 69479 - DNA, 1010 bp, Homo sapiens
agttggttgggaaataagaattaggaaaattaaaaaataagaatggttcctatatttaaatactttatctttccttggagtgggttatggttatacggtgaggagctttgctctccttgatagagggctttgttttgctttgttttttgagagcagaaaaatatggtttagaagttgttttataaagggagatgatgcacacttttggcagttgagtgcagtctgtttctcgggttactctgtaattgagaggcatgttaatatcctcataaaagacattttgctgcctcttgttcaaatgctcagctgttctggtgcccgttatttcccctaggcagccagtgactgactggagtcagcaggtttttatggcattaacagcagtttgctcttttatttttaatatgactcttaatccccctctaactttttttttttttttttttttgtagatttctgcaaatgagaatagcctggcagtccgttccacccctgccgaagatgactcccgtaagcattctttcttagatctggaggatgaggttcttgttttctatctgtatttggttcaggggtgttcccattactgtcagtgctgagaaaataacatagtaaatcctctacttgaatttaagggctaatgcttgaatgtcctttacacacttcatggcttaaggagaagttaaattcaattgaatatagttaacttgggacaaactgaatacttgtaatgcttttctcattgaattcatcctactttttgcaccaaaccctttcagaattgaagctgtataaactaattttgaagtttcattttaacagaagtttggccaatacggattttattcatttataatgttattcataaatacctattctttagtgaataagtatttgaataatctgttaaagatacatattttttccctgtttatctaaatgtatattatagtcaacctcctagccaggttctagggattttcctgctgacagtgaattttgtcacctgt

SEQ ID NO: 69480 - DNA, 1022 bp, Homo sapiens
tcttggatcaaagcagacccacagaaaaatggtctcaaactgatggctacaaaatttgattcaaagaccagaacagaaaaaaatattagaatagtttattttataaaaacatcacaaatgtatgttggaataacaagacaaaatacttggcagtcatgtgttacatggtcatataatcccccataaattgcaaacatccttgcagcagtggactcaggcattagcccatgaggcacatgccatgtattaagtgagttatcttgttaaactgtcttgttttctcatcttttaaatgggagattatttcttaagaataactgactaaatatttttgaagtttttcttatatactgttaaaaaaaaaaaagaaagaaagaaattttaagagaaaaatattcccagcattgaaatatccccatctttatcccaggagcatagtttgggaaacagtcatttgggaaataatgcttgaattgtccctgtatctaaattcatgtttccttcgtcattgtcttcatgctgatttgaaactggaactctgaactgaactggaagattagaacattttaattatagcctaaaaggacattagtgcgactgtgaatcatgaagtgggtggggaagaaaggagataaagacaatacatattcttcaagcacatgctgcaggtttacaaaccctcagctgccttaaaattcgcaatgtttttcagacccttagctatccttttggctgtttgcctagcttttgttaaccaatacctaagtgttatttgaacttcagcttgttaaaaaaaaaaaaaggacatgtgcctggcgaggtggctcacgcctgtaatcctagcactttgggaggccaaggtgggcagattacctgaggtcaggagtctgagaccatcctggccaacatggtgaaaccctgctctactaaaaatacaaaaattagccgggtgtgataatgggcacctgtaatcccagctactcgggaggctgaggcaggagaatcacttaaacccaggaggc

SEQ ID NO: 69481 - DNA, 1144 bp, Homo sapiens
ttcctcaagaaggtgatgtctgagctgagtcttgaagaacgtgtggaagtaggccaagtgaatgaggggaaggttgagttagaaatagaaggctattccaggcagatacaacagagatttggaaaccagagatgatggctgaggaattacagggattgtttgtttgtttggagatggagtctcgctctgtcacccaggctggagtgcagtggcgtgatctcagctcactacaacctccatctcccaggttcaagcaattctcctgccgcagcctcccaagtaactgtgattccgggtacgtgccaccatgcctggctaattgtttgtatttttagtagagatggggtttcaccatgttggccaggctggtcttgaactcctgacctcacgtgatccacccgccttggcctcccaaagtgagggattacagctgtaagccaccgtgcttggccagaattacaggtttgctgacttggctggagcatgaggtacacataggcagcagtgagagacaggtggaaggagagggctagggtaaatctttatgtcacccttaagggtttggatgtagtggtgcagcaggagaaagccactgaaagattttaagcaaatcatatttgtgtgttatgtattaatcattagatgaatggcttaattgaaataagtaacattatttatgtcaggggaattatcatgttctctaccattgcccattgtccaattcttttagtctttcagtcaatatgataatcgaatgttaaatgagatgaggagaaagggttttcaaatctattacagtgatttaatcttaggagaaaagccattgcttctgttacacttattgacacccttgacgccattcttccaaaagacatggagatcattaaatggattaagagcaacagttctcaagcttagttggaatttgtattttttaaatttttttagagatgaggtcttgctctgtcacccaggctggagtgtagtagtgtgatcatagctcactgtagcctccaactcttgggctcaagtgatcttcctgcctcagcctcccaagtggctgggactacaggtgtgcaccaccacatctggctaatttatttttatctttattttttgtatagacagggtctcgctataattc

SEQ ID NO: 69482 - DNA, 1674 bp, Homo sapiens
ataaattgtttcctcccatgcctaaagattcacagagaacagaaaagtactagattactacattattagcagactaatggtgggaaatgtctatagtcatcgacctctatgtttattttattttattttatttttttattttgagatggagtttcactcttgttccccaggctggagtgcagtggcgtgatctcggctcactgcaacctctgcctccctgattcaagcgattctcctgcctcagcctcccaagtaactgggattacaagtgtgcaccaccacacgtggctaattttttgtatttttagtagagacaggatttcaccatgttcgccaggctggtcttgaactcctgacctcaggcgatccacccgcctcagcttcccaaagtgctgggattacaggcgtgagccactgcacccaggttctatgttgattttagatgtaatagatgagttaattgtaatattcaccccagtgtcctttgcaaggaaaaaaatgcaattatccttattccttatgacaataaaatgcatgttcttttatgttgaggctctgttttgagaagtaaaataaattatgtctttagtacaatatatgaattgtatatggaaaaacatgctttttgaaagtcccaccaaaaaggtttctttatggtatcattaaatataatttcagtttttatatgtatacatcatccctgtctctctttccaggccgggcatttatatatgtatggtcagtatattttctattattggcacttggcatctcctttcccctgctccagaatggtcttttctgataaaactcacaagctttgcattaccacaagctctgctgctagaagagtgaatcacaagaatgttgtatgcttggggtgttctgtgtgcctgtgttgatgtgtctgtattctaatgagcaatccagttttacactagcatacagatatttaactctgaggtatgtgtccacaaagctgcttttgtcatttcactagtcagtgggttttgcttgtgagagttagggggttgatttgacccgaggcttcttagaagaattttttaacattccaagtttatctaatagatgtgctatgaagagaacagaatgatgggactttaaaaaaatttttacagttatttttattttgtagaatgagctgaaagccagtggtggcgaaatcaaaattcataaaatggagcaaaaggagaatgtgcccccaggtcctgaggtctgcatcacccatcaggaaggggaaaaggtaggttgaaaagtctgatgtccagttgccaaggaagcatgtgttctaaattagatgcttgaaattagaaacaactctaactctaggctgtagagtgtctgggaatttggtaacagctgccaggacagattgccatttttgcaggtcacataatttcagttgagtagctctgcaacttatagctgaccaaataatgagccttcattggaaaattattttgctcagcagatgctcagaaggcaaagagctgaagtgattttttaaaatctatttggaggctgggcacagtggctcacgcctgtaatcccagcactttgggagggtgaggcaggtggatcacctgaggtcaggagttcgagaccagcctagcccacagggtgaaaccccatctctactaaaaatataaaaag

SEQ ID NO: 69483 - DNA, 1615 bp, Homo sapiens
gtctctactaaaaatataaaaattagctgagcatggtggcaggcgcctgtaatcccagctactcaggaggctgaggcaggagaatcacttgaacctgggaggcggaggctgcagtgagccaagatcacatcactatactccagcctgggtgacggagtgagactctgtctcaaaaaaaaaaaatctgtgtcatccacttttctgtaagtcctggaaatatatggacaaaaaggcatggtctctgcccttagtgagcttacagtgcagtagagggacagtcacccaacagtttgaccaggtaccttgagaacagaggaaagattacctaaatttatgttggcaaggtactcagacttcatagtgcttacactgagtctttgaaggaacaggcatttgtaaggcaacagaaggacaaaggaggctggctcggtagggaccagatctagaacaggacttctgtgacttactaagcacttcgagtttaatttcaggaatgagtaggaatgctgaaagaattttgaaaaggagggtaaaatagatttatatttttggataattactttgtattattggggataatggtagcatcatagagactggattggaagataatgaagaaccagttaaagaggtataatgcagtagtccaggggaaagatgatgaagacatgaactaaggcagcaatagcagaaataacatgagacggagaaaggaaacagcagattctgcatcagcacttggcagtttagaaggacatgtcattgtcatctggtatgtgaggattcccctccaataagtgttacaaagcttgctggttaggaagccatctttagcagagaatattacctatatagggttacttatttttccctgggcacctgtgaatgtgtagtgcttgatatttgtaatttaaaaaaaattctatagaatataaaatataaaatcaaatctggattttatttataaagaaggtttgcaagttgaaccttgcgtcaagatttcccattgtttctgcaaaacttatcgttgggtttcgttttccagattctccgggcccaaagccgaagtgcaagtggaaggaagatctctgaaaacagctattctctagatgacctggaaataggcccaggtaagcagagagttccatgtgtatgaggtcctttaggaagtactcactagtagtaacatcttttggactcgaagccaatgcttttaaaggaagagtggcacaaattaaaaggaagtctgcctattagatgcaagccattctcaaatctcattgctctcgataaatagctttttttttttttttttttttgagacggaagttgacgtgctcccaaagtgctgggattacaggcatgagccgtcatgcccggctgcttttttcatatttttaatccacccttgttagtggtaacctatggtaagcaaagggtactttgaggagctataagtaaagtgctacgatcagttttgcctccagtcatctggggtttgagggcttcagtagatgggctgtgtcccctatcaggtttggttaccctgtattaccagtgataacataacactttgagagtggaattatgttttaaaggggacatatacaggcac

SEQ ID NO: 69484 - DNA, 1471 bp, Homo sapiens
ctgggaggcagaggttgcagtgagctgagatcataccactgcactccatcctgggcgacagagcaagactttgtctcaaaaaaaataaaaaataaaattaaaaagatataattcattaaacattgttcttacatcaaaaggtatgatttattgtttattcttatatattttcagcttgttctcaagattataacaccactagtacaatataaggacacattccccaaagcattagcatttggttttaccatttttgtctacttaaattaatagatatgacttgttatcctttcttttttttttcttttcctaattgtaagactaacacaaagtatttgtagaatgcttgggaatacaaaaaatgtagagaaatcctaccacctggagataaatctctttctatgtgtattattttacttacattaactctctttctaagagagtccctgaagaaagaaatttttctctcaatactttaataaatcaaggctaggttttatctatgccccgatttccatgcatagttcagcaaagctccatttttccctaaaagccaaccttcctctgcccttgactttggtgagatgacagcgtccaaaggaagctgaagttgaaaggttgaaggaagtggctaagtgaggcaggggactctcagtaaattaaagtgttgagaatcagcttttaaagataattttttctgaagataggtgtagaaaagacaggaaatcctgctttgttacttatttagaacctaacttactttatttctgttttaaaaaatacagaaaaaaattctacagactactgtctaaaacttttatcctcttactagtacatcttggtgcgtttgatttatggattcacagagaatatttaagggatgttcatactaacaagagttattgtcagctgacaggaaggaggacttcagggtgggtgaggccaggcctcaggaaattccagaaagtcttaaaagtatcttgtctattctctttccttgacattagaatgattaaggctccctcaagtgtctgagtaaaaagagctaaaatgtgataaaagtctgttacagaagagtattttggtatcagaattcgtgtgtgtgtgtgtgtgtgttttgtgttcctttacttccttgagaaatattggaggaaacccctccttcttcctgtacctcagattaccacttggaaaatgtggatcataaaactcatcttaaatgcatttgagatcatttttgtttgtttgtttgtttgcttgcttttgagacagggccttgttatatcgtccaggctggagtgccggggcacaatcataggtcactacagcctcgacttcctggactcaatcatcccacttcagcctccggagtagctgggactgcaggcatcaccactatgcctggctaattttttttttttttttttaaagcagagacagggtctcaccatgttgcccaggctgatctcaa

SEQ ID NO: 69485 - DNA, 2043 bp, Homo sapiens
aatacaaaaaaaaaattagccgggcgtggtggcgggcgcctgtagtcccagctactcggaaggctgaggcaggagaatggcgtgaacccgggaggcggagcttgcagtgagccgagattgcgccactgcactccagcctgggcgacagagcgagactgcctcaaagaaaaataaataaataaataaaataaataaagcaatatattcaggtaaaatagacatatataaaataacaaaggaagtttcctttgactcatcacccttttctcttgtttgtgacctctccccgtagactcccagcccttcagcttccctctgaatttcagttcttattagcaccaggatcatgatatgtatagatagcatcaaaatgccaacaaaaacttcacttgttccaacatctttgtggtttttcttcttgtaagttcctggaagtgacacttggtattttgtttagttttgcataacactcgtacataagagtgtatatgcgctgatgtagtagaatgagtctttagagagtaaggcaaccaagctaaagtgtgatgatctctgttcatcaggtacttattcatagccaatctgtaatctgcatcaaagaaataatttatataggccttcttgatgaatgggtaggtgtccatagggaatgcccagattgttgcagaaattattcataacatcttatcttcctcttagttaataattgtatgtgttcctttatctacttaacgttaagataaaaaattttcttctgctttctgaatatgtcttatttagaattatatcccaagaagaatacaattctgaggatgttcataattgtattaattgcatagttttgtttgtttgtttgtttgctctgtcgcccaggctggagtgcagtggcacaatcccagctcactgcaacctccacctcccgggttcaagtgattctcctccctcagcctcctgagtggctgagattacaggcgcatgccaccacaccagctaatttttgtgtttttagtagagactgggtttcaccgtgtgggtcaggctggtcttgaactcctgaccttgtgatccccccaccttggcctcccaaaatgctgggattataggtgtgagccactgcgcccagccaaattgcatggttttaagttaaaattttaaagtaagtttggggaggaaaggtatttgaataactattaacatcaatgtggagtctatacagtcatctcaatgtaggggagtatatctttaatttgcctgtcagtgaatcttcacttttaccttgacctaacatttaatcttcaatagatacattgctagtgctttaaatgtggataattggttttgcatgttattgttaattgtacacaagaattgtctttgtttttctatcaatgcactttcttacatatcttggtaaaactaactttttgctgatttagcatattcacctatagtttgtagcttctcttgtcatttcaaaaatgtaaataaggctatcctcagcattattttgactgacatctatttatagtggtacatttcttgtaaagactacatatcagcataaattttttatttactcttaataactctgagtaatctcgtgtgtgtgtgtgtgtgtgtgtgtgtggtaagataataattgatccagggtaaagatgcagtcaaagaattccaatctttttaactgttccttgccctaaatgactgtccttgatgtgccagctagagaccactcatctcttcttctctgcttactttcatgtccactaactatgtactggtttttaaccagtttcattatagtaaaacatatcaacaagcaatgtcaggggactggaatattctttaagcaatgttggctatattagacttcaagggggctagaaagacttcatctccccccagtacaaatattactacctttgtcttcctgctagtgggctcattcctaaattagacaacacaggtgtgtatccagatgaatatatttacaagtcatttcctctagccttctaactcattctaactcatcagtgagttaca

SEQ ID NO: 69486 - DNA, 1090 bp, Homo sapiens
gctgtctgaaacagcagtggaccaggagcagcttggagttttaactttcattttacaaagaacaacatgtttgaatgtttcagcaggcaagttataactggcatctacttcttgttcttctagaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaaggtaagaattgggcgggtttgaaacttgagaaagccaattcaagcactaaacaaagctgtttttccaatctagctattttgagtagaggcgaatatgtggtcagtatgtcttttgattccagttagataagttaatagtctcaaatgcattatttacatagatgctaagatttgtgagtctctgacacaatttcatgttaaatcaggttcacactgggattcaaattggtatctagaaatgaagagagtttaataccgattggattatgtgtttttgtacacttgcccttttaaattgtcttcctgtgttctttatcatttgtagctttgggggtggaattactgctgaatagctctctgcttggacacagctgcagactgagtgttaaggccggagtttaacattaagactgaggcttacttgtctctgctagctgaatcccttctcttcttctcaacttcctcatctgtgccttccaacaaatgttttctatcagctaaaa

SEQ ID NO: 69487 - DNA, 2224 bp, Homo sapiens
aagataatgttatgaacattttaaagagacagttggggccaggcgcagtggctcatgcctataatcccagcactttgggaggccgaggcaggcagatcacctgaggctgggagttcgagaccagcctgaccaacatggagaaaccccgtctctactaaaaatacaaaattagccaggtatggtggcacatgcctgtaatcccagctactcaggaggctgaggcatgagaattgcttgaatccaggaggccgaggttgcagtgagccgagatcacgccattgcactccagcctgtgcaacaagagtgaacctccgtctcaaaaaaaaaaaaaaaaaaaaaaatgccaggcatgctgacatacacctgtagtcctagctactcaggaggctgaggtgggaggatcacttgagcccaggaagtcaaacagctgcagtgagctatgattacaccactgcatttcagcctgggtgacagagcgagaccccgtctctaaaaaaaaattaaaataggatcatgctgtcttataatttgctttcttcattcaaaagtatcctatgagcatcttttcatgtcaataagtatactttgatcacatgataggtatctgagaaaaacagtgtccagttaccaaggcaaagtgccactttgattgtcagggctcctgtgtggttacagtaagggcaggtgaagtcagagacctagatgactcatccattgtgtggcacgagaccttacagagccaagagtgctgctggcagttagggtagaaccagcttctggagctgttctgtaattccttcttttccagcaagaaaactttttaagcttcttatatctctgatgcatacattcttcccccaatggatcattttgtaagctaaaatttaaacactagaatcaagcagttctataatttcttttcaagccttatttctacttgatgaagtggctttcaagagtatattcagaagagtaatagggtgagagacttaattcccaaaatagctgctaatcctgtttaattcctaggttgtttgtcctttctttcttagttgaaagactggtgagtcacagactacaggagagaaggtattggagtttgcagtttgttgggaaggtggtgctgttcaatttatttaggagtacagtcctttcaaagtacgggacatttaatttaatttaatttttctttttttttttgagacagagtctcactctgtcacccggactggagtgcagtggcgcgatttgggctcactgcaacctccgcctcccaggttcaagccatttttctgcctcagcctcctgagtagctgggactacaggcgcgtgccaccacgcccagctattttttgtatttttagtagagacgtggtttcacggtgttggccgggctggccacgaactcctgacctcaggtgatccacccgcctcggcctcccaaagtgctgggattacaggcatgagccactgcgcccagccgggacatttaattttcaacaagcgtgtttcctctattatggaacaacagtgacaatttccaggttgttttcagtctgtcttacatgtataaattaattccatttttggccctagtgaaagtgaactctcttagatatgtaaatgtgtgtcctttgatcatctgagtgataagtagtggtatttgcatttgaagcctgcatattttacaaccagaggatctgtaaaacagtgaatttcttgataactgagaattttttttttttttttggttgggggatggcgtctcactttgtcacccaggctggagtgtagtggcgcagtcttggctcactgcaacctccacttcccaggttcaagcgattctcctgcctcagcctccagagtagctgggactatgggtgtgcaccactgcacccagttaatttttgtattttttttagagacagggtttctccatgttggtctggctggtctcaaactcctgaccttgtgatccgccggcctcggcctcccaaagtgctgggattacaggcgtgagccaccgtgcctggccctgataagtgagaatttatacacagataaacttgtagagaagagcagggaaaaaaaaaagattaaattcttatgaaaaataaaatttgactgctcatatgcatgtaaattatgtcagatataactaaatatttatgcaaatacttggaaagtctggggacttctccagggttctacaaattgtttcaat

SEQ ID NO: 69488 - DNA, 1002 bp, Homo sapiens
gtatacatgtgccatgttggtgtgctgcacccattaactcgtcatttacattaggtatatctcctaatgctatccctccccgctctccccaccccacaacaggcccccgtgtgtgtgatgttccccttcctgtgtccaagtgttctcattgttcaattcccacctgtgagtaagaacatgcggtgtttggttttttgtccttgcgatagtttgctgagaatgatggtttccagcttcatccatgtccctgcaaaggacatgaactcatccttttttatggctgaagagaaggctctaatcccagcactttaggaggccaaggcgggaggatcgcaggaggccgaggtgggaggattgcttgaggccaggagttcaagactagcctgggcaacctagtgagaccctgtatctctattttttaaatgtaaaaaaatagaaggaagagaatgtagaggaacaataatggcaggagcatggagaccaattaagagacaattataatgatttaggccaggtataatatggtttggactagagtagtagcagtataggtgttgagaagtggtcaggatgtatgttgaatgtagagagaaagaagaatcaagaatggcagcagtggctctgccacagtggcttgtgcctgtaatcccagaactttgggaggtcaaggcagaaggatcacttgaggtcaggagttcaagatcagcctgggcaatatagcagaccccatctctattacaaaaagtaaaaaataaaagaatagcaacaatgtttttggcccaaacacaattaaattaaaataccattaattgagatggggaagactacagtaaaagcagattagagagggagaaatagtagaagctcagttttgcacatgtaaactgtaacatgttttattaagacatccaaatggaaatgtcagtaggaacttggatactatataaaaatctagaattggaagagatccccgctgcggataaaatggacatgtgtcaaagt

SEQ ID NO: 69489 - DNA, 1048 bp, Homo sapiens
taaattccttatgtaaagaaaaggaggctggaccgcaaaaaaaaaaaaaaaaaaaaaaaaaaaaaaaaaaaaaaatctgggaaggaaagaggaacaaaattttaattacagaaattttattgtaaatgttttattttctcaaatttggatcttcaaaatggtgcccccattttgtgtccttcacattttgtgtcagaagaatgctagttgctgtaagggcctctgagaaaagtctgaggcctgaacacggaattcagaagtattgagcctcagtcttgtggcaatctaagagtacaaaatataaaagtaccagggatctaacttggaagaaagaggtggtgtagagcctttctccctgttatctactatttagcaggaacttcattacaaataaaaggtggagatatttgagtaggggtttgagaacaggattaaagacagcctttggtgtatacacctggtcttacagatgcctccatgctaaaaggacaaggctaaagatgggaactattttgatttttttttaatctatgtttctattagacactaaagggaagggaacctctgagcttatttactcaactaaccacaatgtaaataccttgccttggagaacagttggctaaatataaacctgtctgccaattggttctagttttcatatattgtattattgctgtaatatactgtagatgattatccaaggggtgtggaaacgcaagttcaaggccagttctaagttcctttttataatagctacaatccactgtatccctgaattctcacttttagggaatctcttagacagatatattagtacaagtgggaaaaatatacgtaaaaggacattccccaaagcgttatttgcaatggtgaaaaactggaaacaatccaaatgcccattaaaggaatatgggtgaattaattataatgagagaggattgtcaagattaccaaacacttccatgttgctaaatcaaagggatgtttcttggcctttatcttacatgaactctcaccactttttccctcccacatttttgcttct

SEQ ID NO: 69490 - DNA, 1751 bp, Homo sapiens
aacctgcatgttgtctcccatgcctctgcctcccgtctcaacctatcactcagaatccttctctgaaatgatgcatttggagaacctactgtttgattggagccttctgtttttccacttgtttaactcttattcccagtgaccctgtgttttgacctcaccaggacacccagccctggatgtcagtccccttcctggcctcactttcttccttgcccagctcagtcacttcagtgaggctctcacctcttccccagtgcctttctcaccactctattctgtcattgtccagcccagccagttctcattaggatttgggtcctatagtagcactaaggagagttaagaggttggaaaaggcttcatctttagggccttcttaatcttgcagagagaaagtgcagagggatctcacaggtccttctcatggtatactgggttcactgtcttttctccatgaaggctgaaaggattgcaaaactgtcaatcctgaacccattaattacaatcagtgtgccaggcaccatgctagacccttgatagaaacacatactattttggctgggcacgctggctcatgcctgtaatctcagcactttgggaggccatggcaggtggatcatttgaggtcaggagttcaagacaagcctgcccaacatggtgaaaccccatctctactaaaaatacaaaaaaatggctgggcgcaatggctcacacctgtaatcccagtactttgggaggctgaggcgggcagatcacgaggtcaggagttcaagaccagcctggccaacgtggtgaaaccctatctctactaaaaaatacaaaaattagctgggcatcgtggcccatgcctgtaatcccagctactcgggaggctgaggcaggagaattgcttaactgggacctggggggcggaggttgcagtgagccgagatcacgccactgcactccagcctgggctacagagcgagactctgtctcaaaaaataataataatacaaaaaaatacaaaaatttagctgggcggtggtggtgcgtgcctgtaatcccagctacttgggaggctgaggtggaagaatcactggagcctgggaggcggaggttgtggtgagccaagatcatgccactgcactccagcctgggcaacagagtgagactccgtctcagaaaaaaaaaaagaaatatataaaatatatactattttgaatcctaacaaaaactatatgaggaaggggctttacccctcttttatagttgagaaaactgaggtaaaggaagtaacctgctgaagttaatatttgagtttgttcctgtcacatatttttcttctgatgtgcttaacacatggaactggtttggaaagatgaatagagttatttggtaggcttggagaatgctgaagacattccagaggaaggggagcaacaggaggtaaaggcatagaagtaggacaggtggtggtatatactgaaaggagtgaaaaccagggaatcagcctggatttctgttctaggttttatactcagtggaaacacgttgctaatattacttaaggtttgtaaggttcactcactgcagcttcccaaagaagactgcaggactattttccgagatcagttgagatcaggcgcgttgagggtggtatggctgtagactacaggactattttccacaaagcatatactaatgtctgtttccaacacctagtggctttatatttatggggtttgcaaatagtgagtcctatacaa

SEQ ID NO: 69491 - DNA, 1058 bp, Homo sapiens
ccaggaaattatgtttttaacaagtatcccaggtaatttttaccttcagggaagtttaagaagcactggtagtggaagggatggacttgtggagtcaaagcagtgagcttgaagtggaatgagtcgagtctaagataggagattgaagcaaaggattatggaagctgaacacgaataaagggaataggaaagcaagcagtctgccatggaaaaatacagaagggagaaggaactggtgtaattcatttagggccagatggaagacctcggatgctctgctaaggttaggatttagtaagaaaaccagggaacgcaattggttttcatgtggggagagtgacatgatcagaccggtattttagaaaaagccttctggcaacagtgtaaagctatattagaaaggtgagagattggtaacatggagacaatttatgaggctctcttgggaacccaagtgaaagctgttgggggtcaagggggaacaggaatagagagaaagggaaggatatcagacggtgttgagatgtgattatgggacttggaaactccctgtcctgcacagaaacttctccacgttcttacccttttcaccctccttagccccacctgtctttaactaaacttggctttcccttgacatgcatgacatgcattctgtgtttgagcagtggctgcctgctctttctttttttttttttttttttgagatggagtctcactctgtcacccagactggagtgcaatagtgcaatctcagctcactgcaacctccgcctcctgggttcaagcgattctcctgcctcagcctcccgagtagctgggattacaggcacatgtcaccatgcccggctaatttttgtatttttagtagagatgggatttcatcatattggtcaggctggtcttgaactcctgacctcatgatctgcccacctcgacctcccaaagtgctgggattacaggcgtgagccaccacgcccggcctggctgcctgctccttctgcacatgcttccctgaaatattttgggggccagggttgctactcttctatatctcc

SEQ ID NO: 69492 - DNA, 1058 bp, Homo sapiens
acatttcactccaaatgtgactttggaacagacttcagttcagggaaaggccaattgatgtttgcacagtggggtcagtcataaaatggaactggaagggaccttaaaggtcatctggtgtagcctccttttataagaaaccacaacccaaagatattggatcatttgaccaaggttacacagtttgggggagaacagtggaggagtgtggtctgcaagtttagggctctaccacaccactgccaatccttggatgttggagaatcctcttctgtgtctaatgttctgactttctttattgcataggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaagtgctgatcctggtccaaaaggaccatctgtctggagcacacattgccacctgtcagggaaattggtgaaggaagtacataatgtaaaataattttattgggcgcctcgtggattttaaacactatatgaggtactgtggagaaggaggaggagggtaataatcagaagatacattctattctttgaatttttgtttagtttgtggaagaaacagttatagacacaaaaattattttaaaaaagataattatgaaataattataaagcaaaatatcagcaagtctaaaatgaataggagtgaggattaggtacagaataagagacagagcatcacagacaggagctcatcaggaaggctttctggttgagatgagtgttgaggcgagttttgatttggttgaatggtgcgttaagcactctctatacctgcactttccaatgtggtagccactatataggtggctatttcagtttaagttaattaaaattaaataacatttaaaatttagttttaaatgtttaccagctgcatttatcacttttcaagtgctcagtaactacttgttggtgactgtcgtattgaacagcacagaaacatttcatca

SEQ ID NO: 69493 - DNA, 1012 bp, Homo sapiens
ttcctgcctcagcctcccaagtcgctgggattataggcatgcgctaccactcctggctaattttgtgttttcagtagagacaggatttcaccatgttggtcaggctggtcctaaactcctgacctcagacctcaagtgatccacccacctcggcctcccaaagtgttgagattacaggcatgagccaccatgcccagcctgacccaggacttttaatgtgaaatggcagcttgagttgctggatttaaatactctctgtgttctacagttgtcaaggttattgaaagcagtacctgatgaaccatacattcaaccagatcagttatgctcttcggttgccaagagctgcaagtagtactttatttttcttttacttctggtaagctgtgaattagcagtactttattattatttttttttagttttcaagactcctggatcagaaacaaagtggtactttatatttttcactcttcaaataaggaaactgttgactcatttctaatctctcgtcttctggacaaaggttggaactcctttcctttggtaattagtggggcaaaataaccaaacgatccagattaatgggtagggactaggtgatatcaagggtatggctttatgtattctttggctgaaagggatgttggaaaatagggtttgtctcctgaacttaaagtacattatacttctccttgataaaggctttaaaatgagaattataacaagagtcaatgataataattatacttaaaatgctcttaatactactgtaatatacccagtattttaaatatattatctccttaaatctatatcaaaacctcctaaagatagatattatccttattttttagctgaagaaagtgaaatggaaaatattacataatatgttcaaggtaacaaagttaggatttccccgaagtctgtctcaccttaaagccctgctcttcctattacaccacgctgcgcccccagctctctccctggcactgagtggccagtgctgcag

SEQ ID NO: 69494 - DNA, 1158 bp, Homo sapiens
atatatgcaaagcataaagttagtgtcttaaaatcttccaagagtcggatttctaactttagctttgaatttgtagtttcctattgtatatcatttggatttctcttgctgacatgtatgtctcaacatgtgtaaatcaacactcatcattttccctcttctttctatatttactgtctctgttaatggaatcaacagccttccatcattcgggtttgatgatgccagctttgattctcttttaccctaagttcattttattctaagaactgtcaatttctctcttcccacttttccatttccacctaccctaattaatttacgaatttaaaccttgattacctctcacttagtttcaggatcttcttgactagtaatttagactccagtctttttccctcttagcaagttgcacactactgctgaataatattttaaaatatgatgttagtcatgttacatgctttttcagaaactttctgtgttccaccagagagactgtggttaatccactacagagatcttatcttacaggtgtggatattgaggatcagaaactttttttgttataaaaaccatgcatgtgctaagtaaatagcacataagattagacctaatctctgatcactcatgggttacttcttcccactattgaaatatggcccaaactccttagcatggttttcttcccagtcaggccccattatgtctttttttttttttttttttttttgagacagtttcgctcttgtcacccaggctggagtacagtggtgcaatctcggctcactgcaacctccgcctcccaggttcgagagagtctcttgcctcagccttccgagcagctgggattacaggcgcgtgccaccacgcccagctaattttttgtatttttagtagagatggggtttggccatcttgggcaggctggtctcaaactcctgacctcaggtgatccgcctgcctcagcctcccaaagtgctgggattataggcgtgagccaccacacctggccaagtcttgtctatcttcaacttctcttgcacctagagtttaactcactccccaaaggtgctaatgctattctcctccttcctcctcctgccttcactttgatgaaattctgcccgttctttaagtcccaagtcatctgatatc

SEQ ID NO: 69495 - DNA, 1976 bp, Homo sapiens
ttttcatttggacaagtcttgttttgttttgcaatccaaagtgttgtattttttttaactggacaacagctgaggtcggtccatctgggttcaaatcaggtagcagtctctgaggagttcggaaggtagcaggacaaaagtttggatactgtgacaaccaggattaagttccatctgagtgcaagttttctaaggtgtttccaggatccaggccactattttcctaccactatagccatctacttcccagattgttactctggattatactagtctatcaactcctattacattttcaaaagccagtgtggcaaaactaaaacccaattactggaatccacaaacaaccagaagttttcttctgttttcattctctaggagaaaaattagaaagctatctagaatcttcaagaaaaaatgaaatgattttcattatacttactattaacacatgctctgaaatgtgttactgtttagacacactgtttagacagtgtactgattagaaagattttcagcaacagctttaaacaaaaggtttcttattaacatctagttgaaccagacattataatgaattagttctaatttctatttcttttcattggttagtcttttttaattccattttttttcttaatgctggcttgaagttttatttaaaataatgctttgtagagtagctgacagttttcaaagtacttttgcttttatcctttcatttagtcctcataagcatcctgtgtgaatcaatacctgtttttgagatgaagaaattgaggcccaaagacagtgatgatctttcccctgccaactgaaagaccactacccagcaaatgcctctcaataactattttctacagtcccgaattaaatgtagcttttagaagctaatcattaaaattcaattgaaacagtaacattaatatgtttataaccaggccaggtgtggtggctcacgcctgtaatcccagcactttaggaggccaaggctggcggatcacttgaggtcaggagttcgagaccagcctggctaacatggcaaaactccgtctctactaaaattacaaaaattagcctgggagagagagtaaggctccctcttaaaaaaaaatgtttataaccaattctttttttttttttttgagacagagtcttgctctgttgtccaggctagagtgcagtggtgtgatctctgctcactgcaagctccacctcctgggttcacgccattctcctgccttagcctcccgagtagctgggactacaggcgcccgccacaacgcccggctaattttttgtattttttttagtagagaaggggtttcaccatgttagccaggatggtctcgatctcctgacctcgtgatctgcctgcctcggcctcccaaagtgctgggattacaggggtgaaccaccacgcccggccctataaccaattcttaataagatacctagcactggtccagataagtagccaaattttatcacttgtgtggcggtgtgatttggtacatctttatgtgatcagcctcagtgatgcttgtcctttattaaggcattgttacgtggtagctgctcagattttttttttttttttttgagacggagtttcgctcttgttgcccaggctggaatgcaatggcacgagctcggctcactgcaacctccacctcccgggttcaagcaattctcctgcctcagcctcccgagtagctggaattacaggcatgcaccaccatgcctggctaatttttttgtatttttggtacagacggcgtttctccatgttggtcaggctgatctcgaactcccgacctcaggtgatccgcccgcctcggtctcccaaagtgctgggattataggaatgagccaccgtgcccggccagcttctcttttaaagaaaggaaggattaaagaacttgcctagagaagagtcactttttagtaaatccattttaattctcctgcttgaa

SEQ ID NO: 69496 - DNA, 1940 bp, Homo sapiens
cactaaggagaaagcttgaggttgtacttaccactttaatacttttctccacccacatttgatcaatccccaagtttggctgattctgccccaggggtgataagagttctttaatcagtcttctaattcagattccccttttagttttttgccagagtccttgagtccttgagtaatccttagagttggcttcagtttttcccttgcagaaaagttatcagagttgtcataaaaaaaaaaagcactgattttcaaaatatggttcctttaattgcctgtgttagaattacctggcagtggttaaaaaggtagagtctcaggtcccacctagacctgcagatcagtgtgtctgagggatgggcctgggaacctgaagtttatcaagtacctcaagagatttatatacaaacttaaggggagacaatgcctaagtaaattcagtctagctttctgacatgctcttcaagacacccacacccccactctgacagcctattcttttaggcttatctcccacaacacgacccacccacctggcactgtgaccctacaataattctctgtttcctggacctgcccagttctttcctgcctctgtgcctttgctcatgcagttaccacagcctcatgctcctccccttccccaccctcttgttgaaatccttttccttaagagcccaaatcaaatgctacctttttaaatttttttaataaaaaaaagccttttctaatttcttctacttgaatcagtggctgcctccccagtctttatacttaacacttgatttttgcttcatttcttaccttacttaatgttgtcactatttataaattattgcttccttgtaagattacaagccttttaggtatgagaacctttcccttccttttcattttgtggccattatgcacatataaacaattaagaactcattttattttattattttgagacacagtttcattctgtcccaggttggagtgcaatggcgcaatctcagctcactgcaacccccacctcctgggttcaggtgattctcatgcctcagacctccggagtagctgggactacaggcacgcgccaccacgcctggctaattttgttttttttttgtattattagtagagacagggtttcaccatgttggccaggctggtctagaactcctggcctcaagtgatctgcccacctcagcttcccaaagtgctgggattataggcatgagccaccgcacctggccaaagtactcatttagtacatgaaatatatctgatcttgcaaacacacttttatataataatgtttggctttgtatcacacatagaataaaattaaaatcctttagcattgttattaatccgtatttaatctgactactactcatctctgtgtcatcgcatgcttctcacttacttcctagctgtattattccttcctcagggcctttgcatttgctttcctctacctggaaaactcccccatctattgtcttcaccttgctggctgcatatgttctccccatcattcaggtttcagttcaaatgtcattcactcaatgaggccttccctgatcactgcctaaagaagctgttcgtgtccctgttcctaccacaactccagttactctttttgtatttccttcacaccactaatcacagtctttaattgtccggcttctccagtggaatggaaatttcatgagagtagagaccatgtctgtcttttttttttttgagatggagcctcactctgtcacccagggtggagtggaatggcacgatcttgactcactgcaacctccaactcccaggttcaagagtctcctgcttcagcctcccaagtagctgggactccaggcacctgccaccacacccagctaaattttttatttttggtagcgacaggatttcaccatgttggccaggatggtctgcatctc

SEQ ID NO: 69497 - DNA, 1058 bp, Homo sapiens
acctggctatttttttttttatttttagtagagatggggtttcaccgtgttagccaggatggtctcaatctcctgaccttgtgatccgcccacctcggcctcccaaagtgctgggattacaggcatgagccacctcgcccagcccgtctggctaatttttgtgttttttagtagagacagggtttcaccctgttgatcaggctgacctcaagcccctgacctcaggagatctgcccacctcggcctcccaaagtgctgggattacagcatgagccaccgcgcccggcccgaatattattttttaatctttactaatttgataggcagaaatgaattaatttgtatttctttgctagtgagagagaacatttttcatacattcatttctgtttcttctgtgaattatgtctgggttaatcccactcccatttttatttgggcgttaacattttaattatgttggttttttgtttggtattcttttatttggagcgttttgtgggggaagcacaggcttttattagaccaaatagagtgaatggagtgacaaagtggaaagtatacagaagttggaattgtggtgttataaatgcccattgttttgaggggccagagcttgtgatcaatgaagcagtactgcagaatggaaagggtgctatttgagagtcaggattcccaacttaatgttgtcatcaaccaatcaggtgatcttggacaagtcattgattcattgactcagagcctcatctgtaaaatgagagggttgggcttttgatccccaagactggacaacctctgtgctgaaaggatgcctttggagctactactgttcactagacattctggaattactttctgtctcatctctaacctttcacctaattttagatatatagagcctgaggaaagactggatgcagtaaaggcagtgtccaccggagtagcaaggggagcctggggacagcttaatttgtttgtgccctttaactttcaggaaaatagaagtataaaaaaaaaattgaatggggttcttgctgtgggggttgggggaagaaaag

SEQ ID NO: 69498 - DNA, 2533 bp, Homo sapiens
ccgcaggagcagtaggtgttagcagcttggtcgcgacaggtgcgctaggtagagcgccgggacctgtgacagggctggtagcagcgcagaggaaaggcggcttttagccaggtaagggccttctctctccacaaccggagagtgcgggaagaccccggcttctctccacaccctctttctccttcgacttttggggcggggggagtgcaaggagtgtgagtccctccccctcgagataaggggtcgagggacgctgatcctccgttctttcctcacttctggggcctgcgctgggtggggagtgcttatgtcgggctgagcctttgctgcccaagggcgggagctgcaaataccccgtcctctcccaccgagaacactgcattctaactgtatactttctggtgtggtggaggaaggtgacaattcattaaaactccaaataccctccttccagggaaatactgtaatattcaactgttctttttccttcattttcagccattccctctcttttcgattttttctcccttccattacgccagctgaactctgtttaagacacttacacccttttgaggaatgttgagaatatagcagtccttgcagccgatgtgtcatccccgaatcgctatcgtgtatatatcgctggcacttgcccccgacatatgttggtgttaatgtaaggtaattgtacacccctggctacacatactaaagcttgaagttgtagctgctaggaacgaaccatctggcacccttcctagcctccttactgatgcttgcaagaacggtttagctgatcctggtgagagatatttgaactactattgtcttgcacctaattccagctttcaaaagtctgccttggacgggcgcagtggctcacgcctataatcccaacactttgggaaactgaggcgggaggatcgcttgagcccaggtgtttgagaccagccaaggcaacttagcgagacccttgtctctacaaaaaaataaataaataaataaaaataaaagataagtctgcctaatccagatctgcctaatccagatggttcaattgacttgacttttcaggttagtcaaaggtaattagggagttatcagtttttaaggcaatgcccattttggggagaggttttcttttgcattaagtattctttcttttgctcttgatttaaatggtttaacacagtaccttttatctgcttggttaccaatactattcacaaatgctaaatatttcaggagccatgaaataacaccaatcctttcttctgaggtatgatgtagacacaaaagaacatgacccctaacaacatgttctaagttcctgtagaggtataacctgggtgcaggatgatcacgttttagatagatcttcaaaaaattatagagttggcgtgaaagaaggcaaaaaaaagtgtgtgttcatatatgttttcttgttttgcattgatagaacaacatataatgtactaggtaattagtttaggaacttatttcattctttggacaaaatattgagtgcctttcatgtcagtcctactgtagattcaaagtgccaaacgtctttaccctaaaagaacttaaaatcaaatgggttagacagatccacatacaatttatggtattagtgaggtcatttctatactagaggtcagcccagggtactgtaggagcatagggaatataggtgttttgttttgttttttaattctctcttctgcttttccttaaaaacaaaaacctctgagtaataatgagtgattctcttcaatctatgtatttgtatcactttcatatttcttaccctctcttcctccaattctatggcctatggaaaatgggattagaccctgttgttaatgtggcatttagtaaatagttggatctgtttccactgttctgtattgggctgggaagtgttgttatcaggtagtccctgggaagagaacagtatattggcaacattagcaaaggagtgccattttgtaaaaattacctcattgtataactttctttaacttggtacactcaagctttgttccagactctggttaaaggtggggctaaatttcaacctaataattctaaaagaaagcttcagaagctaaaacaattcacatcttggtgacaggggatactttttcctgctaagatgccctcaaaatgtttttctctttctttttttcttgggtggggaagacagggtagataggtgggtggggaaaaatgtttttaagtataattttgactagtgtttcttcaggtttcaaattcttatattttctctggtatttttcaccagttaactgcaattaacttagagccctcgtaccaaaaaaatttatcaaagacacacacacagacacaaaagaatattgagagtgtgggagttcattagacatctttggcataatagggcacctaaccacaaattggaagaatttattatttaaattgacagtgaaactagtttcaggcattcttaattccatacactattagatagatgacttttagattagaa

SEQ ID NO: 69499 - DNA, 1037 bp, Homo sapiens
tgtcccagttccgtgccagctgcatgatgccttttgatagtatccttctttcctgtacctcaagcatagtagggtttcagaccacaagttttctgaagcttttcggaattcatgcagcttgatgcgttattagtaggggctgctcgtgggaaaacgcttgtaattacacttcctcaagaagttaatgaaaatgtgtgagaagagagatttccaacaggtgatgaatatgccagccagttattcccttcttccttcaaatatccagcctagactgatttctggataggtattgtagaaataaaaatttcagacaaaacaaacttagattttgaatcggacaacagtcagaaccaaaagaggctcagacacccctgctctagctgcccaggcatcaaactttataggctgaacacgaaagtaaagaaatttgattggctacagctaagcgtttgccttatttgggtatggtcacatgggaggtccctaattatataaccacttggctggttgtctgtttgtgattggttgaaactccattcaaaatcaggtacaaggggccgggcgcggtggctcacacctgtaatcccagcactttgggaggctgaggcaggcggatcccctgaggttaggagttcgagaccagcctagccaacatggcgaagcaccgtctccactaaaaatacaaaaattagccggacgtggtggtaagtgcctgtaatcccagctactcgggaggctgaggcacgagaatgacttgaacccgggaagtggagattgcagtgagcagagatctcgccactgcactccagcctggatgagagaacgagactccatctcaaaaaaacaaaacaaacaaaaggtgcaaggaatacctctaaattttgggttgctttctgggtacaaaaacaactccaaactaatggcctgctacttattttgcattaacagtatcaagtatcaagactccagcaaaagtggcagacagcatgggaatgctaaagagcatacaatatcaatacaggatagtactccagaaa

SEQ ID NO: 69500 - DNA, 1064 bp, Homo sapiens
gatagaaatcacctttcttcaatgatacgttatctttagtgctgtcttcggaaatatcttcagaagcaacaggttgctgtcgtagttcagttaaatctggagttctttcagcttgggctgtatatgaaatagtggagtcccattttatcccagagtccttggtctcttttctttggacttcatctacaatattttcaagttccttgtctaaaatattgtccatattgtcctcagtatcaccaactttgattatcgccctggatgactgtggagaaggtccaggtaacactttcaaggttgatgatgtggacaattttgcatatagttgttctataacaattttggatcgaataagttgttcacatttttcttctgcatcttgaagtttctgctgaagcatttcattttcgttactgagatctcgtattatcttcagagagagctccttttctgcttcacttgtctcatgtgcatacacagtggaactttggaagttaacacattttaattcatcatttagcatactcaaagctgtagaaaggtttactattgttgatgatatatatttaatagcattgttttccaatgtactgaacattgtggtgcctatgagttcctgtagcataccttggatttctgaaacctttgtatttgttgcaagttgatcactaatcatctgatctggtcttaaagcacgggctgttgaaggtcgttttataactctttctttccaagatttccatagagtacctctagatactgaagaacaaaacataaaacagtgagatggcatttttttcttttgcattgtgttctatctatgtttaaatctaaggaatttagcctagattaactataactaattaaatataagataaagattaatctgaaaactttagctctaaaataaacagtattatttttaaagaatgactcttttcacacaatcacctagaagtttttctttctttttttgttgagaggggatctccttgtttcccaggctggagtgcagtggcacgattactgcagcctcaacttccttggctcaaacaatccaccca

SEQ ID NO: 69501 - DNA, 1059 bp, Homo sapiens
atcatagttttttgttttttttttcttgtctacttttcttctgtgagccaccacttttcggcagggttggtttgttcagtacacttcgccaaggtcggctttaaaaatcaaatctagattgtgaactatgaaaactgcggaattatcagtgctgtgtagctatctgacaagtgataaaatgtgtcattacgatttttacacatccccgtgccacagaatggcgtctccttctaatcgttccccccgacagatgatagtacatcccacactgctgctggaaaagatagtgcaaaagttgagcgcgccgagggctctcttttctcccggaaacaatttttccctagacccggaagcagttgttgtttcaagggaggtgggactgggcgggtcaggccgcagcggctgacggcaggggaggagccgggtccactgccgggtggaggggcaaggcgagtgtgtgtccttatcctagcaattggggcgcgggcctgtgagccagttggagttgcggcggcgggaacgattgggctgagcagaggacgacatgttgcttttcgtggaggtgagtgcattatgctagtctcgtcctgctcttaggagagcaggagtgtagaggcgccggccggtcccaccgccatgtgactttccgggccgtacacgccgcggaaccggcagataggctgacacagcacctgggccgagcaggcctgcagcttccctctgcgcgctcacaacactctaggaagctatgggaggtgaggcccgtagtggagaagaattgaaggagaaaaacggagggctgttctggtgtggcggtgaggttcagaggaaggggaaagtgtcccatatggacctcctaaaggaggcagcattggggggttggggggcggagtctgagggaggagagggtaatcaggtgggcgcgttccgggggccgagcgcggcctcgcggggcccctctgggagggaggcgagcaacatgtggggccacggatggagaaaggtgaaatgcggtaagtattttgaaaagaaaattgaaaagttcttttgagcaacttc

SEQ ID NO: 69502 - DNA, 1012 bp, Homo sapiens
tacaaggaaaattccaagaatgagggaaacttattccgggaaaagccgttttttgtaatgttatttgaacaatgagacacttttattacttaaactagaacgtctgctgttggcctattttagttttcaagatagagttggatacctgccttacagaaatacgaaatttaatttcccttaattctgtcctcttgtgtgcagtgagcgtcagctgactgcctggctaatgctttgagtagattccagatcatattgttcttacattgtgaaaacgtcaaaccagcaaagctgcaacttcgcaacttggcatttgttaactatgcccataagaagaatcttttcaatgagggaaggaatttacgggttgtataatgaatctaggagccggggccagcctatggcagatttttttttccgggttgtgggaaaatcttactccgtaatattccagcataaagtaaataaatgattttacggtttttttttctctttaaactaactgatattgtgtcgccgataagcttgatatctttaaattagttttttaaaagactgctacattagagtgtatctaacattcataataaacattcattggaacattccggggaaatcatgaaaagacttaaaattactgaactcattctgtttactgttttctgtcctcattgttgttttccttaggcagaataagaaatcagataagattttaagccagtgccagccagtttttttaaggaatgttatgctatgtaaataccacaggttttaagtgtgtgttttgctgggcagaagaaagattgtgaagtttatattgacaggaactccacaatatacttttgacttccaaattgattcctttggctttattaaaatgtaagttttaataacagctccatttattgtttaaactaggtcttctcctgtctctaaagcgatacttaatatgttttacagatgacaaaaccgagccccagaggttaaagtaactttacttagtaaaagtaaagta

SEQ ID NO: 69503 - DNA, 1272 bp, Homo sapiens
tgcctggccaggatatatcctttgattatttgattaagtatatttatcaatttttcttcctttaaacatactgcatccagcatttataaatgtttaacatgtagtttgtatataattctcatttatatctaacatgaatagattgccactaatttcaagtagtagccgtgtttttgggtccagcatgcaacccatctataataattatatttataaattagtttttatctaccatcattgactctgctatttactcactgttcgaccttgggcaaataacttaatttctctatgcttttttccctccatctgtaaaacagaagcaatcttaattacagcacaggattttctgataattaaatgaataaagtgcatggagtagtctgatacatggataatgctatatacgttttagcaattgttgatcattttagtttatctgtaattgtcaaaacttatctccctcggaatgataactcttgcttaaaaccatgcggacatatttcaaactggtagaaatccttaaaatctttttataggtgacatactgcccagagttcctgagaatagaatttaaataattcccatttactttcagtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggtaaactttatggttttattgttaaaatgagaattcagtacaggacaccccccacccatggtctctttatacttgttctgataaacctatggcattattttcttatttgaaaagaaggttacgttaatgaaatgttagttgattgttacattgttttcagataacatgacttttgtaatgttaagattgtttatgagggttctattaaaggaaagcgtgaaattaaagataacagaaaaaaaggcggggtggctcatgcctgtaatcccagcgctttaggaggcccaggcgggcagatcacttgaggtcaggagtttgagactagcctggccaacatggtgaaacactgtcctatactgaaaaaaaaaaattagctgggcatggtggcatgcacctataatcccaagatcatgccactgcactccaacctgggtgacagagtgaaactgtgtctgaaaaaaaaattttgtgtgtctatatataaacaactgcctactttg

SEQ ID NO: 69504 - DNA, 1066 bp, Homo sapiens
ctaatatgaaatgtatctgatgaaagaatatctagattgacagaaattagttagactttgaactgtccaaattataaaaataataaaaaatacagtttgggccaggcacagtggcttatgcctgtggccaaggtaggaggattgcttgagcccaggagtttgagaacagtctgggcaacataatgagagcctgtctctacaaaaaaataaaaataaaaagttagctgggtatcatggcacaagtttgtggtcctagctactcaagaagctgtggtgggaggatcatttgagcccaggaggttgaggctatactgagctgtgatcacaccactgtactctagcctgggcaacaaagggagaccctgtttctctgaaacaatagctttgtggtgaattttgattgtagatactttgtggcttctgagtacaacagtatgtcagatttatcacctctactaacatgctattaactttttttccctcttcttttctaccatcaggagaaagcaattcagcagtttctacagaagacctaaaagaatgtctgaagaaacaattagaattctgtttttcacggtattgctgtttcccctttattgaattttattagtagatgtaaaatacgtgtgaaatagagcgcaaggatggtgattattatttaactaatttttttttttattttcttgagacagagtctcatgttgtcgctgggctggagtgcagtggtgtgatctcggctcacagcagcctccgcctccagggttcaagagattcttgtgcctcagcctccagagtagctgggattacaggcgtgcagccaccatgcccagctaatatttgtatttttagtagagacagggtttcaccatgttggccaggccagtctcaaacatgcaacctcatgtgacctgccctcctctgccttgcaaagtgtcgggattacaggcgtatggcaccacactcggccccttgtctagatttaaaagtgtagggtcgggcgctgtggctcatgcctgtaatcccagcactttgggaggcttcggtggctggatcacctgaagctggg

SEQ ID NO: 69505 - DNA, 1265 bp, Homo sapiens
tatcagatttcattatactcctcaacatagtgtttggccaatgaaagtacactaatttctgttaacatccatttgttatctcctcaatgaagaatttggttattatatacaagaaatttgccttattagatatatgttgtatgctccctgaaggcagtgccaaacttactctgttaagtactctgaatgttttttcaatgaataacatttgacagtgttctttacatacaaatctccaaaaaattgtcatacctataatctttgattctacaacttagtttctttaggatattaacccagcctctgcaaatttactcagttggaaattaaaatgaatagtttctttaatggcattaataatatcactacttgtcacgtttgagtgataccctttcttttaaatttcagcttctcccatggtacaagttgatgagaagggtgagaaagtgagaccaagtcataagcgttgtattgtaattcttagagagattcctgaaacaacaccaatagaggtaaattattaataattgttaacactaaatgttctctgtttaaattaaaagaggtttcttctgcctttcgtggcaaagaagaaaaattggaagaggtacacaagcaaagcataagtcagtgccttcatcagttactgtgaaaaggttaaatactaatttgtttcattaattctgaagtactaggatggtatagagaaaggaaaagatatagttctattttcttagaagggtagacaaagtattgcagtgaaacattctgaatttactagattgattcaatggcaactaatatataaataggctattttgggaacttgagaattcatctgtaagaatgaatgaaaaactagattttgattaaggattaaggaggcagggctgggcgcggggtggctcatgcctgtaatcccagcactttgggaggctgaggcaggcggatcgtgaggtcaggagatggagaccatcctggctaatatggtgaaaccccatctctactaaaaatcaaaaaattagccaggcatggtggtgggcgcctgtaatcccagctacttgagaggctgaggctggagaatggtgtgaacctgggagcttgcagtgagctgagatcaagccactgcactctagcctgggttacagagtgagactctttgtctcaaaaaaaaaaaagggattaaggaggcaggactaaccctattgttcagcgaaatattatataaagcaaagttgcagtcataaagatggtatggtacacgt

SEQ ID NO: 69506 - DNA, 1956 bp, Homo sapiens
ttttacaattcgtgtattagagatactagtacccttgcctgtgatgagctacaatttactgttttgacttagttttttgggaggtttttactctgcttgttgttgttgtttagagacagggtctcgctctgttgcccaggctggagtgtggtagtgcgatcatagctcacagcagcctccagctccttggctcaagcagtcctccccactctgcctcccaagcagctaggactacaggttgcatgccaccatgcccagctttttttttttttttttccttgtaagggatgggtctcactgtggtacccagggtggcctcgaactcctgggctcatgcgatcctacccccttgacctctgaaagtgctcaggttacaggtgtgagccagcacacctggttattttgacgtgtgtttgtgtgtggcggggggggttttaccttgtttactatggtttttataccatgaaaacgtttttattatttattaattaattaaagctgtcattttcttttcttttgctctactgattctactgtaggcagaaatagtatagtcatgtaaaatatatgttaaaatgtaaattaaatgtattttttaaaatatacacttaattctttgttgctataatgtgttcctcttctaggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggtaagtgagatccttacaataaaatataataatatttttaatttgagctgaaatttgaagaaatcagttggagtgggagctcatttatgttgacattgatgactttttggcctttattttattttattttttgtatttttcgtagagatggaattttgccatgttgcccaggctggtctcgaactcctgtgctcaggcagtccacccgcctcagcctcccaaaatgctaggattacaagccactatgcccggccactttttggcttttaaacagtgatatggatatctaattctccataccaaataaatgcatatgactaagaggtgagctattagagcgcataattttattccataaaatttgctgagtgaattgaaagaagagactggataacttttgcgtgattttaaatgcattttagtgttgcgaaatgtcagaccagacattctttactaagttatgaattgttcataaatccagtggtacttgaagtgaatattgcagaaatgaatcagtaaaatattttaagatatttttggcttgtaaaagataaattcataagctcattaaggttcttgtgaccctcacaccagattttacctttgccattaatattgtttaaacatacatttttttctaggctccctttcccaatggtagttttgtgaatggctttaattcgccaggatcttataaaacaaatgctgctgctatgaatatgggtcgaccattccaaaaaaatcggtaagataaaaaccatagctgtaatgtattttaaacaattcctaatggatcttaaggcattaatagcaatgtttgttgtcaggctcagtaataaggtttggtggattttttgtttgttttgtttttactaagtgtatatgaacagtttaatctagaattcgtaaaaacactttgacctttgagttggtaatgcatgtaacagacttgggattcagattttttttaataataaaagagaatagaaaaaatatttcatgacaccagtctctgacaaatctggtgactaatttccatttagtatgttaaatgggtagcattttagagaatgaattctttgaagatataaatgttgtt

SEQ ID NO: 69507 - DNA, 1048 bp, Homo sapiens
tttaacttaattttttgaaaaccccagtacaacaggagccaattttttacctaaggaaagatgtttttctgtctcgatttactgctttgtgtatatcattttgtatttcctatagtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacatgatcttcataataattaaatgagcatttaattattggtatatggttatattaaataaatacgttattttcagaacatgagttggttgctttttataattattaagaaatagagtgcccatacagaatatagctctgaatcagaggtttataaagttattctgaagttccttatagctcatataagaaagaatagcttagaaaattaacatatccatttgccttatggttttaatttcttccagcttttaaactatagaagtggctgggtgcggtggctcacacctgtaatcccaacactttgggaggccgtggtgggaggatcatctcaggtcaggagttcaagaccagcctggccaacatggtgaaaccctgtctctatgaaaaaatacaaaaattagctgggcatggtggcaggcgcctgtaatcccagctacttgggagcctgaggtaggagaatcacttgaacccaggaggcagaggttgcagtgagccaaggttgcaccactgcattccagcctgggtgacagagcgcgactctgtctcaaaatataaataaactataggggtgaggttatatattgccaacttgcctaattaaacaatagtatggttctggtttgaagggatcactactaacaaatgggctcatctta

SEQ ID NO: 69508 - DNA, 1104 bp, Homo sapiens
caaaaaaaaaaaaaaaaaagagagattagatttggggtttattcaatatgttgtaaatgtcatgatggaggactaaacattggggttaaagaaacaggcatgacttccagtaggtaggtcatggtagaggagctcttttgcaggagggagatcttagctgggaataaaattttggatttgtaagccttcacatagtaattggagtgataagctcatgcagagtactctccatagagtggtgaaagtggtctaatatggaaccttggggaataaagcagcagtgttgggttgaaaaatgagattattcagcatgctgtttgaagtattcaagcaaaatctgaatggacatgggtaatggacaaatgttatctcggttgtaggcaaaggcctaggctgaaaatatttaaaacctacaattcaatgatatttttgtaaatttacagagatataccgccatcaccaccaaaaagcaaaacaggttgttttaacagttgcttgcatataggtagtagttgaagccatggatagtggacatcactcaaggagaatatgagaagtaaagagtaataaccaaatggaaaccatcaaaattttagaaatggtcaggggaaaaagagcacatgtctgtcaaatctaaaaaacaaaaaaggtatcacagaagctaagagaaaaatgtgttcccaaggaaaggatggttaacacaccaaatgctatatgtcaggaaatgagaggtcaggaaaaagggtctgtcaggttttgcattgttgaaggcattggtgacacctaaaataattttagtggagtgatgacaaagtggaggagatacaagtaagaggtaagaggcttgtcagaggatatatagggtgttagacaggagggaagcatgagatttttcatatatgttatatagaggagggatattgttttctcttgagataaatagatggagaaagatggtgatgggcgggcacagttgcttaagcctgtagtcccagcactttgggaggccaaggagagaggatcacttaagctcaagagtttgagaccagcctgggcaacgtagtgaaaccttgtcactactaaaaaacaaaaaataaaaattta

SEQ ID NO: 69509 - DNA, 1045 bp, Homo sapiens
gttgtagtgagctatgattgtgtcactgcatttcagccttggtgacaaactaagaccctgtctcaaaaaaaaaagagttgatagcaaatttaggtaaagtgggtgtttttgttaagaaggcatagcaaattatgaaatgaatagtaaagactggttagaaggcttaaggagtatggcaaagtttacaaaagaaacaggtgagagaagtgactaaagaaaagtagaattgataaagactgatgagagctcaagtgagatgtcaaaccaagaatttatgtagggatacagttctgtgcattatagaggttttgtttgcttctttttcttttcttgcacctttcagcttctgtgacacaggattagggaatgagatagccatgtgacctgttttattatttgttcattttagagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggtaaacacccagcatctgagtcttaccttatgagaccatatttaggctttatttgcagtgttgttatttaaaattttacttgcacttagtgtacatttctatcatagtttttatttatggagttttcagcatacttagagtgtttttttaaagattcatgatgaagctgcacaaaggcaataaaatgtttcttggcttttgcatgtctttgttttttttttttttaaagacatgatcttagctcactgcaacctctacctccttggttcaagtgattctcctgcctcagcctcccaagtagctgggagtacaggcatgcgcaaccatgcccagctaacttttgtatttttgtatttttttttagtagagacagggtttcgccacattggccaggctggtctccagctcctgacctcaagccatctgcccaccttggcctcccaaagtgctgggattataggcatgagccaccac

SEQ ID NO: 69510 - DNA, 5263 bp, Homo sapiens
gattctaactgctctgctgggattcttttgtcatctttcttggggttctttgtagcaaggaaacaggagcagaaagaaccattttatttcatcatatggctataccattattcatctaatctgtcctttgttaggcatttaggtcgctcccatcattataaacaacgctgacatgaacatccttcagttaaattccttacgtgaaattattgtataataaataaagattgtaccagtgtactctaagcagtatatatgagagtgcttgttgcccttttctggaagataatctgtggttttcttatggttaacacaatcatttttatactttataatttaaagaatgtgtaccataaatgtttttttttatcatcacttcaaaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcataggtcaaatggatttcagaggtttaaacttccctgtgattcccccgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatcacttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggcttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagcaggactggtttccttttctctaggtggtgtatgtctaatgactacttctgtctacctttcagtattatatgttgccctcgctaattctattattattattgtctaagttgttttttggatgatgagggcagtgggaagtaatggtgtttcacttaaaacaagggcagagagacaagatacagctttatgatcctggggtattcttttagttattttagtatcagaagcagttattaaagggtgaaaaatggctgggcgcggtagctcacgcctgtaatcccaacactttgggaggccaaggcgggcggatcacctggggccaggagttcaagcccaccctggccaacatggtgaaaccccatctctactaaaaatacaaaaattagccaggcatggtggtgg

SEQ ID NO: 69511 - DNA, 1093 bp, Homo sapiens
tcacacaactcataggcattatttagatacaaactttaaatctgctgtaataaaataaatgctaaatacatactgtgaatatatataaatattacacacacatacacacacacacactctctcactcttccctatacatgccatcaaatgggaactattagatgtaatgaggcaaattaaattaaaaacattgtcttaatgagaaaatttttaaaggttatatctacaaattaaatttctactttaaataacatttgaagtaaaagcaaaaatatacttgctttcttctaaaagaaggctcttttcttgtatttcaattacaacctttaaatttttagagctggactaacagtaagtcacacaagcatacaagtaatacagacctacatttgtgacacattgtttaaaaaaagtaatgtttcattttaagtgcagtaattaagtttataatccttaccaagtgatttttacaaaatgtttattctctgaaatccaacgcattcaaaggatgttaacacttaaaacgtttatcatttccaccaactgcattatcttagtaaaccaaaataagcacttttatcatagatgtagtcaatgattaatatgtttttttaaaggacctaaacttcccccaaatttcagcacaggtagttttattgttatgtttcacctagtaggcaatttttaaaaatagtgtgtagaaatgaatagtttcaaactgagtaaatatagtagtataccatgtcataaaacaatcaaatcaaaagcaactgccaagctaataataagtcaaagaaatagtaattctggcttgtacagatatgtgcagtgttttcaaagctcttaacagttaaccactaacatgtatctccaaagcttaacttagagttggaagatgaatttcacagtaatgtaattttaaccaccatttacattcactttaatatattactaagatgtttactctatgtcacaatggtgctttccagtgttcacaatttacagtttcaatttgtacatatgtaatttactaacatatgggacagttcttactattacaaactatcccttaaaagaaaaataaaacccacct

SEQ ID NO: 69512 - DNA, 2130 bp, Homo sapiens
cgagagccaccgcgcctgtctttttaaaagctaaaactgaaacggaaacagagctcctggcagataggaccaggagccacagcgaaggaggtggcctgtgattaggtttttataaatgggcaggtattaatcagggaaaatggagtaaaggacacgatagacatacattgctaagtctagtattggaaaaagtaaggcctgggacccctaaaaacttgctcgagagtgaaaggtaaatgctatgtgtccacactactgtggtaaagccgacagtccataccatgagcccatttcgcgcagggaaattcgagtggtgggcttgggcccgtcgttctggtagcttcccagtagagggcgccgtaagcatatgcgtcttcagcctgactgggctggagaggcggtgcgtcctcctggccggggggcgggggccgtcgcgctcacgtgacctttgctcatggcggcggcggcggcggcggcggtgctggtggtgctcggcggccggagccggatcctgtagccgggtgtgggcccgtgtctgtccgtccctccttcggccccctctcttgtcttccggagtgtggctggcggagctgggatggcggaacgaggcctggagccgtcgccggccgcggtggcggcgctgccgcctgaagtgcgggcgcagctggcggagctggagctggagctctcggagggtaggagccgggccggggagagggcgcccggggccctgcggatcgcggcgacttgggagacaggtccccgccgcgcgctctggcggccgtgcggcgagggggacgagggtgtagagaacctggcctggcgctccacgaccgttttccctcctctcccaccccattaagtggtttcctgtggctttcattgttttcccatggaggggactaagtaagggcttgtggaaaggtcctcccgggcccacactgcttctgcgcttcctgccccccaaaacccgagacaaagctgcgccctcccgcttctgcccaggcgtctggcccaggtggggtgaggggtagggctgcgaggagggtggctgacagctttctcctttcctctccccttttcgtggagggctccacgccttgttccagcccccccttccccctttcaaaaagagacacatgggaaatccgcagcatcatttcttctctttcctttaacaatgcgcgatgcctccccagtgacaggagtgagacacaagcgggtgagccatttagggtcctaggaagataagaagcaatggcattaacccagagagacacacggtgctgcttttagaccacctttgtcataagaagtttttttttttcctggtgcctgttattcgggccgaattttccgcatctggtcaccttttggagtctttgatgaaggaaggagaggaggctaccgtttacttgcaaatcctggctggcattctttcttttgacaatggattgggacagggagggttcgatttattttcagaattaaaaaaaaaaaatgggataaatcaagccactgttattagagaactccttgtacaacaatgagagaaacacagtgctccgttgtgggcatgtgatcaggcttctggggcagttgtgatcagttctgtgtaaagttcctgtttttatcactggctgcccctgagacaaaagcagcattttctccaagcttgataccagtactttgattgtgtctccagagttgcatattcttactgagttccttgtggaaggccctcttcactagcatttttcaagtggatcaaaaactcttgattggaaaagaagaatgtgaccaactcccaggagcttattaaacattacttattgtttacttattaaggcattatggttccctcccctctgagaatcctttacaatgaaaaaccaaaaatagagttgaatgttataaatcctgttgggcactgaaggaaataattatttttaataacccttttaataacccaatgtgtaggaaagtgctgtttttacctgtacttaactatcaacatgttatttttcaattaatccaattttcaagttattcttcggccagtcccgggaatcactggtattagattagtttgtttctgtgaagtgtttaagaagataggaatcctctggg

SEQ ID NO: 69513 - DNA, 1363 bp, Homo sapiens
ttacatctctgggtgtttctagacatctctagaatgtctagaaacattctgaggaactatttctaggacccacactgattagctcacctctctctccttcagaaaggtgtgaaacttctacaaattgtgaatgccaaggcttaaacattttaaggacaagtgcatggtttgctttccaatgaaggattattttggttggcatctgacttggtttgaatttgtttcttatagatatactacacttcttgtatttcatttgttttagcaatggatgactggaaaaaatacaattgaaaaacttgggcctgcagtgtcagcatattggtcatctttcttgcttaaagtacaggggatggttggctggagaagtggatagacattaggaattcaagtgaagttaaaataatccaaaagtccccatatctgtgtagtatggtgttatttgtgatgcctgtagcatatttggagctaaggtttgttcgttttgcattttctctacagttactctgctctaacataagtactttgtctttttttgttttagatgcttttctttcgtttgttttttttgagatggagtctcacactgttgcccgattttagcttaccgcaacctccgcctcccagggtcaagcagttctcctgcctcagcctccccagtagctgggattacaggcaagcgccactactgccgggctaattttttttgtatttatagtagagaccgggtttcaccgtgttggccaggctgatcttaaactcctgacctcaaatgatccaccaacctcagcctcccaaagtgttaggattacaggcgtgagccaccgctaaagatgcttttaactgtgtgtttatcatgccttgctgacattggtgcactcatttctctattttcattttttctttctttctctctttttttttttaaggttcagcctgtcattggtcctaatcatagcaataatctgagctgtatgctgttaaagaattttctttgtgcttgcctgtattttcagctgcaggctttggtaatagatcagccaactctgtgctgaaatgcaggtttgtgcctgctttgggctctttgctgcagagcgtgttgcagagccctgtgatgtgtctggtgcttcaggcaggtcaccaggcagcttcctggttaaaacctgcttctgtcacaaaaagaacaggctgaaactgcctggaaatcatttaaaaactgaatttccacataaggatgagcttttctatagacgagttgaataggtagaaggtttctgcaagtatttctgtgactgaaatttttaatgatccacatattttattatatgcttgacagctctgttgtttggacttatgtatatgg

SEQ ID NO: 69514 - DNA, 1102 bp, Homo sapiens
ccttttttttttttgcgatggagtttctcttgttgcccaggctggagtgaaatggtgcgatctcagctcactgcaacctctgcctcccgggttcaggtgattctcctgcctcagcctttctgagtagctgggattacaggcatgcgccaccacgcctggctaattttgtagtagacacgggttttctccatgttggtcaggtgggtctcgatctcccgacctcagatgatctgcctgccttggcctcctgaagtgctgggattacaggtgtaagccactgcacctggccctaaacagttctataccacagtgttgattctctctctgaaatctctttcaaatccatcacttatgcattcagttcagcagatgtgtattttgtgcctactgtgtgcaaatgagcaggataccctggtagcttttaagaagctctgagtctgccagggaaatcattgaaaactgccaacaaaacagtgcatgaccatggtggagttatgtacagaggctgccttctaagaaaagaggaagctatctgctttatcgttgtgagagatagaagagaattataaatacgagattggattgtgtggctagtagagcgggctataatttagcctgtgcagttcagccataagtgcaacgcgaagaatgttcctatacttctgtggcatgcaggaaggagctcaagtctttcagtgtctgagaacagtccaaagatgacaactggaaaggtatttaagataaaataacactcacaggaagggatcctcccttttcttgtttgaacacttctctgagtacaaacagtaaacatagtcccatcctccctttctcctgtctgtttcatcacgtagctttgtggtccttaaagcatggcacagggtctgccacgaaggcaaagggataagagaagactgcttcctaggaattgcagtgacttttaatggggaagaggtgggagagttgaagaggaaaaaggagatgttggataaagattttacagtctcagaagggggcagttagacttaagccaccataaaactggtaaattcctcctgctttacctatcatgggaaacggggccacttatcccaaaatccgt

SEQ ID NO: 69515 - DNA, 1031 bp, Homo sapiens
ccgggcgcggtggctcacgcctgtaatcccagcactttgggaggctgaggtgggcggatcacgaggtcagggatggagaccatcctggctaacacagtgaaaccccatctctactaaaaatactacttgggaggctgaggcaggagaatggcgtgaacccgggaggcagagcttgcagtgagtcgagatttgggccactgcactccagcctgggtgacagagtgagactccgtctcaaaaaaaaaaaaaaaaagaaaaaaaagaaaaaagaaaatctcaaaatctcataaagagaatgggaaaaggctgcatttgtcttggaatttataaatgtattcaaaaatttttttcatctttgttgatgcatatttctgtaatagttttttcctgtcttaattttctctcataaaaggaaaagatttgatattcctgagtcatcactctcctgaaatctcagttttactcagacctgtgctatatagagtattatgttcatgcccatgtctgatgtggagggagagacacagacaggagagtgggtgactgactcagatgtaaatgatcttattatacttgagctgcaaccacacctagaaaccttgacaacaacagggcctgtgtttgatatatctcacttgttaaatcctgtctggattttagtatgtcatatgtgtgttcatcagcaaaattgaacaggtgctggaacaattgcaaagctttaatcagacttatgattacactgtttctcgttatgattaaactgtttctcattttggccaaagaatatgacacaataactaaaacaaatttctagttgtttcttgtgttgtttattctgttcagaggtttcttttctttttcttttttatttcttagacaaggtctcattgtgttgcccaggctggagtgcagtggcacagtcttggctcattgcaccctctgcttcccaacctcaagctatcctcccacctcagcctcctaagtagctgggactacagatgtgtgccaccatgcctggctaattttttttt

SEQ ID NO: 69516 - DNA, 1035 bp, Homo sapiens
acttccttaactgattctttttggttttaccctcatatctttaagcaacatgcatacatttcttcttaattttcagtacttttgcatcatatactggcttcccaccttagctacccacccatgcttccataccacttttccctccatatagttatagcataattttgattaaatattagattgatatttaatacttaagttatgactatgtaaatgctgttgatagctaaatcatgtggtatacttttatttttttcttttctgcttagattttgttttctctgtaattgcaagatgttttatttgcttattttctatgtatttgtcattgatatgtctctatactcttagttgcatgaatctgcctctatatgatcgctcatatcaggtattctgtcagtttcaccttgaataggttgttcctggaatcttctgaaatgccttggcttagatggattggtcactgggtgcgtggcatggcggtagaatggatcagccgtctctagtttcttagggatttcctttgctttgtgtattgcatcctgtatattctgtgtctcgtgtctttacctttttgagcttacttcttcactttggttgagtgcatctctgaaagacatctcgccgctccccccccgcccctttttttttcttttgagatggagtcttgctgtctcaccaggctgaaatgcagtggcgccatctcgactcactgcaacctctgcctcccaggttcaagtgattcccctgcctcaggctcccgagtagttggaactaaaggcgcgcgccaccacgcctgcctaattttttgtattttagtagagatgggggtttcaccgtgttggccaggatggtctcttgtctcctgacctcatgatctgcctgcctcaacttcccaaagtgctgggattataggcgtgagccaccgcgcctggctgacatatcccattttttatctcttttttggaatataatattcttgccctcaactcttcctagtgtcccccattctagagaccctctgtttgcccttct

SEQ ID NO: 69517 - DNA, 1034 bp, Homo sapiens
tattctaacatctcaagtagcaaaaagtggaaatgaaaaacaattgagggagctatcagtcagagatggtagaatgaatatctctaatagcccctgttttttcctcatacctcattaaatgacagtaagaaaaagcattaactcagaagaacaaaacagaactgcagaagagagaacagcaacacaattttggaaactggcaagtgggtagatgaacgattactgacttagtggcaatgggggagcaaggccgtttacactttgaaaacccagaaggctcaggagtgggtgcaccagttccctctggaaatgggggcaaaagtgggttgcaaagagaaggattcactgaaagtttaagaaaagactccagagcctccctcttcttctatgaagccaagagaatgtcctttccttaccctagcagaagactggagatttattttctgcaaggggaaaatagagagtctctagaatagggaacaccaggtgcaggtgagggcaaggagagcatactgtcaagctcttccaatttgtatataattctttccatacccagtagcatgtaccaaggtggattcagttctaaactcagaacatgggtgattaggtgatcaccccagtacttccccaagggacagacttcttattaactcctctccactgagtacatcactaaggcctttgggtgacattttatttttccttttctttcttctcctgtaatttagtagttaatcttcacagaaaagaggaagatggtgtaattatttgtcttttttttttttttttttgctgggctggcataacaaaataatgacgtttaaaagattcaagggtagatattttctttggtattataccaattttatctcaacagtttgactaaccaacaattggtccttaaaaaaaatattattaggctgggcatagtgtctcatgcctgtaatcccagcattttgggaggctaatgtgggaggattgcttgagcctaggagtttaagaccagctggggcaacatagcaagatctggtctc

SEQ ID NO: 69518 - DNA, 1041 bp, Homo sapiens
acccagtcttataaccttatcttttaaaatgtgcaatagatgttggaaacagtagaggagctgtgccctgagccctggacagtgtctggaatgatttgtagaaaagcccattgtagcactaatcacttgaggtactgtttcagggcaattttatttttctaatggaatcccatgattggcatagttcaaacagacagaacccagacaggaggcagtctttaaaaatggttagtccaattttgtttacatttcttccctttgcagaatgtgtattttcccttcttcagactaaaaatgtcacagtgtgatgtatgctgttgtggaagtattttgcatgaaatcactaaattcatttattcaaataatttgtcttaggctttttaaaagtgaccagagataaatatttatgaatcatatttaagtatttggagggcatttcaagataagtatatttaagataatttccttgactatgtttgatgatattaagggttcttagaaatcttttccaaaatcttgcaatctgaaagtgaatggaacattcagaattaactgtagtcacaattgtgtctttattgttggttggtcttgcctgtttcattttacaaacaaatgtgaaggacaatactttctccatcaaaatagataagaaactttcatataaaagtaagacaggaaactaatgtaacctttaaaaaaaatcttgaattatcttattaagattacaatagataattagattaatctaaaattagattgttgtttagttaaacctgattttatgatttagaaaggccaataaatagcacctctcttctccacacgggttctggataaatggcaaaaaaccaaactattagcagatgagggccataatattgcttttattactgataaaggtgatggtaaaggaagcagcttaaggttagagccaaattggtttgctaagtgaattccatcattattcagacctaccccgtgggcacagtggtgctggattggagaggtcatatgcagtatgcagaccctccactcaacgca

SEQ ID NO: 69519 - DNA, 1069 bp, Homo sapiens
gtattttgtacacatttatttattttttaagaatctactttttataacggggtcatgagatcagtgagaactaggtatcttcatcccatccctgttcaccagacttcaatccttatgctccctaaggtaaatttaaagagttataacttcatatttgaggaataactagaaacaatctaagttgtcttgtctgttcagaatctctcccaaagtttttttaaaaccttaaaaaaaattttttttgaacttctctagtggaagctcgaaaaaaattttttttagatcgaatcccagacaagatcttgatataggcctttgagactaaacatagtaaatctatttcagagcctcaatatagtgtctctctttctactttcatgttactggtaatgaaatctttgagaacaaatttccccatacttttttggcctaaactacttaatacgtctttggggagattcctaggttgccttatggttgactttgattcacagctgtcaagttgttgagctgttcatactgatcctattccctgatccagattaatattaatagttttcttctcggttttggctaacttctcagagcatttgggtatgctgtgggctcatttactgtgtgtgctttttttcttcacatctgtggtgtcaacatgtttgaaagagaaatagctctgtggcttcaagtgtttctcaaaatgtatcacagggtacctctagccggctatcacagtaagacagtttgtgtctataatggtgcatacctcaaacctactcattgaaaatcttggatggtttcccttccacattagtacagcacaagttgggtcctcatggacaaagggggctctcagtttagtagctattcctttttggcagattacactgcagtgtggctgagggttcagttgcagtaaatggcaaagggtagggagcagcatgacatgtagttcttggaaataatcccctccaaagctgtatcaaagacatgcagtttcagagtaaataggctgcccttatggctttgggtgaaatgtgagaatgcagcaaagaccttgagaatgctcaga

SEQ ID NO: 69520 - DNA, 1236 bp, Homo sapiens
ttcgttatatataagagcttagggaagatgttttatttataagtgataacagtcatgagtttatttttaatcagagcagaatcagtagggaaatgataaatttctattatttaattttgcccaaatttctacaaattcataacaatttcctgggtgacaaattgcttttaaaataatatttaagggaccttgttttgatttttaaaaagatacaatcccagagcagtgctacattttatgtagacttcactacataatcgtcttttaactttacccggatagtttcttatctgtgaccataggttgagttattcatagtaagcacctcatttctcaggtggcatcatttggcacagtattattttcttctaccaactgttagtcagtttctgctatctttcccttcatgtttataggaagcaattagccatttaaattactcttaggaaaaatttcaggttattccaaatcaaaaagaaatacacattccttttaaccattctcctggggattagaagaggaattaatgttgattggccaggtgctatgggctggcaccagtatgggtgctttctgtacagtgtctttgttcatggtctcccagctatggttaggataaaggcaagtttccttagcttgtcttacaaggcccttggtggcccaatgctacctacttgtccagtctcatctccatgactatcagtcttgcatctgtgctctggctagtctctgtttctttaatatctttaaaaagttttctgtcccctccaagctttctcgcgtgcagccccctctacctgacgctgcactctccctacctctgggcctttcataactaatccctacttagccatcaggccttgggttaggtcttacttccttgggtgcctgccttgaactcctctaactcatctcagtcccataagaatagggactatgtcttcttgcccaactttttattcctaccaactactgtagtgcttagtgtgtttgtcaaatggacgaataagtaaacagtcttctcagatgggtaattttatccccaagtcacatagctagtaagaggtggatcctagagtttgaatggaagactgacaccaaagccatgtttttttccactacgctaagctgccccatagttgtaagtcattaaacactgaagactggcagacaaacagggtaactgaattgaaacaatacacctaattgcataattgatccaatatagaaacataa

SEQ ID NO: 69521 - DNA, 1047 bp, Homo sapiens
acaggaatatttgtgtcccggggtacagttgaaatgttagaatattttctgaaaattacacaaaatgctttccttaaaggggtacagatgtgattacttctttttttctttaaattttcttttaatcaccccccttttgcatgatagatctcattcttctttatggacctcatcactttatctctttgggatctggtcactatttatctctccaccctcatttttttcatttttttgccttactcttcaaagtctttgctctatgtacaaagaagtacttgaaatccctgactgtggttggttcccatcctgcgaaaccctttgattactcccgtttcttagcatctgttttattcttttgaaattatctgtgggcttctgtgtctcctgtaagcctttttagggcacttactgtgtcataagcactcatacacttcacaacccctaggacttgacatagttcctggcacatgttgtgattagtactttttaaaaagcaaaaacagtcacaggcttcagaccttcctcaatatgaaataataagttggaggtagtacagaacaagaagcaagggtatagtcattatataactttctgggttttttgtttttgtttttgaaatggagtctcactctgcctcccaggctggagggcagtgatgctatctctgctcactgcaacctccgcctcccggtcttaagtgattcttgtctgcctcagcttcccgagtagctggaattacaggtgtgcaccaccatgcctggctaatttttgtatttttagtaaagacagggtttcgcgatgttggccaggctggtcttgaactcctgacgtcaagtgatccacctacctcggcctcccaaagtactgggattacaggcctgagccactgcatccggcccattattttaactttctctcttgctctggacctgcagaatttgacttctagattagatgagtcttttgtggttcaggttcccattgtgaggtgccagcagttttccagccccattggttatgtatttggctctttgaaccaaagca

SEQ ID NO: 69522 - DNA, 1009 bp, Homo sapiens
gggtttcctaagtaattaacttaatgcttaagatggtttgtttgttgctaaatcaccaaaaggattaagtgaaaaattgtgatgaggacgaggatgaatgcgttatagttcccaaaatgtgtagtataatcgtgggcatgtcggagatctttttagatgtgtgtctctatctcagtaacttaatttcctttagagcagatggctgttaaatagtttgatttattgtgttcatgataaatattacatacttagacagtgacattgaaagcattagtatgtttttattcctctgttaaactgaatatcattatgaattttaggtagccctggtttaccccaacaatgatccagtcatgtttatggtggctttctatggatgcctcctggcagaagtgattccagtgcctatagaggtacctcttaccagaaaggtaacattgctaaatttaagaggaatgtagcctgatgtgacatggcaggcattgggttcttggatagatgtagtcacaacagtaaaaactgttcgaccatttttggaagtactcagcttcactttctaaaaacaggaaatttgtagaaaaattatttattaaatattcacaagttttatgcaaataacatattttgtattaagatagagtttgtatagtattgcatatcatttaaaatatcactggggcgaggccgggcgcagtggctcacgcctgtaatcacagcactttgggaagctgaggcggggggatcacaaggtcaggagatcgagaccatcctggctaacatggtgaaaccccgtctctactaaaaaatacaaaaaaattagttgggcgtggtggcgggcgcctgtggtcccagctactcgggaggctgaggcaggagaatggcgtgaaccctagaggtggagcttgcagttagttgagatcgcgctattgcactccagcttgggcgacagagcaagactccgtctaaaaataaatagataaataaataaaaaataaataaatatcactgg

SEQ ID NO: 69523 - DNA, 1144 bp, Homo sapiens
aaaattagccaggcatggtggtgcgctcctgtagtcccagctacttgggagattgaaacagaagaatagcctgaacccaggaggtggaagttgtagtgagccgagatcatgccactgcactccaggttgggtgacagagagaggctccatctcataaaaaaagaaaagaaaaagcatttctgaaaggaataaaaaacaaattgataacatcccctaatctctagttgttgggatgtagtatccttcatttgatcaggaaatcatatgattgttcttaaattattaagttggcagaatttgtgtggtttcataatgatgcttgtaagatgatattttaatggaaatgttttagactatatcttttgttgtttttgctgctgtttttgtgtaaggcttaaatctaccccctttaaaaacagaaaaataaaaggattatacagatttggtatatccatccattgactttcattgtcagcttggacatttagtatccatttacattatttattttgttcatacctgacttgcttttctctcgaattttggagtgaggctaggggaagataaccatgttagcatttatttaatttgctggaaactaatctaaaataggatcattgctgactcttgaataaaatggttacatttgtctggtaggatttatcatttgtaatgtctggttaataaaatacttgatttgtgctcaggaaatgtttgtattgtggaaattatttggaagaacacattgtgattggattttgacaattgccagatattggtggggctccatgaatgttatcaaacaaaatgccagagcattactaagtgtcagatatgggcatgagtgtgctcacattcgctcccctacctatgttcattatcatttctccacaggatgctggaggtcagcagattggcttcttgctaggaagctgtggtattgccttagctcttaccagtgaagtttgtctaaaaggactgccaaaaacccagaatggagaaattgtacagtttaaaggttagtaacattgtacctgaattatcagttaaaagttaaaactgagtgctttaattagctttttaatttagtaatagctaggtactttacatatatgttctatttaattctcatagtcttatgaag

SEQ ID NO: 69524 - DNA, 1120 bp, Homo sapiens
aggaggcagaggttgcagtgagccgagatcgcaccactgtactctagcctgggcaacagagcaggactctgtctcagataaataaatacatacatacatacatacatacatacatacatacatacatacatacatacatacaccagtcccagctaccctggaggctgaggcaagagaatcacttgagttcaggaattggaggccagcctgggcaacatagtgaaacccctgtctcttttttttttttttttttaaagcatatgccatatgacagcagtactacatgtccatatagggaaatacttgcacaagtccagggaaggaagtaggaatgtgctccttgaaacattttttgtagtagcaaaaaattgtcattaatagggaaatgcctaaataattgtgatatagccaaacaatggaatactgtgccgcagttcaaaaagaattatgtagatctcttatactgatatgcatagatttagctttagaacaatttaaatgaaaaaaacaagttacagatatatgtataatatgatgtcttttatgttaaaaatacttatatatttctatgggaacaaatatctatgaaaatgcattgaaaaaagattggaaggatatctgtcaaatttgtaactgattatctctggcgaggagaggagggaaccaggtttgagggtaggtattaaaggaacttcaatcttatatttaatatttaagattgttttcaaagagtgtgtatttgagtattacttgtataattaaaattgctaacaaaataccagctcaattttaaaatactaagtatgtattttgtattgattacttttcttctttctttgtttttcagaatgtaatgaataagatgcacacaatcagcgtaccctactctgttatgaaaacctgtcctctctcttgggtccaaagagtacatgctcacaaaggtagtcacctgcaacatctgagctttaattatgtgactgtttgaattaagatttcagggatttcagagattttcaaattgcccttgtatgcccctgtcccttaacaaattgtagagtttagttactacagaattaggtaccttgcctgttcatctcactgatgtcctctcttaagcatt

SEQ ID NO: 69525 - DNA, 1050 bp, Homo sapiens
ttttaaatttaatttttgagagatggggtcttgctctgttatccaggctggagcacagtgacacgatcattgtagcctcaacctcccaggctcagatggttctcccaccttagcctcccaagtagctgggactacaagcatgtgccatcatacccagctaatttttgtattttttgtagagatgggggtcccactgtgttgcccaggctggttttgaactcctggcctcaagcaatcctcctgccacagcagttgctgggatcacaggtgtgagacaccacacccagctctaatttggcatatttttgggagagaaaatggagaatttttttggtattgtagccagaggaaatttgtcttcctatgtatttgtatttttcccttgatgttatttcattcaccaaacttgatgggttcttcttttcaggcctggagttccaggagcccctttgccaggaagagccattctctcaatgaatggattgagctatggggtaatacgggtcaatactgaagataaaaattcagcactgacggtccaggatgtagggcatgtaatgcctggtggtgagtcgcaaggagcatcatttggtttttcataaagatttgtcatcagagataatagagcctgataaaatacagaatcccaaacgaggaacccttaattcagtacttaacgcatttaatttctcagagcctctctaatagttaagtcattataattatgctgaccttccagcagtattgtatgacttaccagttgtgaatgcttcaagtccatttctttacctggaaggccaaatactgagagatgttaaagttacctggttttcactgtaattgccaagccattgggactggcagaaaattagagcatactgcttccaagagtgtttgagtttgacctgcctaagggtaacacctcattcatctaacctgtttatttgggctttgcattcatcgttaatatgtcactgtctctacaagctttacatttcaaatatacctatgtagtttcaggtttatgtttagcattcctgtctggtattt

SEQ ID NO: 69526 - DNA, 1050 bp, Homo sapiens
agggctcagaaaaatccaggcacttgcctaaagtctatgttactagtaagtggcagagccagaaattgaattgacaccaacgactatgctgtcctgtcccccatggagtggctgagtgggctaagtcaactcttactaacttggaagggtatctgagatatatttcgtggaaaagcaagttgcaaaaagtataatatctgtttgaaaaaaaaaaaaactcagcacatttatttatatatacatattttttatatgttttatatatatatttatatatgtatcttcttaaaagtctagagaggtaaacaataaattgtaattatttcttatctctaaagggatggaattactggattcactattacattattttttcactgagcatgtattttaataaaactttttaaaaatcacatatactttctaagaaaaagcaaagtttttcacttacttcattttgtctcttaggtaattccagtgaattctgcaggctctcctgttggggatgtgccattcatccgatcaggattgctggggtttgtagggccggtaagtgatgctttcatgttgattttgttacatttgatccaaatatttggactttaattcacagaacagaacaaattctgattagtccaagagtgttacagaaccacttcacttatatttaaagcagttcttgtaaggatgtcataaaatgagttagtgtttatcatttccactacccaagttcatttgactccttcaaactaagacattttttattttctttttttccccgctgagatcagaagacatgatgagactttttttattttaagaactcttttcacttattctcactatctcgctctgatttgattaacatgttgcaataagttagaagagtgctggaaaaagttatcttcagtagcaaagacaaactataatacatagtatacagagcattttcatgtaaatgattggcactatgtgatgtgtaatagtgatcctttgagtgaaaacagtttgggccgggtgtggtggctcatgcctgtaatcccagcactt

SEQ ID NO: 69527 - DNA, 1050 bp, Homo sapiens
ccatgtcagaacaaaaaaagaaagaaaaagcgtcccatacatgtctttttgtttgattttattttattattattttttcttttttgagacagaatctcgctctgtcgcccaggcattggctcaagtgatccttccacttctgccccttgagtagctgggactacaggcatgtgccaccaccacacctgactgatttcttttttgtatttttagtggagaggagatcttgctgtgttgcccaggcttgtcttgaactcctgggctcaagcagtgctcccacctcatcctcccaaagtgctagcgttacaggtttgagccaccctgtccagccccacacgtctttgatgctaagggaattttcactagaattgataacttgctaaggataatctacaaaagcacaagcctttcaggtatgatgttgaattggctgtgcttattactgtttatttcctttctgagctttgacccgcttatcctttctgttgtttaaagggaaccactgtatgcacagccagctgccttcagcttcataagcgagcagagaggattgcatctgttcttggtgataagggacatctaaatgcaggagataatgtggtgttgctctatccacctggtaagcattggattggcagactagagtttaagctccaatactagactgactacaaattataaaaggataggcactcagagctactctctatgacttgcaagcagtgtacttcccaacacttagaagaccatgcacacaggccaaagtgggaaccaatcctcaccccccaagttgtgcagtacagtggctctcctgggaccatgtctgtttttgtacctttagatttctattagtgcctggcacataaaaggcactcagtaaataatgaatgaatgaagtcttcagctacttggcttttggaaaccttcaaaacagatgctttgtttctatgaatgttcaggaatggggcaatttcacccagtccccaaagaaatgttgtgcgtgaattctgtgaacatttttcgtattatgattgatgttactcaggagga

SEQ ID NO: 69528 - DNA, 1010 bp, Homo sapiens
ctgagtagctgggactacgggtgctcaccaccaagtctggctaatttttgtatttttagtagaggcgggatttcgccatgttggccaggctggtctcgaactcctgacctcaggtgatccgcccatgtcggcctcccaaagtgctgggattataggtgtgagccaccgcgcctggcctgacaactttaaattccactttcaaactcccaggagattctggacaactcagctgtgttcacaggggcaagatgtctctcatatatatatatattcattatataatttttccctcagtcttatcaggtaaaattgaaaggtgtcatatatggtagacatgactgctgacgttctggttgggattgaggggagaaggcggggaaatgggctaagtctgggacagatgctataaaagataactgaaaaatgtagtgacaagttaatgaattgtcattgaaatttcagtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctaagagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttcatctgttgtacatagttgtattt

SEQ ID NO: 69529 - DNA, 1828 bp, Homo sapiens
gtcctttcctcatgaagttgtgttgcctcaggctgtttagggaccattgcctgtcttggtcacatgagtctgtctccttactttagtccctgggcaatccttgcttaatgcttttgttgactcaacaagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgttaataaatattgatgcctgattctgtttaatccttcacacattgggtggaggctagggaattgatagattttaaatttaactttagatggtaagacccagtgatagctggggtagtctaaggaaagtgaacacagagatccagagtcagtgctattaaaggatactaggtcagggaatcagggtgtcactttgaaaactaaggagcctgttgtcaggactcttcaaggtaataattatagtttagtcttcctcccactcatgtagcatttggtagttgtattttcttttttaattttttgagacagagtctcactctgtcacccaggctggagtgcagtggcacaatctcagctcactgcagcctccgcctcctgggttcaagcgattctcccaaagtaatccccagtagctgagattacaggcatgcgccaacatgcctagctaatttttatatttttagtagagacagggtttcatcatgttggccaggctggtctcaaactcctgacctcaagtgatctgcccttctcagcctcccaaagtgctgggattacaggcgtgacccaccatgcctggcctaaatttgaattttttctaatctgtaattaggctggattttagcttttcctaaaatgagatttcatttgctcttccaattcctggtttcaagaaacttggtgggagcccatcaaattgtgcatgttttcagacaccgaaagtggtccttgaattatttcattgatccagactactctggcagctgagaacattttttcatgtcacagcactgtgataagagctgaagccagagagaaaaaaatatcaagtcactgctctcaaggagatataggataacaatcacaatacaatacaagggttaagagcagacatgcattgtgagagcaggcaggcaaggcacatagtctgatggtaagggaggatagtgaggagtagggaacctctgacctgggtttcagaggataagacagccagataagatagtgagcaggaaggcagagtcgcatattctgggaactagaattcattattgggattactgtggtttgaatgtatgtgtctgcccaaaattcatgttagaagttaagacccaatgtgatagttttaagaggtggggccttttgggaagtgatcaagttacgaga

SEQ ID NO: 69530 - DNA, 1050 bp, Homo sapiens
tccatctcaaaaaagaaaaaaaaaaaagaaatgctgttttattccttttacatgtagttcacctaaagtaaagtagtctgcagttaccaagtagaagtgcattcatacctgttttagtaaatagtgtttgtgggctttttgccactcctttgaattagtgtattatataaccttacaatagctattttctctttttgattaaagttgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaagtaagtatgctttctgtctacagaaagtctcctaacactgtcagagacacttactaactaactcattcactcttgtttaccatctagctgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacaggtaggtagtaaaatcgtagtaccagaatgggtaatgtttttacaaatctcacaacataaccagatgttaactggaactgtatacagtcatgggctgcatgacaatgtttaagtaaacaatggaccacataaatgaatgacggtggtcccataaaattataatggagctaaaaagtcctgtgctaatgtcatagtgcaacacattactcacgtttgtggcaatgctggtataaacaaacctattgtgctgccaatcatataaaagtgtagcacatgcaattatgtatagaacataatacttgatactataataagttaatatgttactggtttatgaatttactatacttttaatcattattttaaagtgtataccttctacttttttttttttttttttaaagttaactgtaggcc

SEQ ID NO: 69531 - DNA, 2074 bp, Homo sapiens
cctggccaatacttccgatttctatatgtatataaacttacatatgacttcacagaaatgttttaagaggacatgcacagaactgagtatttgctcaagcattgtttgtaatttgaacttaaataaaagaagtcatgtgtcagaagttaaccagaggacccataatttcactctttggtatttattcaagagaaatgaaacctttctacaaaaagactggcacaaaaacatgcctatgcagctaaccctagaaacatcgcaagagactggatacacaaatggtggttatattcatacagtgaactatgtccagcagtgtgaaggaacaaacccccatgcagcaacatggatgaacctcagatgggctgagtgaagggacaccagagtacatagtgtatgacactcttacatgaggttctagaataggaaaaaaactaatctctggtgataaaaatcaaaacgatagttgcttggaagggggctgaccaggaaggggcatgagggaactttctgggacagtgggaatgttctgttgtcttgacagaggtgtgggttatacaggtatacacaattgccaaaactgactgaattctacacttaagatctatgtattctctgtgtgtagatgatactttaaagagaaaaaaaggtgaccacggaaaattactgaagaacatttaccatttaaagaatgtgaagttttttctaacattgtttttttaatgctcatatttagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagcaagaaatgaactttcagcagtctaaattttctaaataaccaatagttgccaatctaaaatggcagagaagatgaaatttgataaactgaattttttttaaaaatccatttaccctacaggtttgcatttgtttgctgaaatttacctttttttagttatatatatgtgtgtgtgtgtgtgtaatttctgccaataaattctaaattacaaaggtaagagaaaacctagtacattactaaatatataaagtatatgttctgattatgtatacttgttctagtgtcaagtctttttaagtgggtttttaaaagtttgttattggacttgaatggatttttgagactaggttaattatttttgaggtcttatcctaaaaggcatctaaggtacatgaatggagtatggtgattttataacattttttatcagaatggaaaaagaactgtttaaaagtttgatacttttaaatagttggtttttttgcttactctggtaatgattttctacaaatacataataaattgtttttttgagtctatattctgtatgcagttgaatatccattacttattctgctgtgctttaatagaatggaatgtttacaggcccttaaaatattatttttaaaaaaccttctgaagatacataccaaagtttttccaagaagattttataatcaatttaataatgtaaggtttatcagattctataatagtatagttattaaggcaattttatgttagagactattttgtaatgtagtgagtggtacctttataagaaaagtgactgccaatatatttttatagctgatctttataaattctaatgttgagtttttaatgattattttaaatgtttatatagtttagtaaaatttgcatctcaaagtatcatttttatattatgggacgttttcagattggctaatatttgcattgtaaattttgtatgcagtttat

SEQ ID NO: 69532 - DNA, 1038 bp, Homo sapiens
attgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaatatggtttatatctttgctggcttggtttcctttttcttaatgtctctgggaggcttattccttcattgtggaaattttagctatttaaacatgtaaatttttctttctacagccaggtaactataaacacagccaatagattttacacaaagcaatcctagaagtatcagaatgggttttgaaaagttcaagtccatca

SEQ ID NO: 69533 - DNA, 1076 bp, Homo sapiens
ttctccctcttggtacatgccatttcatgtttttgttttttaaatgaaaggcttttctctgctccagtgccaaaggataatagggctcaggattgaaaccattgggaatttgatttctaattcacacagtagtaaaatacaaaagcattctgcttgtttgttcttatcctgatttgaagcacccatccttaggcagagtgtgtcacaagaatagtcagagtgctaattttgctaaggacatttggtaccatctcagtccttaactatttcagctcctacctgttattttgcatatcagaagccattcatgtatgtatctgtaagccatttcttttctgaaataaaaatcaatatagcagtacagaaaaaaaggcctaaattgatgtgctaattataggtacttaaaagctgatttcaataaatacgtgaaaatcagtctaaccctcttccatctttttttccttagtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggtgagttttgttcagacgttttgaacaaaaggcaaagatttcctcatgggaagggtgttcaaaactgacagctataaatgtaggtcagagacccacccacctcataacagtcatacactcccagagttaaacgattggcctctgatggccacacacccctatgggcttgtgtcttggactctgggatttaaaagatatatatgtatatatatttatgtaaacctgagcatctcagtttgggtagagttttaaggttatatgaaactgatagaacttttgtattttttttttaaatattgttttgatatatcagatatttgttttgtctggatcacaagtgagaaagaaaagagaacaatgctctttttcacaatgaactggtcaaattgactatcttgtaaagtgatactttactatgtcagtgaaatttcagtttgattttagt

SEQ ID NO: 69534 - DNA, 3817 bp, Homo sapiens
agccaggaggattgcttgaggttaggagtttcagaccagcttgagaaatatagcaagacaccttgtctctacaaaaaaaaataaattagctgggcatggtggtgtgcgtctgtaatcctggcaactcaggaggctgaggagagaggattgcttgagcccaggaattcgaggcttcagtgagctatgattgcaccactatactccagcctgagcaatagagggagaccttgtctctaaaatgtaaaataataataaagattttaaaaaaaaggaaaaccacagacacaaagcagtaagaacagagaaattcaatatttaaaatagtatggacaaactttgttgaggaaggcagctgattttttgaagggggagtggggttgagagaatgacttgtgcaacccttggtggtagaagatgggcacagctggatgttcaaggaagggagcaggtttgcatttgagaagtgctgtgtgagcagtcatggctcttcaaagagcctggtgagtgatgaccatattttgtctttcagggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaatttggtttcctgggtatttttttaaccttgaaataatttattaatagggttacaacaactttgatacaaaaaatactgaaacagcaactaccacctggaatggcacactaagtccacactgttaggattttctccttagaaaggatagagaaataaatggatttagtcctcagaaagcttggattaattgcagataccaggatattaatttccatttacccacttagtcaaatagttttaccatagctaaaggtcacatcattaccatgttgaaacttgggaaaaaaattttattctgcttttctctaagctgactattttctacctgtagcttatttcactgtttcacttttacattctatatgtgctgccaatgaaaaattagtatttgaagagaaaccaaactcatttagcttaaagaccaaggagcattttggcagacctgatataaatggaaatattgacaccatttattaaaaacaaaggcagagctcaggcacagtgaactttactaggcacatgacaggaaaacttgagtcagcacttgatttgtcccaggagtgtcaccagaacttcattttccctttctctgttgcaaggcttccctgtgagtaacacagtggaattcatctaggaagaattttgttctccatgttgtccttcctcatttagtgctctctctttactttggatttaatttcagaactaaaataggattcaaaacaatgtgaggatcctgttttgaaacatttcctttagctctgccctctggaataccttctgctccttcattggtaggaccaatgaatctaaatctgtcagcttctctaagtcccttagctta

SEQ ID NO: 69535 - DNA, 1079 bp, Homo sapiens
ggttaatgacagctctgcagaattcagcataatgcccaagcatgttgggatgataggaataattatttctcatggagtagttgaggcagcatttatgtttccctttcattaattgtgctgttctctagggtgatacaaggacccatagtaatcccatctgatcttctttcttttccagcttccctttgctctcatacccatcctcacatttacgagcttgcggccagtaatgagtgactttgccaatggactgtgagtgtactcctcttcgttcccaaaggggatgctgatatggggaaagggtatcttcatgcagtaggccagtcagacgtgagacacagagggaagcgatatgctttgagaggtgattgctagctgcttcctctttggcttagagaatggaaactgtgaatatagtaaaggaagagaaagcacgtctttcatatgaaggggagagaaagttcagcttttacagcataactcttcagcttcagccactgaagtttgaggcaccttaattctttgttaaatgatcttaacaaaaaaggcataagttagtaccttttatatatatctttaaaggatatgaggtatctgaagtgacttgttgcatttttgggaacgttaataaaatggctcattgcgtttctaggccttgttgcatctctagggacttaaatattagggattatttgttggtgtcttttcccccctctttctccctgtctaccagtatctaactttgggtgatttaacttagacttatgaagaatcattttttttcaaattaagaacaatttttccattcattttgaactgcctctaattcccatcctgtttccttttctgtctgtggccaagttggattattccatcagtgactgtgctgatttcttttacagaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttggtaagtctagcctggaagagcag

SEQ ID NO: 69536 - DNA, 1155 bp, Homo sapiens
cctggccttgtattttttttgtagagtcagggtatttgccatgttgcctaggcttgtctcaaactcctgggctcaagggattctccaaccctggcctcccaaagtgctgggattacaagcgtgagccaccctacccagccccaagaaagtgttcttagtaaagtgtttttactggagtctctcagttcttttatgctggttacattgtgatcctccaacagtagaatatatagtgtgtagcatttcaccaatttatttgatatttccctgtacttctattgccattttccagaatagtgtgtaaaggaatataatttggggaaagtggtgtagacctctttttttttttttttttttttaatatttaagatggaggtttaggagcttggagaagagaaaggactaggcagagaaacgaaggagcatccagtaaagtttagactgaaagcttctggaatgaggtccagacttgagcctagcttctggcacagtgcgcagcacagcacttggtgttggtggtgcatagcaaagaagggagaaatgccacagggaactgctgttttggatattgtctgagcagattattgccacaatcatatccttcctcttggcctctcacagggtgttgtgctgggatgttactttgggcctgctgcactctacatttgggcagtggggatcctggctgcaggacagagctccaccatgacaggaacctattctggccagtttgtcatggaggtacgtgctggtataggatagagggagataacacaacccttttgttacttcttcttcttcttcttttttttttttttttgagatggagtctcactcgtcgcccaagttggagtgtaatggcatgatctcggctcactgcaacctccacctcccgggttcaagtgattctcctgactcagcctcccgagtagctaggattacaggctctggccaccatactcggctaattttttgtatttttagtagagatggcgtttcaccatgttggccaggcaggtcttgaactcctgacctcaagtgatctacccgccttggcctctcaaagtgctgggattacaggcgtgagccactgcgcctggccccttttgtcacttcttaatcccattcttctgaggtctctcctgaacctcccca

SEQ ID NO: 69537 - DNA, 2082 bp, Homo sapiens
tgggagattttagaaacctttataaataggtatatgcacaccttaggactgaaatcaggtcgtttttataggtcagtggtccttccagccactgagagtaactgagagctcagtagtcatttagtctctgttccctatttggggaatgtacagttcaacgaaagggcatgaagttcttttttctccccccatatgaagttcttaattgctcagtgaactaggatgtaggtgagtgttggatctctcacttttcgtctggtcaacttttgtcccctaaatctctcagctgactccaaactcctgaaatgtcacaaggaaacttgttctaactggtcaaaaagtgactgctgttgttatctttctagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggtgagtaagccagggttatgggtggtagtgaatgtgagggtaaagtgaagactgcaatgggatggggaaggaaaatacctcatcctagtgttaatgttcaggagaaataatctctagcttctcgtctgccccccaaaatcactgtgcaccagtcagagtctacagtatggggctgaccaagcctggaccctctttctcagcttttgtttgggagtagtcaacaaacagaaaacagaaactgtgatgatgacagactttgtcttgtcattttgaattctgtatcaatcttgatttctgattacctatgtagtgttttttttgagacggagtcttgcactgtcatccaagctggagtgcagtggcacagtcttggctcactgcctccacctcctgggttcaagcgattctcctgcctcagcctcctgagtagctgggattacaggtgcctgccaccacacccagctaattttttgtaattttagtagagatggggtttcaccatgttggccaggctggtctcaaactcctgacctcaagtgatccacctgcctcggcctctcaaagtacagggattacaggcgtgagctcctgtgcctggcctgcctgtgtagttttgatcaccatttgtttcccgtctatggaacctctgactcctctgtctgctttgactgaggattctattctgggtgttctctcatgtctgaagccttcttcagagcctctcctcttgtcatcatttaaagtaccccagcgtttgtacattattaccatgcacactgtaactcagtaaagatttttgatgacctgtgggtgtagaaggattatagaggaagatcctagataacattgctgctagtctctgcccacatcacagcatatgtccagtgttttccctccagcctacctcttatagatgattgtgtatgatatgtaggagagctcttatttggtccttgcttctgaaacaaaagttgctgttgaattgctttgggttctaggttgaagtctgtacaaataccagcagtcctcatgctggcctctttcctaaagataactcgacactggctgtggacatctacaaaggggtaagcatgtttggatttgtgatctttgttcctgaatcagtatttttagcatagtatgtggtcttttttgtgacttcacttcagatatgagcatatctcctctggagtgtcatttatttcagagttccagacaccagacaagcattttggattaaatgggaaggaatagaggatcagttgaaaagatatataatacaggccgggtgcggtggttcacgcctgtaatcccagcactttgggaggctgaggcgggtggatcacttgagctcaggagttcaagaccagcctgaccaacatggtgaaaccctgtctctactaaaaacaaaaatacaaaaattagctggatgtggtggtgggcacctgtaatctcagctactcaggaggctgagacacgagaatcgcttgaacctggaaggcagaggttgcagtgagccgagattgggccactgcactccagcctgggcgacagaata

SEQ ID NO: 69538 - DNA, 1008 bp, Homo sapiens
tgttgggaagagagtgtttttcaatgtttcctttctttccgtctctctgacttccatatctcatctctgacctagaattcctctgtggggtggcgttctcatcaccattgcagatacttttgtatttctcttcttggacaaatatggtaaggagagcgggaatgggagggtcaaaggagctgctctctgtcatgtggcagatggggaagtctaccttctctgagctcactgctgccttttttcctttaggcttgcggaagctagaagcattttttggctttctcatcactattatggccctcacatttggatatgaggcaagtggtacaggatattcattagcttcttaaaataagtttttgtggtttttttttttagccttttattataaaagacagtaataatgctagtatgattcacttatagtgggtgtatcaacaaaaagccaatttttccctgggccaattttaaaggaatatgatctatagcaaagattagcatgcagaaaggcctgcaggggctcccaggtttaaaatgactagatattttagggctttccagactagattctttggtcccaagttgaccatctgacaacagaacagccatggatagtgttaattaaggagggggttgcagggttattcttgggtgttaacttacaggagttctgcttttgttcatcctggtttatattaattgcagcttgaactttcccaatattaaaacagttaatgaattatatgaaatatactggatatttcctggtttgtgccccaacccagaaactccttagagtcactaatattatttgcagtactagcacctttctttgtacaattcttataaactgatttctgcttactggtctggctgaactttaaaaaatatatgtaatctatgggttgattatgcctcttggcctaaggcttccaagagaaatactgaaccggggaagagtatatatgagagtgtttaaggatgagtctctcattacacacgtactag

SEQ ID NO: 69539 - DNA, 1027 bp, Homo sapiens
cctcaggggctacatgcagatacttcattggcagtggctcttatgtgtaaagtactttccatttggtcttatttttatccacatagtttccttgaacaaaggagaaactacatataggagaaactgaggctcagaaaggtacaaggtgacttagcaggtcatgtgcaaaatctgttatagaactcaagtcatttgattcttgacctgggctcttttctgaatgcagtatttaccactcatgttgccaaacaactaaacaaacaaacagacaaaaactcagttgttcaatgagtgttacaggagattttgttcttcttagttgctctggatccttctgttggccacccttgtggggctgctgctccagcggcttgcagctagactgggagtggttactgggctgcatcttgctgaagtatgtcaccgtcagtatcccaaggtgagcaatgtattgtcctgtttgtctctcacccatgccataggaatctgtgtgtctggcggtatgtgctggcctcattctatagtgagacagtcaaggacttgggggtcagtggccctgaagacagacggtaccaacggaaatactgtagctcctcctgctgccaggccatgttttccccctctttcaaaatctaacttgagactcgcatttcctagaaggttttcttagaaaaactgtgttaccattcactctggcttccagtatctagcaatgcccagcccaaggggaggaggatgctctctctaagcacttttattcatacctccatgttactccatcagtttgcattttatatatgttctttttttgtttgactttgccatcactttgaaaaagtaattttttttctttttagtacaaactatatgtggcaagatctttggatttgctaataattatttttcagtttcccctcccaccgggggctacactgtcctctgcagcttcttctggacattttgggcctttcttaccgttgcctaaggcaagaatgaacactatgtctggaagatatttttaacttag

SEQ ID NO: 69540 - DNA, 1203 bp, Homo sapiens
attggccagcaatgatcaaaatggcctaacttctcttccacttttaatttcaggttaaagtaatttatattttttggcataaggaacaaattagggtttttagtcttgttttggtgcttattgccgataagtcattttgtgtcaggtttgtgtttgttttggtctcatctctactaagctgatagctgttaaaactcctaggaaatgaaagaagaaagctacaagttaattattaaaactttaccaggtttcaaagagcagaaagaggcttgttaaaggctggagaatcttgtagtatatattgtcttaatttttctttgcttttaggaaaagaaacttggaggacaatatttacttaaagttgttaaggtcaatctacatcatttgggagccaatatccatcattaggaaaaatgggttgaatgtaatctaatgaaaattcttcatatttgccagagaaaagctacttaagtgtgaggacaaaacatattttctgaggcaagaagtaggtataggctggtttaataggggatttttttttttttttttttggaaaaaagtaatttttttttttttttaatggagactgggtttcttgctatgttgcccaggctggtctcaagcttttgggctcacgcaatcctcccgcctcagcctcccaaagtgctaagggattacagatgtgagccaccatggccagtctaatagggaattttcttattccaatagaaaggggtctttgaaattgttcacagagcttggcattgtgttccatgatagaggtgtcagatcaggaggccaggtttgtcccccaaaaggaaacacactgctgtaaacttctggttaggaggaagtttagaggaagctcacacagagttgggaagaacaaagacgaagctatagtcactggaagtaagactttagtgaccctgacttgtgagcattcagggagatttggaagctggttaagcctcaagagtgctgatgggagaaggtgaagagttgtatttaatgggtaccagccccttctaattctgatgtctctggttgatgtgtgatatttttgtttaaaagataagtactccttgacagcctggccacatttctcccaactgttatcgtttttgacacccaggcagctggtttcattatcagctgtactcttcctccttacatcttcctcccccctcctcttcttgcttc

SEQ ID NO: 69541 - DNA, 1719 bp, Homo sapiens
tgtccccgctcaggtggatcgcatgtcctttccatgtggctgctcccgggatggctgtgggaacatggcaggacgcattgaatttaatccaatccgggtccggactcattacctccacaccattatgaagctggagctggagagcaagcggcaggtgagccgcccagcagccccagatgaggagccctccccgactgccagttgcagcctgacaggagcacagggctctgagacccaggacttccaggagttcattgctgagaatgagacagcagtgatgcacctgcagagtgcagaggaactggagcggctcaaggcagaagaagattccagcggctctagtgccagcctggactcgagcatcgagagcctgggtgtgtgcatcctagaggagcctctggctgtccccgaagagctgtgcccaggccttacagcccccattctcatccaggctcagctgcccccaggctcctctgtcctgtgttttaccgagaactcagaccacccaactgcctcaacggtgaacagcccatcctacttgaacagtgggcccctggtctattatcaagtggagcagaggccagtcttgggagtgaaaggagagcctggtacggaagaaggctcagcctctttcccaaaggagaaggatctgaatgtcttctctctccctgttacctcactcgtggcttgtagctccacagacccagctgccctctgtaaatcagaggtggggaaaacacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcagctgctgctcccatgttattttattggggtctttggggaatgggtgggaaaggattgtttgagtattttttaaaagggaaacagtaccaaggagaccagccctaccttgatctggggatagtcttggggcaaagaaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacctgccttccttcaatcccatatttggtaaataagttaatatttgacatgtttggtgttctctgacctgttccccacactggggattcctggtctgtaacttgaattgtttcttccacatgttcttaagtactagagttaaacttgtctatgtgtcttttttctctccatcctttttccttcggagaaagagctggattggctggggatatggtataacgagcctgagccttctgtacgtgt

SEQ ID NO: 69542 - DNA, 1078 bp, Homo sapiens
ggaataaatagagaatgggtaagaggcaggacctctagcgcctgtcacactgccagagggagttctaaggaagaatcttcagggggccgatcctcattctgctgggaggtcttcaccatcccacagccctcttcattgtccgtgcggaaggggaggcttgagggggaccaggaagggtggaagtcttcattttcaggctcctcagggttacaatcttcgggcaatagagcttctagggtgggtgttttccccacctctgatttacagagggcagctgggtctgtggagctacaagccacgagtgaggtaacagggagagagaagacattcagatccttctcctttgggaaagaggctgagccttcttccgtaccaggctctcctttcactcccaagactggcctctgctccacttgataatagaccaggggcccactgttcaagtaggatgggctgttcaccgttgaggcagttgggtggtctgagttctcggtaaaacacaggacagaggagcctgggggcagctgagcctggatgagaatgggggctgtaaggcctgggcacagctcttcggggacagccagaggctcctctaggatgcacacacccaggctctcgatgctcgagtccaggctggcactagagccgctggaatcttcttctgccttgagccgctccagttcctctgcactctgcaggtgcatcactgctgtctcattctcagcaatgaactcctggaagtcctgggtctcagagccctgtgctcctgtcaggctgcaactggcagtcggggagggctcctcatctggggctgctgggcggctcacctgccgcttgctctccagctccagcttcataatggtgtggaggtaatgagtccggacccggattggattaaattcaatgcgtcctgccatgttcccacagccatcccgggagcagccacatggaaaggacatgcgatccacctgagcggggacaagaaggttggggcaagatgagacctacaatcctaacaatggagacaggagacatgagctggcaaacaggcagttgggatttgaggtctccttgtaag

SEQ ID NO: 69543 - DNA, 1199 bp, Homo sapiens
tcgccgcggggcccgggactcgctcgctcctccctccttcccaccgggctagggcggcggcggcagcgggggcggcagagaccatcacgggaggaggcagctgcggcggggccggtaatgggcctaggggtgcggggcggagggtgccgcctcgtcctttctcgggatcggccctcgggcggccgtggaggagtggtcaagcccagagccgtgcggatggaggggtcagaaatgagaggctcggacgggagcggtcggggggcggggaggtcgggtgccgttgggaaggaaccgagtcgggaagaggcgtgggagcgaggggcaccgaggacgctggcccggactgcgggggcagctcgcgggagaccgatgggcggcttggaagcctgcaggattgcagatgaggattgagttcggaatggagtggagaatgatgtaggatggaggaaagtgaaggaaggggagggggaacagaggaaaatgtgggaggagtggttgggaatttgtgagtagcaggcaggaagggatgcggaaggctgggtaggggctgcagaggattggaatgagcgggaaggttagcaggaatcagagggaagtgggccgagagctgaagggttcggcaggagtgttcattaaaaggaactggtgacttgacatgtcccttcgctccggttcctgatgtctcccatatttctggcgtcgtgtgggaaaatgaaagcatcaattgccctggttgctagcttgatcttttttcataggcccaattacgcagccaactgccacccgtcccttttagtgctgtggtcttgattcatccttttaaaggggttgagagtggcagtgtgacacacaaactgttcttcagaatgaaatgctagaagttatccccacaagacaacactgtccccttgtcctgcagttttcagttcaaggtaaattcatagttcagatttttttcttcactggctttctgtcttgcaaatccacaaagccaggatgttggttgtgccggtgttataaatgactggatatccttgagagttaatgcagcatcatgttccagttcccacaaagatctgtcttccacacgatggtagtttaggcatggaaaattctaaccttgtgttagtgaatgggtaaaaatcggggagtgggggtggtgagtgcacggctttctttaaacacctaacttaagcggg

SEQ ID NO: 69544 - DNA, 1112 bp, Homo sapiens
agaattcttgacataggtgagttaagagaatctattgcctaggaaatgcctttagctatggacccagagttggttttctttatttgacatttaccttgattcatatgcttgagaggctcaattagtataaaccttgaaattatttactaagcataaaaaattttaagtaatacaagttaaaatgatatcaaaattgaagttggaagtgtaaacactttagttccatagcaactataggttgattttgttgttttttaagttgtggtaaaatatacattacataaaagttatcattttaaccatttttaagtggatagttcagtaacattaggtacattcacattattgtgtaaccatcactatcatccatctccagaacttttctcatctgcaaaaccagaagtctgtacctgttaaacaacaactccccattctcccttcttcacagcccctggtaaccactattctcctttctgtctctatgaattggactactaagtactgcataaatgaaatcatacagtatttgtccttttgtgactggcatttttcacttagcataatgttttcaaggttcatggtatagcatacattagcatttccttcccatgcaaggctgaataatactccattgtgtgtatatatcacactttgtttatccattcatcccatgataggcacttaatttgattccatttcctggctattgtgaataatgctgctatgaacatggatgtacaaatatgtgtttgagtctctgcttttaattcttttggatacatatccagaaatggaattgctgggtcatatggtaactctatcttagattttttttagaaaccactatattgttttccacagtgactacacattttacatttctaccagcggtactcaaaggttccaatttcggccgggcgcgatggctcacgcctgtaatcccaaaactttgggaggccaaggtgggcagaacatgaggtcaggaaatcgagaccatcctggctaacatggtgaaaccccgtctccactcaaaatacaaagaaattagctgggcgtggtggcgggcgcctgtagtcccagctacccaggaggctgaggcaggagaatggtgt

SEQ ID NO: 69545 - DNA, 1046 bp, Homo sapiens
tatcaaactagaagtcctacttcagagatttgagttctaatgtcatacttgatatctattactagcttcttttgcttagctgtccatttttagtgtccagcttcctcttcctaatcatattccctagacactcccattggttactgtctgagaagtattactctacctggctctattatttaccaattgtgtggccttggacaagttgctaaaactcttttaagtttcaatttctttgtctgtaaaatgggattgataataccttagaaaagtatatcagttaaatgagataatgtgacaatacttagcacagtgctgagcatcttgtaaaggcttctgattgttgttactaatactaataatattattatactgttgtatattcaaccaactgaattttattctttccgaatctagcaaagttaatttgtggtgaatataatatgtaattactttttcttctaggacagtcttatgaaattcgaatgctagacaataggaaacttggagaacttccagaaattaatggcaaattggtgaaggtaaaacgaataaatcattcttctgtacaatattttttactaatccttttgggattttaaattttgttgttgttgttaatgttcttttgcttccaatggcttaatggtatctcttgcctgcagtaatttgttggcagagtagtaagctgatgtgttatttctttggggtcagagtaagccccagtattcacatgaatttttcagagctgcagaaatagaacgcttaccactccctgtccagggtaatcacccctggctcagtgaagttcttttgggtggagtaaagtaacctccttgagatctttagagaagcctcagtgtcttttttgatacttagtcttatagcaaggaaaacagaagctactttgatgaagagcagttctcttagtctagattaacagttaggattttgataattcacagcacagttgaaacagaggagttttgtcaaaaggtggtgggaggaattaataggcacttctacaaagtaagagtaacaaaagg

SEQ ID NO: 69546 - DNA, 1744 bp, Homo sapiens
acacttgcacgccgggtcctccccgtgatcgcccagcccatctcgggggcagagccgtggcgcagcccgcctatcatcgctgccgagactgacgcggtctcttctttataggcgaacgacagcgtgacgtcatgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgaggtgagtgagattttcccagaccctacaccttctgaataacaaaggcggatagacactaagaaaaggggttgagtgggaaggaggtgtatagagttttaaaaagctgtttacgattggggaaaagggacttgttcttttgtcgctttgagtagttagtgttgtggaagaaatggaaaaagcgattgtaggcgatatgaagcctgtgcagaatcagtggaagaaggaagtggtccctgattagtaaccagatgaatgttgagaggcttttgtgccaatgtgggagacttggggactgatggtgtatgtgtgggtaagtctgacgttgtgtgaagaagggttacatatagcataggaatggtatctaggaagttgggaaattgggagctggtgcttaatgatgaatattggttcgtttcttgttggaaagatatggaagtccttgatgaagaagtccgtacagctctatcttaccactagcttgctttaagactttacttaattctgggatttctgacttttaaaacataagctgtgaaatgaaaaagtgacgaagaaaacttaagatgcttctggatctttatgtatcaagccagttgttgataacagatgaaaaatctcctttcggccgggtgcggtggctcacgcctgtaatcccagcgctttgggaggctgaggcgggcggatcacttgagctcaggagttcgagaccatcgtggccaacgtggtgaaaccccgtctctactaaaaatacaaaaattagccgggtgtggtggcgc

SEQ ID NO: 69547 - DNA, 1056 bp, Homo sapiens
attcccaacccaatactggggccttctcaaaaggagcaaattaaacaataaaccagacagcaaggccctgggggaaaggacaacatcctgaaataaatgatggagcccaggaaggtctcttgtggaagttgacttaactctaattttctttgtaactttaagccttggatacgggaggagaaatctcattttgtcgagtctcagaccatgtctgtgtgtaagcaatccccacagtgtcctctgagccaaggacacccccagatcagattgagttttgcttctagacggggtagctatggtaccttgggggttagctctcatccaagctgttaagtgagtttccagcctcactgtggctggaaagcccctaaaattcagtatgtaactccaggaagtcaggagagaactgagatttgcctagatgaccacaggcttgcggtgtagattatccctaaagggccccaagtcacgggggtcaaccacccctgtcttcagtactcttatccttacagaggctggtctctaacagctgcctccagtggacctcccatgatccaccctgagggaaggaccgtcagctggggacacatcaccacctctgtcagtcactggtgcagagccacctcctagcctagcttcctctggtgtcctgtttcctttcccacttactgttggtgcctcccaggccctgcagtgccagcgtggccaccctcttggtagcctggccagtaagaggaggacagttgtgtgctgaattagcacacgcacgtgcagcgcgcacagacgcgcgcacacacacacacatacacgctctgctgcatttggacaaaccatgcctgccagagtgtagcagaggtgaggaagcaggtgggcagcttgcctgacccagcttttcaggagagcgtgtctccaacagagagtctccacactctagttcagggttatcgacctgcctcaatgagatgacagactcatttgggaggggtgttgcaaacaagttttcagtgagaatagttaagttccagagcttgtaaaggattcagtgactgacacttc

SEQ ID NO: 69548 - DNA, 1008 bp, Homo sapiens
ccaggtgcagtggctcatgcctgttatcccagcactttgggaggccgaggcgggtggatcacttgaggtcaggaattcaagaccagcctggccaacatggtgaaaccctgtctctactaaaaatacaaaaattagcctggcgtggtggcacatgcctgtaatcccagctactcgagtggctgaggcaggagaattggtttaacccgaggggcagaggctgcagtgagcacagatcgtgccactgcactccagcctgggcgacagagtgaaactgtctcaaaaaaaaagaatccttttttttttttttaacctctacagatacttgggagaacctaacttctctgtcttctgtgattctattctgacttttctagatggtatagaaattgtattactgtgtcacatcaccctttgcctttccaatcccatcttacccaggatgtgctaggtgtgggccggcccccacccgaccctgacaagtgaccatggatcctggagccgggtcagagacatctctgactgtcaatgagcaggtatcttctggggtgggaagtgggggggtaagggtgatggagtgaggggtgtgggcaacagaggaggactccacagggcccttcactctctgtttcttaccagggttcaccatcacttcacctgtccagaggtacttgccatttaggatttctcagggcctgggtttggggagttaagctgtgactttaagatgtaaaatcaaagtgtacataatatgtttaagtttacatggggaaaggtttgaacatcaggtaatttactccttagtttttcttcttgcttacacatattttctaatttttttttttttttgcaaattactattacttatatcttttttgtttgtttgtttgtttgtttgttttgagatggagtctcactctgtcacccaggctggagtgcagtggcgcaatctcggctcactgcaagctccgcctcccgggttcacaccattcttctgcctcagcctcccga

SEQ ID NO: 69549 - DNA, 1033 bp, Homo sapiens
tccagcctgggcaaaagagcgagactccgtctcagaacaaacaaaaaaccaaacctgatcccccgcttttccagtgaggatattcctcctcacccctcagccctgcacccttttcccagtctcacggttcacttccatcattcacaccctttgtttggaagtcgaccttgaatagtaatctgtaaggaaaatcagaactgctgttacccacgaagtctgggctggttgtagacaggctgtggagactacctagagcagaggcacccttgataagccagaacagcagcaggccagaaccccagacctgtcctgcattccggagggaacttgggcccaggtagacttaaccccttacttcggtatgttagtaggagcagtgagcagtgcctttcttgtctcgttagaatccagcaccttccattttaagggtgcaaagacaatgcatattttcttagttccaggaatcaggccctctggggcagactatttgcaaatccccttctgcttgctcccactaagttagctacccgatatgacctgcctcattttggtagctctgtgtagtaggcaaccttcatttttttcttgtctttcaggtcaatatccaacacagccaacctaccctgtgcagcctcctgggaatccagtataccctcagaccttgcatcttcctcaggctccaccctataccgatgctccacctgcctactcagaggtgcttccagtttgccagatttgaactagctgggaatactcttagggtggtcctttagtccttagctaaatctgacttcacatatttactcttcacaaatgctaacatgaataatctaaaacactatataatttggcaatttttgtcggagttgaaagtgcattatttgatgattttgtgttatttggcacaggctaaggtgcagaagatgaatttgcgttctgtgagcccaacattagctatagcagaaagtgatccaggagaatattgaaggccagtggaaaggcaacttgtataatcttacaaaaagtataacct

SEQ ID NO: 69550 - DNA, 1059 bp, Homo sapiens
aggaagatcaaagttccctccaaacctaatttgatgttttattactaaaagcaaagaccagtatggtacagtattactccagagaaattaaaggaaaatccttagggcggcttcacccacattcattttatgaatggatacctcccctacctcaaaatgctttagggaggtactgctaccattacatggttccttattaaatttgaaaagtgcctgaaagtttgggcaccagaaagacaccccaacaacatgtgtctaaactgcaacttcaggttaatatgactaaagcagttacattgtgagaagtgctgaaggtatgtgatgtctttcccggcacagaggtggccttggttcctcaccagatggtgtagccaccatctgaaccacccatgaagaagttccccttccgctgagttacgaggacgttggctccctgcatgactgcaagctgagcagcattgggagggcatccaggaggtggaggctgaaaggaaatgacatgatagaatgggcacagggcagctaatataagcgaaggggacataggggaagcagaggcctgttaggatgaggcaatgtgctaaccagctgcgttttaaggagctagttccgccaccaatttgagttctaaagtaggtctatactttatgtgaacccaaagatacaaacaggaaagggagcctaccactcattcaaagggttccagctctaagatgaagcctatggctaccttctgaacatgaacagaccagaccaacagtcattttgagggtagagaaccactgtcctactcacattcccaaaacagggacagggtgccagtccatgtatgaatcccacatggtccctacatagtttttaatttttaattttttttttttttaatttttttgagatagagtcttgctcttgtcgcccaggctggagtgcagtggtgggatctcagctcactgcaacctccacctcccaggttcaagtgattctcctgtcttagcctcccaagtagctgggattacagacgcctgccaccatgcccggctaatttttgtatttatagta

SEQ ID NO: 69551 - DNA, 1588 bp, Homo sapiens
ttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatgccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaagacttgatcatttcatgaattccattccagatgttcaacttttcatcattttactccaacctcttacaaattttggaatttcggacctaaacttagaaatgagggaactattgattctcctaacttgctctaaagtttggcttgaagaaaaggttctggtatagcaatttgtatacgttgaggatgacctttagtttctccaatgttctatgtggagaaatactgaaaactcatagaatctaggttgccaagatagattcctcagctcttttatttattttttgagacagggtctccctctgtcacccgggct

SEQ ID NO: 69552 - DNA, 1093 bp, Homo sapiens
agaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaatcagattctcatgtgcaagaagtaactacattttgacttatttttgcttaaacatttttgacattttcttttccctatttaacgcctttacatatgttctcttccaagcaataagaaccctaggaaagttctagaagtttgcagaactatctcagggatttgagacaaagatggtgcaggaaagcttgttccaggggaacatcattagaaacataccctgggagggccgggttcggtggctcacgcctgtgatcccagcactttgggaggccgaggcaggcggatcacaaggttaggagatcgagaccatcctggctaacacggtgaaaccccgtctctactaaaaatatataaaaaaaatagctgggcgtggtggcgggcgcccatagtcccagctgcttgggaggctgaggcaggagaatgg

SEQ ID NO: 69553 - DNA, 1039 bp, Homo sapiens
gagggcagatcacgaggtcaggagttcgagaccacctggccaacatggtgaaaccccatctctactaataatacaaaaattagctgggcatagtggtcggcgcctataatcccagctactcaggaagctgaggcaggagaattgccggaacccaggaggcggaggttgcagtgagctgaggtcgtgccattgcagtccagcctgggtgacagagcaagactccatcttgggaaaaataaaaaataaaaagagaacttgaggccacatcggcccctctatattttcttcattttcttcctgagacgccatggggtggagtagagcaatgtagaaggtaggtgagtgtgtgtgtggccacaggcagggttcttcaggcttaaagggtatttggtgatgactgatgtaaaaatggggtgacaggttatggttcgtggctagctctgccatggctgaagcatttttaggctgaacccaattagaagaaggtgaagagtcattcatagttcctgcttgtcctctgtgtcctaggctcaaagctaggcactcacatgcctgggtccagttaatctttcagaggctctttccaagcaggaatagtcactgtttctacagatgagctggagccggaggaagcccagcatgtctgtgactggcccaagacccatcactagtaaatggcaggcctgggatttagccccagatgggtctgacttgaaagcacgggctctttccattacaccacactgctccaggatatgccatgtaaccgccaccatgctgagctcaagccagcaccccaagtgagcctccctactccaccccagcttaggaaagaggaacctaacctggaggctgcagggaagggagcagtctaaacataatccaaggcagaaaattggaggtggagcagtggccctgggtctttgagcctggccatctgggggtgcgggaggccctgaaagcatttttctctcagcccatggtcttgtctttcaccatttcatccactcagtctgaagctagggatggggatttggca

SEQ ID NO: 69554 - DNA, 1047 bp, Homo sapiens
agtgggggcaactaatacctaactcacagggttgtggggaggattaaatcagataatgtaggtaaaatgtttggcagagcacctgtcacactaagccctcaataaatggtatcaactatttctattattatgataaatccctgcttcacttcccagcagttatcctcaagcacctggcccttggccaaagccacgttcattactccctgcatgttttgcttaaaaataactctggttgtactatttaatgctattgtttaaacgcacaagctcctgcctgtggagaggcctggtgtctgagaccttgggagtatgtggccatcgtgatctcaagtggggaggtggattcattctggactggggtacaaatgtggcttcttttataacatcagattcagcagcaccgtcaaaaatcaaacaaaagaaatctctttgagcatctattttgtattaactattgtctaggagataggagagatttgtttattccaccagtatttactgaataactgcctctaccaggtactctgcaagaggcgggggacacagagaagtgcaaggccagccctcaaggatcctacagtcaattgggggcatcagattttaaacagagattaccctgtgagaagcagaatcaaagaggtacccttgagtgctgaaggagccggcatgcaggaaactcagcaaatgggggagggcaacatctgtgaagaaatctcacgggggcagaaatgggccgaacactaactggcgagtaggagtcagcgaggcgaggtgagcacatttcaggcagaaggcacagtacctgcaatggtctagaggtgggagacagaagagccagtcacagaactgtaagcagtctggtatggcaggagtagcagaaattgggcctacagaggtggctgaaaccaagtcctaagggccttgttcatcatgctgaggagcatttgcccttgacccaaggcatggggagtaataaagcgttaagctgggagcccagcattacaggaagagcaatatgacagcggtggagggtatcttggaaag

SEQ ID NO: 69555 - DNA, 1056 bp, Homo sapiens
gcaggcttttcagagaggatttctggcatcatctcgggatcaaagccaaggatggtccaaagagttgcaggcccaagggtagctggaggaaaaagacttgggaagaagtgctgagccacagcgagagggaaatgagtggatgggggctgcgggcacacttgccaggaaagcaggaggccaggtgtgggagcccaaaggtgagggagatatacaagacaccaggggcggatctcgtgaagctttgtacttgaaacaatagcaaagaatagcagctattctttctccaaggctggtggaggggcgacctccacgaccttgctaaccatacttctgggaatcatctcctacacagggagcagaaatccttaaccccaaagtcctgtggcttgcactagattctgtgtctcttctaagggactcttcctgttgccctcatgctaagcaaacaaactagagaatgagtgcctcaccaccaaggctaatcccaggtgtctcatttcggttcaggatgtggttagtaccttgaggaactgtaggtttgagagagaaagcttcaggcagccagatgggattgagagattagatgcctaggaagagctcaatttaaccctatatttctttctccagggaaaataaaagaagcaaaaacaggccctgctgtgagggaccacgaggcagtgccaggatgaaagagttggagtaacctaggtgattctgagtgaatcagtcaggaggccttcctggagggggtgagtcttgagcactggcaacagttagtaactacaatcttaccatgcctttgtttctaactgtgctccctctttcttgctggagtgggaaggtagatggaaagtagcagggaagacgaagcctgcaggacggttcaaagctgtcatggcaaacactcccccattctgcaggcctctgtgtgggcttagccgggacagttccagaactgatgaggtgtctagctcaagcaaatccccctgtgctagccccagcatagctcaacctctgtgacaagaaactcctgctacactgaatccccatttcctc

SEQ ID NO: 69556 - DNA, 1050 bp, Homo sapiens
aggggctgggccaggctggtccctcctgccttcgctctctgctggtcgcggtggcctgtagctcctccctcggtaggacccccctccaccttggcgcttacgagatgaatgaggagcccagacctctggaacttggaggggtgagagggggacaagccagagccagggctccacaccctcttcccctcacccacccatgccctgcattccttctgtgccccgtctccccagatcgggccaccccatgtgctctggtacggcaactcttgcagagaggtttcctcctgccctgccacgttgcgcctgagcagaaggggacagcaaggagaagcctcgctggtggaggtcggtctgagccctgcttggttgaattccctccagagcctgggggcttttgggggtgggaagggatctgcctcctgctgtggggaaatggaatctgctgggtgttcatgactgtgactgtcaccgacttccctatttcctcagttgttcagattcccaggctgacaaaaaggagaaacagcttttacttgcatccagggccaatcatcgcagacccagacgtctgcagagggtaggatggggctcttctgtgtatgggggtggagggtggtcagtttgcccacaaagcttacagcagaccccttctagcagccgacaacccattgcagcactctcagaaaggatgttaactctgtgctctgagctcgcccccaggcccacacacacaatttacaggcactgggtgaggttcatagttctggacacaccaaagagcctcgaggacttttgcgccttctaccagagatgtgtgtgcaccacacaggccctattctccgctccagacagatgagctgtctcccttcccatcaaaggaaaggttaagaaggatgagacagggaaattcatgtgatgatgaaaaccaggtcaggtgaggggtttgaaatatgctttggttccggccacatgtggtggctcatgcctgtaatcccagcactttgggaggctgaggctggtgcatcacctgagatcaggagttcgagacca

SEQ ID NO: 69557 - DNA, 1120 bp, Homo sapiens
ggactcagtgatgactttttttcctctcagagtgcaattgaatccttgtttggagcttccatgactgggattgcttattccttgtttgcgggacaggctctcaccatcctgggaagtactggaccagtgcttgtgtttgaaaagattttgttcaaattctgcaagtaagacatttgtttttctgaaaactctaaccagatttagtgattatgctgccaggattaaatgtcagggttctactcagtacagacaggcaatatcattttggattgtaagaaacctgaaaggagaccatcatttggtctgttgtcctgcccccgggtagcaccatacccaaaatagcagatctcctattgttaaagagcttgattaatattcctcagccattattgaagtcttgactttttatctttaaaaagactttccctagctaattcaaacttctccatttccattgtgagtcaatttttaatttggcctaatatcctccccctgctgtttttttttgttttgttttgtttttttgctattgatagtggggcacaagagtgctctggtttccctaattttcctatacaatcttttcttttttccttttatatttcaagtagcagctcatgggactatggccagcccctttttttcttaactgcaagaataagatcataattacattaggtagtaatggcaggaatgtatatgagacaatttctttttttagttttcgtatccttgcgcatatcctgtgaggcaaatctgtatcataactgtgccagagcactatttagaaggaaaatacaatcagaattagggataaactgggttccagtgcttgtttagatgaaatgaattaaccacatttctgactccttgtctcttaatgccatccatccatgcgttctgatgaactttggtcttgtttcagagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcaga

SEQ ID NO: 69558 - DNA, 2356 bp, Homo sapiens
ttaattatactttaagttctagggtacatgtgcacaatgtgcaggtttgttacatatgtatacatgtgccatgttggtgtgctgcacccattacctcatcatttacattaggtatatctcctaatgttatccctccctgctccccccaccccacaacaggccccggtgtgtgatgttccccatcctgtgtccaagtgttctcattgttcagttcccacctatgagtgagaacatgcggtgtttggttttctgtccttgtgatagtttgctcagaatgatggtttccagcttcattcatgtccctacaaaggacatgaactcatccttttttatcagccaggcacattttcaatacagggtacataaatgggaggactcagttaattagatatttagtgtacacccatatatgactagaacacattcttagacttcagtgagcctacatggcagtcacgggaggtacatattaagtaagttctgggtctttgtttcctgctaggacaaatagttaacaagtggctgttctgtactgactacttgctcaggcctgggttaagtgctagggaggtgcaacagaaacttaaaagatagtatctgtcatcagataggaaggaaaaacacatgaaacaatcagatgctatatgcaaagtagtaaacagttggatgtcccctgggatgtacgtgccgtaggagttcagaggagaaaagggccactgggccccaggatggtcaagtgggcttcatgttggggatggggaggcagtggatactcagagaatttatattgcattcagagaagaactaacaaaaccatggaggaggaactggaaaccttgggcttcaaagcaaagtgaagtcaggctaaggtaccggtgatattacgtgtggctaagatatgttttgctctcactcttttggaagcttagattaaggcaggcacgggtcatttgccaggtactgtattttattaaagccacactataaagtgaggcagtccttttatgatggatcctaaattggatgggaatctccaacaaaatagagatatgtgccatggaggaaaataaagcagtaaagaagtacaggaagtgctggggtggagggaggtggccaattttaagtggtatcatcagagaagagctcaaagagaaggtgatatttgagttgaacctaaaagacgtgagggagctgcccaagaggttacctggaggaaaggcatgttaggtagaggcatgaacaagtacaaataccccgaggtgggagtgagcttggcatgtttaaggaaacagcaacgcagtctgtgtgtttggagcagagtgggcaagcaggagagcaataagagctggggtgggagatgtgatgatgccaattgtgtggccctcataggccaagaaggccttttgaccagaagccatttcagggttttgatagaggagtgacatgacccaacttatgtttcaaataattactccagtgactgcatttaaaaaacactgcagggcaaaggcagaagcaagttaggaggctgctaccattacctgaacaggagctggtggtgacttggatctgggtgggagcagtggcggtggtaagaagtgatcagactcgggatatgttctgaagggagagccaataggacttgcaaatagactggctattgggtatgagggagaagtggagttgatgctgctgctgaggtttttggctagcactgaggaccttggctgatcccagaaaatccaagttctcagaactagagtcccaacctggccctaaatgtcccaaacagaactcttcagaggatggtctgggttatgttagcatttgtcagagggttcattctccctcatcatatccacactttatgagcatcagttgggcaattaacatattcctgttgtttaaatttgcttgcattaattcaactgtaagatgaaaacattcttctgaggatttttaagccttttacaatactaacctcttttctactgtatttaacctgccaaaacatgtgtccacttctttctcatgccaggtacgctccatggtgagtgactttgctgttttcctcactatcttcacaatggtgattattgattttttgattggagtcccatcaccaaagcttcaagttcccagtgtgttcaaggtaaacagatctcagagtacttggtgcactcatgtaatttcatacattctgatgccaagtaaatttcaaaggccttttcatatcctaatcctgagttttacagtcccctaaatctgaaccttgctcctcataccttgtcatgtagaaaagcaaacttcagacttggttgaattcaagacagaaaagccagagaacagaaaaacc

SEQ ID NO: 69559 - DNA, 1110 bp, Homo sapiens
attcctcaaaccagtgctccttctgcctttctttgccaccttccaaagatgaaaaggatgtggtctttatttccagagagttctcagcctagtaggcatgaaatccaatgcttgggcaagcttttggggataggcagaaatagtcaatgttagcctggcttgtggcatctgtagttctgggagcaagggggaattgaactgggatcatgaaaattccttacttctgccaatgattttagcccctttctctatcaaacctattgctcaccacaaatgacaggaagctaaattggtccattcatggttttactcctagcatcttgtttctgaattggaagagatacacatagcacttgtgtacctctaggtaccataagctgaaaaacctagaggtcaagagggagcagagcaaaggaaaagagcaggatatctgggtcattgagattctgaagaatttactgctgcatcactgagttggttgtggtttatactgtgggggaaattaggacagtctttttcgtaataatagtcttggttcttaataaactttctacgtgttgttgtggaaggagccgtgagcttgatttatctggtggcaaagtaggaacaatgtttcccctgtaacaggatgctgcctcctctcttggcattttagaaggagataatctggcttgcagcaaacatcaaactattctgtttctaggaaaccaagggctgggttcaaggtcttgattctctacttgctgttgtttgaccttggatagtcacttagctctgagagctttcatttctgcaccttcaaaatgaggatgttaataatctctgttgctatgatagttaagatactaggaaagtcctttgtgaactatgaatagaagagatttggctgtttaaatgggaaaatgaatgaaaaatgcctggcatgcagcaagtgctccgtaagtggtagttcctgatgctacactgttgatatcatagtgttgtcagcagcatctccagtgaggcccttcggaggagtgcacagttgtgggagcaggactggctgccacctggcacaccagcccagctttcagcaccacctcatgggccaccttgccattctgacctcag

SEQ ID NO: 69560 - DNA, 1031 bp, Homo sapiens
acatcctctctggctctccagtgctcttagtgtctacaggctcctaggcagccctgggccttggtttgattacctcccctgggggatgctggtcagacccagaggttgtcaggaggtcagctaccaggaagatccatgatctgggcattggcagtgcctgccaccacagccaggaagatgcctctgacctgggtgcatctccatcactccttagcagcagcctgcataactggcaagaatcttggatgatacaagagccaagaagggacatttgagttgtgtcgcttagataggaaagggatccagggaaaatcaacagtaagtgaggatgagcagtgtctcttggttttcattgaggatagagtaagagattgagtttagattgcaacagaaggaattagtttagataccaggaagaacttcctagcctgaagatttgtcatagtgtctgctttctagatatctgggaaagatttgataatagttgtttgtgaatagaaaggaggatatgatgtttttattggccattttgcgggactcttcgacttcttgctgctgtctcttgaggatacattccaattccatcctggcgagatccaagtgcttacgtactgtctccttagctgccttagagtaaacgatcatcagttcaatggaccaaaatcaccttcagccatgtggtttcttcatcatcatggatttcttttggttgacaaacattctggctctcagatgcaaaaagtcacactgggaaatgaactgtaagtggtgaaattagttttggtatttaatttaaaactacatttatagtttttctcttctcttctatgttgcaatgaatgtaaagtatttgggatccagtgcttataaacctttccttcctttgtgcacagaatgtaactagcaagcccattagcacccagataattctatcatgttagtttcccatcctggaaaatctttgtacagtgggaagttccccgatgtgtttttctttcttaggtgaagggttggctatatcactttattga

SEQ ID NO: 69561 - DNA, 1038 bp, Homo sapiens
agagatgattttcaaaatattttaacaactggtacaggacagatgccagccactcagaagggatgcctgctgtaaacaagcagtatgtatggttgtaccaatgcctattggctgaacattatgctactttcagatattaaaatggtgttcctttgaatcgtgggtattgttcctggtttgtctcatttctatcacaaggctgttttgggcacagccttagcttcctttcatatatatatggtgcagacaggataggtcatgcttcttggaacctatatgggcattaaaatcttcatgagccaaagcttcacattttagcactttaggataactgtagtaattgtactcatttacctacctaattgggaagaattaaaaggcagcccatctggaggataagctttcttgcagacttttcccttgtccctctctggctgcctccttgagcttgccactttttcatcttcattgttccctgagaacatctcccctttcttgctctatcttgcccctcccatcttttcctgccacctctgtgtggggaggttgatgaccatttcacctctttccctagcctcagcacagctgtaaggagtgtatcaaaactgggtgagagtatcactcagaaaaatgcctcccctaacacacggatgtcttgtgctgccttgaccgcttgaggggaggagccttcattaactctgtgtagtgcaggtacaggaccacctgtgcactttagggtacttctcgagctagaccctcctggatcactgcgccttaggaatgttagctactttttaaaaaaaatatgatttggtgcgttgttggggtgaactccatggggaagattgtgagtgaagatgggaaggaatttgggtggttttgccacgaggtgatggttggggttgggcgaatgggttggatgatcctggctctgtgggtgtggtgctcggttgcctccgtacagttgcagttcacctttgtgcatggtgattaccagtcactctagggattgtaggtcccaacagcggttccagcagc

SEQ ID NO: 69562 - DNA, 1316 bp, Homo sapiens
tccagagtgagatcagttaccataattataaaaatacatacttattgcagaaaaattttaatatatgtaaaaacagggaaaaagtcatccttagttttaccatccttaccatctttgcttctaccataagcaaaacaattatctgtgttttattatgtttttccagtctttttttttcccatagagagggaaagaagcgcttgtaaagttatccagaatgatagtattttaaaactgagccctttaagctcttaattttatagttcacttgctagtcatttagggacttaaacagattgttgtatctcaatttacctttttcttaatcctttagaaatgttccaaaaaaaactgtaatgtgaaagaattcactcatagaattggacttcactcgtaaagtctgtttgtttatatttagcacattaactgaggaatcaataaaccttttcttaatcaatgaatcaacaaatagtctcactctgcacctactatatataaggcactgaactgaacactagtacaatgcctctctaagctggcgagcacccgcttaaaaaataatactgtgctcaaaaactgtggctattaaggtgtcgaaggaaacagaactcttaccctgtaagtttattaattgcggaaatgtatggcagtctgttagggccagcccagtgatttaacctaaaaaagaatagtttgtgcaagaatgggaagtaaatgcagtcaaaagacaaaggagaaggtttctggaaaaattatccctttgtgaagttatggagacacagccaggacacatatttaagtactatgttagagattaaggtgaaatgaaaacccaagaaggttgctatagttacactattgagaagaaaatgtcagaagcagtatgggctttggaatcagacaaaactagattcaaatcccgactctgctatgtattggctttgtgaccttgggcaagttatttaatctattggagcttcagtgttcctatctataaaagtgggaataataatacctacgttgcagggtatttgtggggattaaatgaaatctctgtttccttatggtttctgacacatagtgcttaatatatattagcccccttgcctctagggatttagcagcttaatgtgtatttatgtatgtatttgacgtagtatatatgtactgtattgaatttcagtagtctgaaaagcagacggatgctttatcttcagtctggcatagaggatggaacccgtaggtaccctaacttggatggacattgctaagaaaagttttactgtacaattgctctgctggcttccaccaacaca

SEQ ID NO: 69563 - DNA, 1032 bp, Homo sapiens
cttaatgaaggaagttgtccaagctaaggactatctaactggtgtagtggagactggtacctaggttggtcgactcatgtttagtgacttctttctgttaaatggtgttatattctgatgttcatataaccaagtaatgtgaacaattttggttttattttaagatattattagcttaggtagctaaacatatcttagtgagtgggtataatgaaagattctgggatagacagagggagggcaaaagtgcctttgaaggaaagcattttggaagcaggaaggatgaggggaaattaacagaggatgtatcaataagtagaatatggatgaaaacaggaggcaccaaagtaacacacttgtgttccttctgtggctatcctagctacttttaaaaaggtcatatcttggtgtctgcttatctttcatccgtgtctcttgcatgtaaacacatatacttggctattcatgaaatctctcccattgccaacctaggttgtaaccaggactgtagggaattatgaccattgttacctggacttctttgcttatgcaaggctgaaactggtgtgagactcagagaacagaatatgctggggattggtgatgggtacgggcagcaagttggggccaaagaagttctgggaggactttgggctagaagtagtacaaaggttggagaggctaatagttaagattttccttgggtgtatggagatgtgtcatactgaggagaatagaatgaaataaaagccagaagcctgagggtctaagaggtacttttagtttggtgctgaagctctcttgatcctggaaggagttgattggggtgggttgactaaaataggcgatggagagatttggatcactttatattcactattgatggtaggcatcctgtattcactgggcatgtcccaggatctggaagtggaaagcactgaactccctcaaaaggcacattcacaggctcctttcatattcagctgattagtgtagttttttgtgctataaatttttgggggttcctgggga

SEQ ID NO: 69564 - DNA, 1055 bp, Homo sapiens
aaatcacatttgctacagatttctcaattggatttcctgtgatttggtgaatactctaaagaggcataatgccttgtttgtaggaaagatgtcttgaagataattagtcattttttaagatgagtattgtgatagggagggaagaaagtgtttggagtgtgacgaatcatcatagggagaaagcaaaagaaggtgaatgacagagtgaaaatgggcaaggggatttggatgtgaacgtggggaactgctcatattttaagagtaggtattcactcccctccaacaattcctttgggtacacctccgtattactgaaccagatcctcatctgctggacagggcacagaaccttgggaaggtggtttttgttgttgttgtttagttttattttattcttagctctgctagaactttgctgcaaattgctttctttatctgatctctgcattgagaaaactggagaatattttcttgctttatggaaaaaaatgtaatattcttaaacgtttctttcatttcctcttgatttttagtcatttaatacaaaaacattttctcagaaggctctgttgacagtttctcttccattgtcttgaaatgtttgtttgaatatttaacagaggcacaaaattcaaaaatcaaaaagttcgaagttaagtcttcttttactgtctcccagtcatgcagtatgcactccataatagcaattactgttactaatttctcttgtaatgcttcctgcatacatacatgcacatatacatattgtctccccctgctcctcacagttagttccattgtcttttaaggaagacttaaaataatttgaggatttggattctcattctagatcatcttagatcagttagttaccccttttccttaagaaatacataatgcctctgttttatttttcttagtaaaatttatattctaatttcttggcttatttaatgtgcaagttagtttgggctgaagcagcctttcctactaacctacattgcttttagggttttccttatagaattacctgttaaaaataaaagtgcaggggg

SEQ ID NO: 69565 - DNA, 1069 bp, Homo sapiens
ttttagtagagatggggtttcaccatattggccagactggtcttgaactcctgacatcccgtgatccaaccgccctgcctcccaaagtgctgaaattataggtgtgagccaccatacccagccaatttgctaatctttttgttgagaagttttgcattatctgtgttcactaggatattggtctgtagttttgtttttttcttgtcctgtctttgtttagttttggtatcaggataatactgaccttataagataagttgggatatgttccctttaacattaaaaaaatattttcggaaaaagattttgtagaattctccagggaaaccatctgagcctagggttttctttgtgtgaaggttttaaactataggttagatttctctaatagatatagaacaattcaggttgtcatttcttttggggtgagttttaatactttgtggctttcaaggaattggtccatttaatttttgttgtcaaatttatgtgtatagatttgtctgtagtatttccttattcttttaacatctatggaggtctatggtgatatactttcttttattcctgatattgatagtttgtatattcattcttttttttccctttggctagaggcttattaatgttattcatcttttcaaagaaccagcttttcctatattaattttcctctatttttctgttttcaatgtagttgatttctgttctttattttctttcttctgctttctttaatttactcttccttttctgtttttctaaggtggaaacttggattgttgatttgagacctttcttcttttctaatataatctcttaatgctacaaatttccctctaggtactgttgtccctgcattttacaaattttgatatgttgatttttgtttcccctgagactttctctttgacctgtggattatttagaagtatgttgtttggagtgttgggagatttgtcagtgtctttgttttattgatttctagtttattccattatgattagagagcatactttgtattatttcaatattttacaatttgttagggtttgttttatgaccaaga

SEQ ID NO: 69566 - DNA, 1013 bp, Homo sapiens
tcccttgaaataatttcagatttatagaagtgttgcaaaaatagtaaagagagttcttgtattttcttcacccagcttcccctaatgttagcatcttatataacagtgatacatttgttaaaactaagacatttacattggtataatactttattaggtaagctacagacttcatttggatttcaccaaattttctactaatgtccttttttctgatccaggatccggtccaggataccatattgcatttaacattctatttttaacttacatttatcgtatttaatgtgggtttctggtagatagcatactgtatgttctttttttttttttttaaatccattctgacaacctctcttcttcttattcctttttgaaaaaattgtattgtggtaagaacattttacatgagatgtaccctcttaacaaattttaagtgtacaatacagtattgttaattatatgttcaatgttgtacaggagatctccagaatttattcatcttacttaactgaaagtttatgcccattgattagtaactgcccatgacaatctcttttagttggtatgtttagaccaccttcatttaatgtagttattaatatgtttgggtggtctgtcattttatttgttttctatttccttttccttcttttggattatttttaatattctattttttttttactgttttcattatatagttattttagtgtagcactaggaattacaatgtacatacttaagtgttcagtctacttagaattaatatattaccactttaagtggaatatagaaatgttagtaccaccaggtgcagtggtgcacacctataatccaaacactttgggaggccaaggtgggcagatcgcttgagcccaggaatttgagactagcctgagcaacatggtaaaaccctatccctacaaaaaatacaaaaattagtgggcgtggtggctcatgcctgtggtcccagcttctctggaggctggggtgaaggattacttgagcct

SEQ ID NO: 69567 - DNA, 1515 bp, Homo sapiens
ctaatttaaaattttccatttggttcttttttaaaaaagtgttctatttcttcattaagactttttatttttccatttatttcaagactgtttgcctttccttctttgagcatacttagaatagctgcattaaagcctttgccaattctaacatcttgcattgatatctgttgattgtctttttccttgtgagatgttgagattttcaagtttttttgtatgttagtttgaatttgtatcctgaacactttcaaattgttagaagactttgggtcttgtttaaatcatatagagaatgtttcttgcttatttgttttagcaggcaatccagttagattcaggttgcaaattccttcctgccttctgtgggctggggtccaaaatcagttcagttttcaaagtatttgccattctatttctgtttattccaggtatgtcccagctagtggccagtttcagatctgggcagcagtatactccagagattagttgtcaaaacctttggtgtgctgtttagggccagatacatgcatgcacagcttggagatgagccccggaattcatatacagccttattgagctcctttctcttgttgtttcccagactttccagatctgaagggtttcccatcctgctaccctgcctagaagtcttggacttttagtttctctattctgccttttacttcctatgaccacatctcccttgagaaccaaatggcaagatacggagagtcaacgaagcaagggaggctttcctgtgctcttgggatcccagcttccctggtcagggaagaacttttgctattgactgccactgctgcttaactactgtgaggtagggcaggagagagcaggaaacacacacacaattcagattttctcccttccctttcgtgtctaggggctcccttttctgtttcttggaccagaaatggaggtcttctcctgtagctttttctgtctgtgcttggggcacagttctggatttggctgccttttttgagtccaggccaagagataccagagcaacacacacacacacacacacacacacacacacacacacacacacacacacagaaagaaaaaaaggcaaaactctgctggttttgtgatactttgaattgtgggtttcttttcctaaactatctgctatcaattatttttcagagtcattaagtaatggatggagcagctctgtccaaggattttagttgaatacagtgggagatacagggtagagtgggcttacttcatcttatctggagtgagaaactttggttatttgagagaggaacaaggctggcaggtgtgagaaaggtggtggctttgaggcaggttctcaaccttgagagatcaagtgactagattgacaggcctcgaggtcctgggaggagacaccctgaggaatgacttcagtatttttgatgcaggatgccctctcctcctcctttttaatttttaaatttaagtaaaatgttttttaaaatatataatatctgcacttagcac

SEQ ID NO: 69568 - DNA, 1048 bp, Homo sapiens
gtgtggtgattcacgcctgtaatcccagcactttggagggccgaagcaagaggatcgcttgagctcaggagtttgagaccagtctgggcaacatagtgagacaccatctctatttaaaaaaaaaaaaaaattaggtgtggtagcacacgcctgtggtcccagctactcgggaggctgaggcgggaggatggattgagcccaggaggttgaggctgtagtgagccatggttacaccactgcattccagcctgggtgacagagtgagaccctgtctcaaaaaaacgtggggcctcataggatcagaaaccacggtggagcagactatgaaggagaaatatgatggttcttataatggcttcagtggggctggctttctggaagatgttcaggtatttatccttggtctctcctcagctgctttatagagtaatgcagtagaggaaagactgtcaagaaattttttattacttaggtgctatatcgtttgctttttaacttcataaaattttttggccatctctgcttagtatataaagcaagttgagcaagtgtggctcttgccaactataaacttaggtcacttgggtctggaaattccctcttgaatgctatttcctgaatttgatttagagatcagagtttacgtggtcaatgtacgtctttcccacaggatagccaatgaattcttagagttttaaaccatcactctaaagcatgctaatttgcatttagaaatacaaagtgcatcatattggtgaccccttttagatagtgggatgggtatcagatgttacccattagttctgatgtcttaggcagagcctatgcagttatttggccacagactaggacattgctagtatattatctattcatgtatatgatgatgattcttggaataatttcctctggatgtggagagactagggcagtacagatttctttaattctgtgtcagagcagtagtgagtaagaaggaaggggcagagtgtcagccacagctacaggcctcttacaggcagtctagggtccagaccagacacgatga

SEQ ID NO: 69569 - DNA, 1082 bp, Homo sapiens
tcaatctttggaaatttgagtttgttctaatactgccttatatgttcagattctctttaatggctctgagagtccttcactacatctcattgtcacacttttctctaaaataatttgttacaaagccttgctaatggcagcttgctgtgcccagggtcctgaggtcccatcatcaagcgttttgattcatctgccattcaaaagactattgatatcccgagggcaagttttagatacacttggtgaatttcattgctttgttcctttgacttcttcctttaaacacccaggctccctccctctgtgggaaggcgtatttttggctggcccttttctatctgtgccatctgtcacaggggtcattgctcagaggctggcttcctccctgctgggagcaggtggtcaaaaccaatggctattgacagggtcaggttggggcagcttaccaatatgccccccaagcagtatgcatagttgttctccttcagaggaacaagagaaaaccttacttgggggtctttttctgcattaaagaggaaaagatgcagatgtgattctaagttgtttatttattcttgtggtccagccacttgtcaactgtcctgtctgtgctcttgtctctgcgtacttcaactggcactgtactttaagaccactacctgaagcagcctccagtgtagcaagaaagcaacatctgtgaaaattatggatgatagaattactcaagctggttcatgtctaagatgctagaggtgatgatcctgacccttgatcaaacaaaataaaatatccctgaagtcttttgatgatctctggtggtaaagacccttgtttcaaagtcttatttaaagagatcatacttccaagcacttaggattctgggcctgactcacaggagagccagcccagtgctgagtcacttagccaacttcattcattgatcatgtgcttgtgcacagcttggtggcaaggtgggagagaattactattttcaaatgttccttcctgaggtagcatagtccagaagtaagccgagagacaggatgctagagttctattcttggcccagctatgcaccttca

SEQ ID NO: 69570 - DNA, 1049 bp, Homo sapiens
gggagtggagctttaggaaaggaaggtgacttgaactgtaaggacttcacagctaatatatgcccctgggtaatgttacatagtccttatttgtttagaatagaagttccttgagggagtagaatatatcctttttgtcatatgtggttcctaatagtgagttgcatctgagtgaatataataaataactagcaattcaggagactcctgatctttgatctcccttggcagatcagtccatgccacagatttcctgaaaagaaaaataagcatgtcatggaagaaactatgtgttttttttgcaaaggttgtgaattaaggttgagagtgagatggtttagtctggcctctttttagagcagtgattgattaatgctgtctgtgttgctgtttcttccagagctgacctgtcctggacgcagcataactaacgaagctgctgcaggatgagaagatggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaagtgagttggaggaggaggagcagctgcagatacctgtttcctaacaggcttagggagatgggggagaaagaactgtgtctctttgccaaagtttggataagtagttaaccttttgtttcagttctggcttgtggggattatttttcattttaattgctactaagggtcatttgtggtcttggcactcatcaactctattaataagacttctgattttggctccaggccagatcagaaaaaggggatgtaaatgaaatgggactatttaaaagagtctttaaaagatgggatagtaaaagatagtacagcctccctctct

SEQ ID NO: 69571 - DNA, 1028 bp, Homo sapiens
tcaatagcagatagagagggaagcacaaagatagaatcctggagagggcagactggaatgtggtttactgagaacctcaaagaaggtaaattcatcttcaccacttacaaatttgggccatggagttggccagtaaatcagtgccctaccaaagatgaattcctatatttttagcgatggtagctgactccctatcaaccaaaggctgggtgtcagttggagtatatacttcttggcaaaaaactacaaccttaacttaccaagatttagttcctagccattttaaatctgcttaacagaaagctcagctcattctccagacagcctcagatagctcattgatggtggcctaatctttaggcaagccctgtcttattttttgaggcatctggaatgccacatctttactttcctttttcctatggtgtctctcctcctctggccccttttaaatatgatcttgtgttttctgctcacttccctcagcgtactctgcaaggcatctgtctctttatgttcctgtgatctcaaaacttctctcccagaattaaattggaaagctgtattctattcactaactagggcagcagatgctgtctctagtctagctcatagcttctgtctctgtctctgctatatggttaacttttgaccatggcatttctgcaagataactcttgattggtgtcacgttatttattctttgtatatatccttaatatgtcatgttatttatcctttatatatatatatatatctggaatatatgcagtatctaacacagtggtgcctggcccatagtagtgctccataaatgattgtagtagcagcacttatgattataaagaaacctaagccaatagaaagggtttgtatcaagatttagacatcagcttcacagtttgaaatagagtcccagattcctatttctagaagcacccccaattgagctggctttgggaggctaactggggtggaaaataacattaagggatagtaaagcgaataatagatcactgtcagtaaat

SEQ ID NO: 69572 - DNA, 1056 bp, Homo sapiens
agtttccctcatgggaagttttctctcatcccatgggaaattctgaaattgctgattatgctttctcccatagagggctgttgtgctattcctacctgcctgctatgcagtctccttccaaggcgggagcaccagtgtatgagtcagtggatctgggccatctcttgcttggaagtatgtcattttgattcttgtgtggtagagctggcccatgattcccccttagtaaaaaccattgttctgtataccaagttttctcgtggatcacttcagtggaattgttgttctctttgtcttctcctcttcccagtttggttatagactactgccaagggtgccaaaaatagaatgtaagtgagagcaaccactgacctggagcctgcaaggtctcacaaagctccctgtgtatcaacttcctttatgagagcttttcctttcctagagcactcacccacccccaacctgggctgatactgtccttcctctttgtgtctttggtagatattctgagtatgtcagggccgccaggactcctgaagattggacagtaaggtgcatcagttagctctgcccttttctgtaagaaatgctttgctttacagctttcttgtagctcagaaaagaccaaacccaccttctgaccctttttactttacttgacttggatacatactatttatgctttccgttttgctccagaggcagcaacttggagaacagtgtacacaaggtctgtgctaaaagggtcggttatagaggagaccctttctaaattttctttagtctggaatttgtcaggttcaccttgacattgaaatattctgcctaaaagtttatatgtcttaaaactttgttttcactttgtatttgtctgagtcccgcataaagtgaacttctaagtgactctgtcagaagttttgtcctctgcatgctttgatcatgtgccacagggctgacatgcccaaagaaagggtgggaatctcgaaagagtttctcaggttcttcttagcagcatttaatagtataagtactaatagaactggttgagagaaactc

SEQ ID NO: 69573 - DNA, 1031 bp, Homo sapiens
tgggttcaagcgattctcctgcctcagcctcctgagtagctaggattacaagcatgcgccacaacgcccagctaatttttgtatttttagtagagatggggtttcaccatgttggccaggctggtcttgaactcctgacctcaggtgatccacccaccttggcctcccaaagtgctgagattacaagtgtgagccaccgtgcctggcaaattaactttatttataatctggccatccagtggtggaagactttgaccccaatatgcttgactgatttttctggacatagcacataggcaggcattgttcatttgttcacaggattcctgggcattgtgaaacgtgacaggagattcagaagtacctttggacatagagtagaattcttcacctgcttcttaaaattccttaaatatccagctttccctcttgtcactgaccgttctctacattgaatccagctgtcttttcttggcctgtggtaaatgtattaactgtttctactcagacacgtaccaaagcgagctaatgttagccttttccaagagttctcactgtccaatttgcccccacgtggcttctgttgcacactctgttgtgtaggagtcttttgaagaagcattctgctgttttggataattggttttcagtcagtatcttgcttgttctggaatgtgatgttgtgagccaatagaataaaaagacagtgtctctgtatagccagaatgatggcattctacattctggcttgtgtcaggtcaggaattctactaacaactttttgcctttattgacaggtgttgatggtacgagggagcgctttcaggcagtcacagctggcaagactgtagagcttgagcttaggaaatgaattgatggcatcatctccataaattggcattgatgtctgcaaatatggccatttgcaatttatcctaatgcaaggaagaagagtcttggctgagaccaatgtatagttcagtgactgtttattatttaatattgctgtgtgatcatgtgccttcctttac

SEQ ID NO: 69574 - DNA, 1614 bp, Homo sapiens
tccttgcttaattaagatttatctgaccctctgtgaagtataagcagctgaataccatttccaattaagtttctactttaaacatcttaaaagctaactcaccaatgagatgatctaagccccagacttcaaagctgaggcttgaaaaagtgtctttttagcttccttgactcatgtttacacatttctttagcaataacatctggtttatggagaagagatgttaaaccagctgattgtgagcatttgggtccatctccaggaaagtgaattccatgcaggcttgacatatcagattagtgggggtcatctctggttgcaagtagcaggacacaggaataattcagggaacccaagggctggaatgcacttgtgcttctgggaagccagtagaaaccagaatgcagagccagaaagccacaggtacaaggaagtactttgtctccatctctcttctctccacgtgtccatttctctctctcagcatactaactgcctttactgctcagtcacatcttaatataatgacagaatatggctaccacttagcttccaaatttatttattaccattctcaccacatgaaaatattactcaactgtctcttatcctgttccaaattcctgtaggaaaggatctggatttaggtcagatgtccacccagacatctgcaactactgagagaaggtgaccttgtacagacatggctgctgagagctcattcttaaggaacaggggatagttggagctcatggcctagaatttccacttatgtggacctggaactgtcaaagagctcccagcccaggaaaatcagattctactcatgctaaaattgtatgcttttcaaattatttacttacaaactcagtggtttggctattttgtagtattatactcttgttactaatacaaaagacagcttacagctcatttctcaattcagtaaaatagcaatggtaaagtcctttaacagtcatctggtgtttggaaaggtgattgtctgaatcgtctggagagatggctgtataggcttcataaaaaagtccaggaaaaagaaactgtacaaccatttttagtgacccattcaagtattattttttaaatcagtctatgactttgaaaacagtaaacttgcgtaattttagaagcctaggattgaattattgattcaatataggcccactccaacccagtcaaaatataatgaggacttctctgttccttagcaactaaatgaaaataaattccattacactggaacaatttttatttcttgatggctgccttctactttattccaccagtaccttcttacctagctgtgtgattatgatacgatttcccagggccttaggtttaaaagatagcttgaaatttcaattacttaatctcaatcaaagaaacatctctgccttattttgaaagacttttggagaagattcttcagcttctccactactgcccactgctgtgtagtggtgtgtttatccatgttctgtagatgagaaaatgagactatgagaagtaaccttaaatttgatttgaaacacaataggtcaggccgggtgcagtggctcacacctgtaatcccagcactttgggaggccaagg

SEQ ID NO: 69575 - DNA, 1077 bp, Homo sapiens
tttacagttcctctaatgcatttgggacgactgtctcaaagtaacctgcagctttcctgacagctcctcgcgctctctcctgctgagaactgtagcccttttctgctgtttttagaaccttctgctactatatccaccacttccaccactagatgcataaccaccaccatagggactgcccgagcttcttccaccaaaacttccccctttcatgggtccataatttgattgctgttgtccactataatttctaaaatcattatagttcccaccaccaccatagttaccaccgccaaaatttcctccttcattgtaaccatcatatcctccaccaccgctaccatatccaccacaccaccttggtttccatatcctggtccaccaccaccatagccccctctactactataaccaggaccaccagcatagttgccaccgtcacttccaaatccattatatccaccatcacctcctccataactacctctgctgccaccacctccaccaccatagcctcctcttccaccaaagtttccaccacggccaaaattacctccaccacctccaaagcttcctccgcaacccataaaattgccagatccacctccacgacctgtccgtgatccagcggactgcatctcttgtttagaaagggcctttttcacttcacaattatgcccattaatagtgtggtatttctgaacaacaattttatcaactgtatcatgatcatcaaaagttacaaaagcagatcctctcttttttccactctgcctctcttgcataacttctatggtttcaatcttgccatacttttcaaagtagtctctcaaattatattcctttgtatcttctgtaataccaccaacaaaaattttcttcactgttagatgggcaccaggcttcacagaatcctctctagaaacagctctctttggttccactacatgcccatcaaccttgtgtggtcaagcacacattgctgcatccacctcttcaacacaagaataagtcacaaaaccaaagcccctggaccattttgtttgggggtctctcattaccacacaatctgtgagt

SEQ ID NO: 69576 - DNA, 1050 bp, Homo sapiens
ggaggttgaggctgcagtgagtgattgcactattgcactccagcccaggcaacagagtgagaccctgtcttgaagaaaacaataaaaaataaagtagagcataaatattctgaaagggggtttggtgctatggaaagattaaggaagttagtagaggaagaagcagaagggctggatcatggagaactgagaggatttccccagctgaaaatggagcgtgcactggaaacagaggaaataaagacctgcggtagggtggctgcatggtagggtgtatgagaaaacagtgaaagatgaagtagaataagtaaattagagtcaaagctgggagggtcttgaatgccatttttatgacggtgtgatagtgttaaaggtgattgtggcatttagcaaaggggccatgagtacctgagtcctgtgttttcctggccatatttctccgcagtgacgccctcaagagagatatatgtgcccaaggcaccggttattaacacctgggcttgtacgctgaacctcagtgttctatgttacgcttgccttcaaacttgtttttcatgtacagatcaaccagtccaaagcccacattcccaactacctcctttatctaactcactcactaagccaatatttcccttccctaaatcaccccatagccagataccagacaagtagttaccacctctgtaggccagagccttccaaaattattcaaactccccaatcctaaacttgctcagacttacctatcctgcctcatcccttccttcctgaggaaaccacaggctcaggctaaactttccccctcactccttctgcttcctgaccaacacttatatttccccgtatggccctccatggcatggcaagcccactcctcttgggaacggaagtaacgaactcttctttcaaaggcagttgcctctgtgtctgtcaccttaccgtgatctgattaaaacaaaatcccaagtacatcttaagacaccatcttctggccagccacattgtttagagcagtgtttctcaagttacctgtggtaaaggactcatttc

SEQ ID NO: 69577 - DNA, 1035 bp, Homo sapiens
agcctctgtctgatagcaaagcttttttcctcacccccaacccctctgcccatgctgtatggtcccctaacactgtcaaaatgacaaccaggtatgatgctagatgactgaatatcagctagttctcctgaaatttcttgatacctcctattcctgctttggtgatactccacccaaaacaatacaaggtgttgtcaccctaccaacttagaaacaaggtgccttcttggtgccattttcttgtctcttttggtttaaacaattgtgcgtgtgcgtgcgtgcacgcgcacgcacgcgcacacacacacactaaaaagtcaatttcttaaaatcaaaggggcaactggctttggtggtaatagttgtcctgtggtgatcagagagaggtctgttatacttaacgagaccaagaaaactcgcttcaattcagatgttgaatacatgcaggagagcaaaccagaggatatatttttaaatgtgcaaacgtcagaatgtaagaataaaaattaaactgttacgatagtctacgtgaagcaagaccgattggaaaaactagataccaggacagtgctgctacgttcattcctcatctgtgatccctggctgttactccgtgaagccacccacagttgtataggaagatgaaaacttaattgggacttgggaattttattatgttaatttatccagacaaatgctttttgcaacaaattcatgtttcttctgtagcacagtcacagtttggtgtactaaatgtaagctttctgcaactctcctgaaaccatctgcaggaagggcagttccacagtagtgtaaatttattttaatttttcaaaaaacttgggattttaagactttgtcccacagataagagaggttttagaatgtgcgcaataaggtcattgctatgctcaggctaaatttaggaagagagtttattacacaagattcagtggtttagacagccacggtgagattgaaaatgtggttaaaatgttcttctctgctccctgcacctttgcatgttttccagag

SEQ ID NO: 69578 - DNA, 1014 bp, Homo sapiens
tgggctcaactgtcactgtgctgctccaattacagactcagagcttcgcttgagagggagcatatgacccaagcctgtcctggggcactgacttcagtctcctcttcttcctcaaaccaaagaccaggaaaactgaagcacttgtgctataggcaaaggaatacttaatgtagttctttgcttttctctcctccatagtaatcttcatttaaagatttcgctgtgctgttaaatttttgagggtatataatattagtgccatgaaacatgcatgcatttttgttgattgtcagtacatagttgtccattaaagccatgttccctctgccagatattaaaagccagctgacagattttatagtatttattgagcaacaataatgtccgagacattatagagaagacaaaaatactgtaagaattaatatccattggaattttctcatcaattaaatgggatttgtatcaattgccaagtataaacttccattgataaaagtaactttttatagattactaaaacctagctttgagtgatatttccatgtctagttcttaacaataatagatttcatgataattaaaggcaatgtagagtaactagagaacttgagaagagaggatcaaattcattaagtgactaccagtggaaatttgaattatcatttataatatatctttagtgtgagagttcaaaataagaaatatgatctcttgcccagtggttgctgagaataacagcacaatgatcattacatatggagcacagttaaatagtttctgcttaacatattgcagcttatcagctaatgttcaaagcaaggaagaattattagtacgtttaatcaactctgggctgggcatggtgtcttatgcctgtaatcccagaacttttggaggccgggatgggtggatcactttgaggtcaggagtttgagaccaacctggccaacatggcagaactccacctctactaaaaatacaaaaattagctgggcacggtagcacgcacct

SEQ ID NO: 69579 - DNA, 1051 bp, Homo sapiens
taggattttatatcatatcagagaaaaaggctctgaatatttttgtatattgattcatttgatcaaatggatcaatatgtaaaattttctatatactttatgagaataaaagttcaaagagatcacgttaatgtttcttccctatggtaaatattaacccatatttaactgtaacccatagtatgtgggacaggttagactgggtttgagtagaagcatagtcagaagagttcctggaggaagtaggttctgaattgagattaaaaagcagcatgccttggtttcaagtctttggggcctacttcctgtgccacatttgtaatggtctaacagaaagtcacgatctcccacctaaggtctgctgtgaaatgctgtcacatagacttgagcttttgaatctttacctaatctactcccgtattgtttgagaaattatttttccatttgtggatcatcctccttttgcctgttcttttgcacatttcattgctttttggtgctcccgccaaagggtgagcaactgtagaatgaggaggtaaattcaaatctgggtacatgacaaatttggtaacataaataaatatgaatatcattctccaaaaaaagtgaagattttccagatttcagatatcctggctttccttgctcaacttaataaacaaagtaataaacactttaatgacagagctgtcagatctagaagagatttcttggtctaagaattaagaaataactgcctctcagtctaaaggccctaatatatgaattggagaaacacaaaatgaatattttaatctaaaaggaagagtgactccttagcagaagaatatcattgcattttttacacaagatagaacaggtagctctgatcagccacatgtcctgatgagtgacaatgcagtctaaggcaaaaccagaagataaggaaaccctaaactctaaattgtgtgctgctctgactgatactgtaaagcaaaatcaaagttgaaaacaacccagaaactttgattcctaaggggtttttttcttttgctttttttttattcctgag

SEQ ID NO: 69580 - DNA, 1024 bp, Homo sapiens
agagtctctgcctgtcgcccaggctggggtgtgatctcagctcactgcaacctctgcctcccaggctcacgcaattctcctgcctcagcctcctgagtagctcgggttacaggcatgcgccaccgcgcccagctaatttttgtaccttttttttttttgagatggagtctcactctgtcgcccaggctggagtgcagtggcgtgatctcagctcactgcaacctctgcctcctgggttcaagtgattctcatgcctcagcctcctgaatagctggaattacacttggctaatttttttgtatttttagtagagactgggttttgccatgttggccaggctggtcttgaactcctagcctcaagtgatctgcccacttcagcctcccaaagtgctggattacaggcatgagccattgcgcccagcctgatactggtttctgattcacgacttgcagcacaaaatctatcagctcagagttgaaagtcactcctgagagtccctttagttttctaggctagtttggtagactagggaggtagggctatgggaaaccaaagatgttttttcagagcaaagaagaagatactttgaaaattgctagcattagagaataagtaagacatcaaagttaaaggataatgaggttatgaggtgtagccaggacctctcatttattgtttgtggatatggaaatttgattccattgtggagagtatcagtatcatcttggaaaatcatatgtgcacaaatctggaaaaaaaacctaatcattcttgagtagaaaaacaagtaaatgaggacctattcataaaagggactaccactcaattgttagaatgagtaatctaaaattatttcaacatgagggatcagtctcacaattgtaatgttaaatctcaaaaacaaggtagagacctaaatagatggacctcataagacaaatacagcctggatgtggcagttcacacccgtaatcccagcactttgggaggttgaggagggaggatcggattgcttgaaccc

SEQ ID NO: 69581 - DNA, 1154 bp, Homo sapiens
gctggccaaggtgggccctagggcctctgccaaggaactggactcgttcgtggagtgggacaaaatgtacggctccggacactgacggcgcgcgggggaggccgcgggagccgcagtccctccgtccccgccgcctccgcgtgggagggatgtcactgactaaacccggctggcaggggctggagtggtgaatgtgggatcggggacaggaggggtctgccggtggatattttttttttcgtgggaaggaaaatgcttctgccaggcagatgccatatgcgccgtgtactcaggtttttcctatttattgtggactggaagctcgccatctccgcccggcagaccgggcagatccggcatgggctggcacccggggccttaagaactcctgctctcttgccacaacgcttttgtctcctcgctatctgaatggcaccctccttctccctcactctctccatcccattctctgcattctcttggttttctctcccttttgctttgtcgctgacacccctgcccaccccatgctggccctgtttctctcctgcccctccctccccagctctccatccctcaccctctgtgcttctgtctccatccctggctctccagcgtccctggccttttggtccctgagctttaatgcctttccctgccttctgttcttatttggactgcagtggccctttgcaggagctctggaggcccaggggctgaggaggagggttacccctctacccatctgaaacctagggtctagggggatcaaggaaaaaaagtccccaaagaaggggaattttttgtttgtttttgaggggagatcccagaaatgtagcttgtttcatattttagtcttcttatttttgtaaaatgtgtagaatttgctgtttttctttttcttttgacaactcaggaagaaactgacctcagaaagaatgttagactttggctgctctcctgtgtgcccctcacacctgccccctcccccccactccatccaggggaccaaattctcccagacactcaaaaaatgagacttacggggaaggggagaggaagacccagaggcctcagtgaaaccccagctattcctggtcagaagcagaatgtattcctaagggcttcctccccagggccgaggcctaggcatg

SEQ ID NO: 69582 - DNA, 1054 bp, Homo sapiens
agcttggtgacttagacaagttaatcgagcctcagtttcctcacctgcaacatgggaataacgtcctcactcagattaaatgaactgatgtgtgtgaagcactcagggccggacttggcttgtgttgagaatcccatatgggagcaggcagacaggagctgctgtggttgctcagtcttttcctagcaccctccccccagtatctttttccctctgtgttcctgtggccctgcaggtgtagggggccacccccttgaggacagccctgcccactcacacccaggtggaccggccgggctgcatagctggagttactcggctcagcccccccagggctgggaagagggcaggaggggctgaggcagctgctggggactcctgggtgggctgcctgggcctgtttcctcgcctttggtaaggcctggccctgtgggggcatgtctctctcccacccccatgcacgggaaggggccatatttggggctagggcacacaggatcacccagactttaaagcttaagccttttggaggccacatgccacccaaacagactcaagtcaaccttggatcctaaaactggctacggggaggggaagtgtggggccctccaagagactctaggctcttgggctgagccttgtggtccatgaccctgaggagttcctgcagataactgtattccaatgtttttgtttttgtttgagatggagttttgctctgttgcccaggctggagtacaatggtgtgatctcggctcaccacaacctctgcctcctgggttcaagcaattctcttgcctcagcctcccaagtagctgggattacaggcatgtgccaccacacccagctaattttgtatttttagtagagacagggtttcgccatgttggtcagggtggtcttgaactcccgacctcaggtgatcagcctgcctcagcctcccaaagtgttgggattacaggcgtgaaccaccgtgcctggccaatgttattaattccctttgtagccccatgtatttttcttttatgcattgaggaagtatttttgagaacag

SEQ ID NO: 69583 - DNA, 1066 bp, Homo sapiens
gtcacttgctcctccctccgtggcctgcacctgtgctcccttccgcctttgtggcggggtccactcagggctttgactgaaatggagcatgtactccctggccctgcccccagtgggcttgccacagggcttgacaccttgtgggtgctccataaatattggttggctgaataaaaggggttttgtaagggcctttagccaggcagtctgcatagcatggaatctggccaccttcaggtaaacagctctgtgctcttgggtggtggagacccctgggtggggctcctcctctccctttcccttatttgcctccttctcctccccatgaccctaccccacccccccaagtccggggaggactttgccccttcccttccccacagaccagcattctttccctgccattatcattctgttaaacagagaggccagtcaggatccatatggatcacattaacaattgcttattatctgggccaggactcccccgactctccccccaagctccgactgctgccattgctggacccttaggagccctgccttcccctccccctgccgtcggtcagccagggagggcaagagacaggctggtctccctcaccttccctgtgccttctagcagaactttgcctctcctggacttggcggttatcgactcctttacccgatttaatgaaaaccaggttcctggaaggagcatggctctgcaaagctccagggctgcagcagggagatgtggactccaggccccagtgcccctgtgctctgcagccctgagacccccttcaggggacagagactgtggggggggggcggtgagccacaagaggtcaagtatggggtgctggcatctgctaccttagccttgggctggtcctgcccccttttgggagctggctgtctggtgagggagatcagggcagagggaccctgccaggctctgtggtgttgggctcccagcctttccctgcagtcaaagaagcaagaaatctgttagagcttcccagagcagccactgaattggccttgaaggatggggagtgtacttcacgtttaaacccat

SEQ ID NO: 69584 - DNA, 1070 bp, Homo sapiens
gaggtaaagtatcttgcccaaagttcaatgctgtcaagtgagctgatggagctgacggaggtggcatttggtctgtggagccagcattctggttccctgatctgtatatttagctgtgtggctgactttactgtctaggagtgaagcaaccacaggtcccctctgggacccctggcctcgaagccacagtggcagcacttagcaagaaataaggaaagatacctccctcccccctggcttcagatatgtgctcctgaggggttggctttcccttcttaactgcaggggttggtgactgtactgggttgaatagtgtccacccaaaattcgtgtctaccaggaacctgcgaatgtaatcttacttggaacgaggatcttagcagcagatgtaaccaattaagatcatttgcactcatactggattagggtgggccctaatccaatgactggtatccttataagaagagaggaatgtggacagagatgtagatgcagagggaagataaccatgtgaagacatggggttatgcttccgcaaaccaaacaacaccaaggatcctgggaaccaccagaagctagaagaggcaaggaaggattcttccctagagccttcagagagcacatggccctgccaacaccatggtttcagatttctagcctccagaacagtgagagaatacatttgtattttaagctacccagtttggtagtaggaaactaacacagtaacctagcactgtgtgcaccacagcttggtggatagagcatggattggaaaccacttagacggactgggtggggtgtgcctatttgggggagatgagggagaggagaataagttatttactcatccagctacactgaccaacttgtagacaatgcctccccatgactttatgtgattgtgtgtacactgtgtctggcgagtgtgtcttcagctttattttttccggatatgacgatgggagttcttcaggttggtgaaacttagaaggtgagaattccatttaagcaactgttctccctatctcttggccatcctttccacccctagatctcagatggtgaag

SEQ ID NO: 69585 - DNA, 1056 bp, Homo sapiens
cagttatattgaagcgattattgacccacagatggatctgggagagatgatcaggattgtattcgctcctgacgtacaaagcctgatgctttgacttctcagcagcccctaaccttccagcaatgggagataaagtgtgttctgtggctctcttctcttacactaaaaataatgattctcaggtgggttcagtcgtctttaataaaccagacagtcaagaaaagacaccatgccactttggaatctcaaaaacaagttcattatctccggctttgatatttgttcccagtggtggagcctgtgcagcggggtctttgttcacgggctaatgcttctcctaagcacctcgtgtgtgttcttcggcctcactgctctgtggcttaggtatctgtgctgtggggtttgagaaacatggtgaaggtgtatgaacagagcttgacatttgtggtgagataatgatttgcatgaataaggatgttcgtcgggccttattaagggccatgtttttggaatgtgtaacataatgttctctactgggtagtaaaaaaaaaaaaaaagggagattgaacctctaggtttgtcattttatgtgtgtatgtataaatctttaaatcctcatataggaatttttatcctgcccctaatatatccaggatttttaacagtcatttccctgctgatttgatgtagtgtttgtggggtttttctggttgtgagcctagttaagaatgtttgataatccaagtggttctgaatggggcagagttcatttttttgtaaccttcctaaaatggatgtttgtgggggttaaggtgggtgagtaaaatagggagttcgtttctttttttggtaaattggaaattaggttgtgtgtccagcaaacattctccagggcctttaaacttcttggccagacactacagttttttccaggacacgtctagttgccaatagtgtatgctatggagaccactgctgcaaagggcttaaagtaaaacgtcagttctgggaaaatagaggctgtgggataacaagaagttgatttttttcccctcc

SEQ ID NO: 69586 - DNA, 1034 bp, Homo sapiens
ctgttgttgtaggagttggtgtaagagggtcttaatctcattttcctctctgtattcataaaaagggaatcctagagtcctttctcaccagtgcttctgatgctggacataactgcaggcagccacagcccatcagttccacttggactgggaatgcgggaaccttttaagtccaacttacatttctctcactctgcaggcactgcctcatggccaggttcagatacctgctctgagtttctgttctcagtttttcactctcatgcaggtttaacttgagctttggcttcagaggcaccatttctgtccatgtctgctctctctcctctgttatggagaaatggtgtgctaagcaaaaatatgatttcagagagtatctttctttcctttactctgtagagttgccatactttggtttagctgtgaagtttccatcccaggcaatctttatctgctctctagggttcagagacagtgccactttaggcaactctgggctttttggttttctttagtgtccacccagtcttaagcctgcatttgtctccctaaatattttgaatttagcataatgaaagtaactgcctttccctttaaaccataacatcacacctaatatttacacagttaacatataggagatttctttattcattggattgggtatgtgcctggaacagtttttggcatggggaaataacagagaacaagatgaacaaaagtccctaaatctctattatggaacttataattgcaatggcttagactgaaaataaataagtaaacacaattatcagtccatgagtgctgtgaagaaaataaaacaggatgctgtgccatagtgtgcctggagctgccacttcacctctctatcagcttcattgttttatctgtaaaatggggctaatacagtcttgttatttgtggtagttccataaagttgaattgtagaactgaattaccaaatcttcaaccattgctcctaggggaaatacagggctaggttcctgcgagcctctggtcactttttcaac

SEQ ID NO: 69587 - DNA, 1032 bp, Homo sapiens
caatcattcctatccctcttctcactcaaaactgtgacatacacggtctcctctccattcgtccatactataataaataggtcaggaagaaaataccagggataaatatccttccctgctctattgagccagaagtatgtttattcagactcaacaaagaaaacagtggttttacatgttcatcataaactgatatcaaaggagaaatgcaatttcctgattgtctaaatatgacagctgagtctgcacacataggtcccaggaacattggacacactccctcataatgaggcccactcatttcagtcttaccttgacattctcttgggcagcaggtgggcccttgctagatgttcaggtatttacagtcagccataaattaagttgcaatgacaggtctccttagcataaacatcaaacgtctcttctgagtgagaacaaagctttcattctctaactgagacttaaggttgaacttgtttaaacagctctctagggctgggtttgtctccaagtagaatgtcagaaaggcagtttgtagaatggatatagtgtggagctggctttccaaacacctttctcttatgcaaaccccattccaagaccttttcccagattggaattaaataccaagcttatcaagtgtcttattgttaaatctgtgtttctccccaccccccaccatacaaatagcttcctttattaagtcagttatattttttttcataagtactttttaccagtacatttgttgttgttgttgttgtttttctgtataccaccattggcacctgtaaaatttgactttattatggcttgtgggtacttgaaagctttttgttttaatgtatttttaaaatctaattttgatgattgtaaaaggtgaaaatgtaacttgggtctttttttcttttaaccaaatagcatgtgattgctttactgctgcaagatttttctatttaggctagttagaactttgctagtacagtatcagttcctagttattgccttcctgccccccaagaaagccac

SEQ ID NO: 69588 - DNA, 1065 bp, Homo sapiens
tagaactacttaaggaaatacactgaatttgatcttgcatgttggatgaaatcgattacagactaaatttcaagtagtctggaagagggaatacttagtcttttctagactaaagatgtgtgtgtgccagaatctgtgtagctaatggtgttgggttgaggaggggagtgtggagatagagggaatacctacacaggacctggaaaagtagaagaggaaaatactactaaaaaaaaaagaaagaaagaaaaaagaattaacatcacaaaaagagacaactggaagttctgtgccttgtgagggatggtagggatggtattcatcacttgttagtattctagccagaaatttgagcctgaatcacatcaaacctctaactctagctaatagcttatagaaaatacagaggagagaggaacatgttaaatgacaccttggagagtcaacccaaaaaatccagaatgtgggaagctgcaggacaaatggcctagattcttcaacagataacttgcaaggaaaaataacagtgcaagcgggaacctatagattgaaaaaggttttaggagatctcttagctgagtgcaatggaagaacctcatttagatctggattttcattttattttatttttgaggcagagtctagctctgtcacccaggctggagtgcagtgatggagtcacagctcacttcagcttcagtctcctgggctcaagcaatccttccacctcagcctcctgaagagctgggacgacaggcatgtgccaccacacctagctgatatgtttactttttgtagagacagggtctcactgtgttgcccaggctgatctcaaactcctgagctcaagagatcctcccacctcagcctcccaaagtgctgggattacaggtgtgagccaccgtgcccttcttggatctgggtttgagccagttgttaattttttcaaggtaataaaggatttttgaacactgactggatatttgattatattaaggctattattgtcagttattttaggtatgataatgatattgtgggaaactgcaatttaaaatataactt

SEQ ID NO: 69589 - DNA, 1032 bp, Homo sapiens
aggtggctctgcatgaagtggggggcagccccacattctccaaaaggaagatgctttcctcttgtcaggcatctcaatttgaagaaaaggtagttcctctgtctctcacaggcataaagtagagcacttagaggataatagtggagcttcaaaagccttgtttgtgagctaaataaacaggtgaagttgtgctcagttaaggatatctttttggccccatctctataaaaactgttttggaacatcaagtatgctaagggattatattctaagtttggaaaaggacctgcaaaagatctcaccattgatgtcaatgtctgctccccaatttcctgcagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtgagtgcatgcccttgttgggctagtggctcagcttggagatagggtaccccgtcatttcatttttttctactcttgcccactcacttggtttgacgataaagatgccttttggatgttcccgaaggtgacaaaggctggggtttctcagcagttgcttttgtagattagagggtgaggaagcagattttcaagttagtcccagaggtgcccgcagtgtttagagtagtggcttagcagccataggcagcggtgaggagtggaagaaccaggcagggattcccacgggaggatgtgggactgatccagaaagagatggccccagagccgagcaaaggtgactcctcaagggaggatgatggttagatgtgaggagggaccagaataggaaaaggccagtgaccaaagccgagaaacaccacataccatccttttgcaagcctaccattcagga

SEQ ID NO: 69590 - DNA, 1016 bp, Homo sapiens
taagataagataatgggttcacagaaaatctctcattccgtgggattcccaaggtctagtacacaattatccactacagaagtcctgcctctctaagctttgcaactgtacgtacatctattaaaattcagctggtcccacctgagcagtggagtgctcaatttcagggccccttttgagaaacaggagtgtgccagattcctgtgaggtggtgacagctaatcattgatctctgagcaaccacaaggggagtttaaggacatccagtaaagcttagagttgggatttggtgaatcattgacttgtaccagttgcccaagggtttttggtgggggtgaaaataaaggcagtgtgggcctccagcatagcatcagcactatttcctgtactgccttttgttgaccaagtctttctcagatgagggaaatgaaccaaacactggaccttggcataagacgagaatttaagataaaggagctcggggttgtttaggtctcagggtatagctcagctagctattaaatgtgaacatgaatgcaaaagaatttttttacttacttatttatgtatttatttatttagaaacagagtcttgctctgtttcccaggcaggagtgcagtggcgcaatttccgctctctgaaacctccacctgcctggttcaagtgattctcctgcctcagcctcctgagtagctgggattacaggaatgcgccaccacagcgactaatttttgtatttttagtagagacaaggtttcgccacatcagtcaggctggtcttgtgttcttgacctcaagtgatccgcctgcctcgtaaagaatttttttaatgaagataaaccattatttttgtgacaatggtattgcattcctttttttttttttttttttttgttttaagatatggtctcgctctgttgttgcccaggctgcagtgccattgtgcaatcacagctgactgcagccttaacctcctgggctcaagagatcctccaccttagtctcctgagtagct

SEQ ID NO: 69591 - DNA, 1172 bp, Homo sapiens
gagggcaaagaacattccaggccaatgaaaataccttgagtaaaaagacaaaggcatgaaggtccactgtatgtttaaagaacttttatgatgaggagaccagcatgatgtgcttgtgctggggaagcagggggacgtcaggctgccccaggtgtacaggatcttgagggctgacctttatcttctaggtaaggggcttctactgaaagtttccatgtgggaaatgaatgttcattttttcctttggaaggaattctggcagtggtgtggaggatgaattcattcactaccagccttctgttgggaagggtggggtgaggcggggtgtgtgtgggtgcacagggcaagagcaggctgagatgggaggcaaaagacctgttggaagtcttttagagaaggtccaaaagtaggacaggcggacggagatggagaggcgggggctaatttgagaaacattttggtggttctatactgttgtcattaaaagcatagattatagagtcagacagtcctagattttaagccctgctttgccacttactgcttgtatgaatttgaatattacataacctcctctttgagccttagttttcttgtttataaaatggggatgataacagcgccttaccttccaggtggtttggggaagtgagataatttatgtaaagcccttagcatggagcctaatacatagtaagcatgcagtaaatggtagttcccatctaccagacctagggattaataatgtattaattatttgattgggggtgggagtaagacagttaagagtcacttgtgatggtaagggtgattggatatatagagatacattgaatgagtcaaatgaagcaatgttgagttttataaagacagtaaagttaatcttagactaaacatagatggtcctccattctacatctggagttcgcttgtgagcagagcattgctctctttggagatgggaacccatgggccgcacagcactgccctctagtggctaataagcagaacagccagaaggtggcccccagcacatgagcccacactttcatgttctctgccctctttccttcctccaccaaaataaagcagatgtgggtggatcggcccacaggtggctggctgaagagttggtaaatctggtcaaacatttacattcaaatctatcatcc

SEQ ID NO: 69592 - DNA, 1034 bp, Homo sapiens
aggcattgcagcaacttcccttcagtccctcagcacttctgtacctgagcatatttgctcagggaaggcgagtagtagtagtaaatattaatacaaatattagctaaatacacatgtccttctatggtcgtaacttagctacatgaatgcatttaatcctcacaacagtcccatgaaataagtagtcattctgattttatggatgagaagactgaggtacagagggctaaagtcacttttccagggtcactggattagcaggaggcaaagccaggactcaaacctatacagtctggctgcatagtctatgcttttaacatttatatcatctctttgtaaagatccctgtttttttctctgccagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacggtaggagggcctgggactctgcccttgctaagcagcttctactgagtatcccatctgtgccgtttcccatatgcgcaggagaaggaggtgttgaaaaaggaggcgaggaccttgctctcagcccactgaaagttgaattgaacatgcactccccacaatggaaagttgcatcactgcatctaacagatacaagtgctgagagcacagctccataaactgtatgcacattggtgttggtggtattaaggtcggagggtagagaaggacaatctagagcaggatttagaaggatagcaggcaacaggtgtggctcgggaaagagggaaaacactgtcatctcctgtgcagagagctgtgaaggaggcagggagcatgtgcttagggactggagaccagatttgccaaactatagcaaaggtaacccaggatagagatttggggcacccttcaagattatgggcctgcttcccacttcatgcagaagtgaggtaagaagtaaggagctgtgattgc

SEQ ID NO: 69593 - DNA, 3977 bp, Homo sapiens
gcgcggtggctcatgcctgtaatcccagcactttgggaggccgaggtgggcagatcacaaggtcgagagagcgagaccatcctggccaaccaatatggtaaaaccccatctctactaaaaatacaaaaatcagctgggcgtagtggtgtgtgcctgtagtcccagctactggggaggctgagacaggagaatcacttgaacccgggaggcggaggttgcggtgagccaagattgcgccactgcactccagcctgggtgacagagtgagactccttctaaaaaaaaaaaaaaaaaaaaaaaaaaaaaaaaaaaaaaaggaagagccagggaacaaagggagccttgcagagcatttccctaaggtcggccgccgggtggatgtggatctgccagactgcactgagcgggaggtggcagggaaatgagtgagagcctagggaccagaaaggcttctccagggcatgaccgagctgatggctcctgggtctctgcacaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccatgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacagagctgctctggtgccatctgtcccacatacgtagtacggccacccagcttttgtcaggggagttgggaatggggtggatgttctaaggtcagggtctcgtgctcacaccagctgtagcagaccccagcaagaggaatgctgttcccaacatcctgggtcttcctgagactgttgctttgtgttcctagagggcgggtctggcatgcaagggacagaagacacaaagcatccttttcttgggctttgtctgaatttgtcttctcacgttttttcctgtttacaaaagagggtcatgttcctagttagtcacactctctcatgtcttagaggcatgagcgctcctcctaagctgaagtgaaattgtgaattctgggatgcttaggtgact

SEQ ID NO: 69594 - DNA, 1045 bp, Homo sapiens
gtccttcctagcctcggcccgccgggtcggttcctggctggtgtctgctgagggagtggggggcccagccccttctcttctcccccgccaaaccacagtgggagctggggcagggggagagccaggcaatcgggggccaaagatgggggtgctcgcctacagtctgcatctgtagtgccttgtggggtatccaggaacaccctcccagcaggggatgggaaccctgtcccatgaagccctctcctcagctttacttgctcccccgcccttagccttggggagaaatggcccgtggtgggctgaccccccaccctccacacacacagttccatgacccagcgggcccccaggggcatcaggtgctggtcctcctccctcctggcctcgacccctaagggcttcgcccctcccaggggcctgtaactaagtcgggtcctgccaggcagggggcctgtgttctgtgccccttgggagacaggaactggcgagttcaggtggggtggggacagcacagactgttccaccgttgtgcatattgttgcttctgaaccacaaactgtataaatggatggttttttgcatctgtgtcagtgtggtgactgcctgagggggaggattgggctggggcaagctctgactccaccatcccaacccccgcccaacgcacacacatcttgttttcttgcagcctgaagccagggaaataggctgggagatttaaacttacatgtatgggcctgagctggaggccccacgcttcttcacaacttgagcctccctccccagatacccaagcaggtggtgaccaaggcttgcctcaagtccttagccatccctgtagaaatacgtgtgcttggcatgcctttcttcccagcttctgaggtctcccttgaggggcacaagccagatctgtagggacctgaggcattaccacctggcctgtgaggggcccaatcacggctcactctgttgttctagcagtcttcagcggtttcccaccccaggatgagatttttcttttttgagatggagtctccctctgttg

SEQ ID NO: 69595 - DNA, 1073 bp, Homo sapiens
cagaccctccctacctgtcctgcaccatggttcttgctttttgagtgggtcccatttctgtttctgcttttgctccttgagcatcccttctgcacacagcagtcagcgtgatcttttcaaaaaggaaactggatcacaaccctcctctgcttaaacccattatgcctttccctggaataaaagaataaggtccaaactctttaccatggcctatccataacacgtccctccggggagacaaataacaacacagcttccctttctccaggctgacagcagccacataggcccaacagtttggtaactgggagccttttgtgcagtacccaacctctgcaactatatcctgatgccctccatgaatccctctagaatctggtccctgcctctccctctgatctcaaattgtttctccttctatgtcacttgttacatctaagcacactatcccttctgctcctattcctcaaatatgtcaagctctctcctgcctctggccttcacccatgctgtcttctctgcccggaacactcttctttgcaagaatgatttctctatcctcacacctcagctgaaacatcacctcctcagagaggtttgccttatcaaataggaacaagttcgctgaccccattatttattatttatttatttttttgagacagagtcttgctctgttgcccaggctggagtgcagtggcacaatctcggctcactacaagctccgcctcccaggttcatgccattctcctgcctcagtctcccgagtagctgggactacaggcgcccgccactaggcccagctaatttttttgtatttttagtagagacggggtttcactgtgttagccaggatggtctcgatctcctgacctcatgatctgcccgcctcagcctcccaaagtgctgggattacaggtgtgagccaccgcgccctgccgaccctattattctttatcttgagtcttctgggtttgttagtttgtttgtttgatttttgagacagagtttcactcttgtcacccaggctggagtgcaacctctgcctcctgggttcaagcaattcccctgcc

SEQ ID NO: 69596 - DNA, 1068 bp, Homo sapiens
aggcgtggtggttcatgcctgtaatcccagcactttggaaggccgaggcaggtggatcacctgaggtcaagagttcaagaacaacctggccaacatggcgaaaccccgtttcttctaaaaatacaaaaattagccaggcgtggtgatggatgcctgtaatcccagctatttgggaggctgaggcaggagaattgcgtgaacctgggaggtggagattgcagtgagccgagatagcaccactgcactccagcctgggcaacagagcgagactccgtctcaaaaaataaaaaaaagaaaaggataggtgacttctgtgtccctatgtgctgggctaacacttccacatccattaccttactgagacctcacagtacatctgaaagctctctatttgacagataaagagactgagaattaggttaaggcagcatagctggcgcctggcaaggccaggatgctctcatgcctgtttgtctctatagcttagggtggtgagaaggaagtcttcctggaggaaggggtgtgaggacagggtggaagagatggtgagtaatgagctgaacttctcaggctaggggcctcgcctgtggaaaaagtggtattggcatggtgggtatatgaggtatatgagaggtaggacccgaaagagcaggtccaaggtttgccagggagcagtaggaggaggggccagcccagagagttcccggttccatgcatgcaggtgctgtgctggagggagggagagcattcccatctaaggggagcataggggggctctggagacttggtggggtccacaaaacaggggaggtgggcttggagaagagctctgctaacacatgtgggaaaacttattagaaggagtgaacctctggaccctcccatttcccctggaaaccaaaccagagaccttgcgctgaatggcagcaggagaagaggaaggacagcaggaggccccttctgctgcccagcccaagctcatgaggctgggaagtgagggaggctgtgggattccccagctcaggagagacgtcaggctggctggctgggaggctgcctggtcctgca

SEQ ID NO: 69597 - DNA, 1051 bp, Homo sapiens
gtgggggcgggggtggtctgtatttccagacctcctccatggtggtctggctgtgtggagggcagggcacagttccttgacttggctcattcccccccaacgccccccctttcttttttttttgagatggagtctcgctctgttgcccaggctggagtgcagtagcgtgatctcggctcactgcaatctccgtctcccgggttcaagcgaatctcctgcctcagcctccagagtagctgggactacaggcacccaccaccacgcccggctaatttttgtatttttagtagagacagggtttcaccatattggccaggctggtctggaactcctgaccttgtgatccgcctgcctcggcctcctaaagtgctgggattacaggcgtgagccaccgcgcctggcaggctcattccctttttatgccttcgtttttgatagatgacctggggatgggagaaatgctgcagaggtggtttatttacagtgaattgttaatttggttgtggggctagtattaggggcacattgggaaaacacaggctgggcagaggttggtaggttcacaacagttatgcccactgggtgctgatggatttgggggctgtcgtcggcctggcttggggccctagtggtggggctacaaggcttgctcctagatctactccaagtgaacatttaagatcagtgacttggatggagacttaaaaaggaagtcagctgactccgtgtagtcatccagagctgtgaggaatgacaagtgcacagtataaaatcaagattctaattgaaggtaactgggcagaaggatgggccgagattaacggtgtgaatgtgactgacgattcctgtgctgaggcctctgctggacttaagaaagtcagctgaggagttcaggccctgtgcctggctcaaaggcccagggacccaggcccttagcttctgccctgctctctggatggaggctgtgggactgctctgtgcagtgtgaagcctccatccgctacacaggtccaagtgggtggcagggggagcgagaatgcctgattctgga

SEQ ID NO: 69598 - DNA, 1554 bp, Homo sapiens
agaggccaggccctgcccctcccaggcagcctggctccttctgctgggccctgaaggcagacgggataatgtggttggccaaggcctgttggtccatccagagtggtaagtgctctgctattgtcctttgtacacccctccagcaggtggggttggggggcagaggtgggggtggagctgcccaaagcggatgtggttagggggatggaggggaagccctggggaggtggcagccgaggtgctgttcagtgtgcgggatctgatttctttagaggttggggtagtgtgagtgtggggactggggaagccttattttcttggcaggataggctggagggctctctgggcctaggtgacacgggctggtgggagtaggggatgacagctgctcccaaggcagcatgtgcctgattccaggaagcagatagggtagaatagggtgtctgggggctgggctgggagcatcatggggcagacgtggcagcggggaactggcctgtctcccaggtgtagacacttctccaggtgagtgcatgaagggaaggctgggacctccccttcctcgtggaaagcatggtgcctgcccctcctcactgtggcaggccagagggcctatggagtctgtggtgtcgggggtggcctctgtgaatgggaaggcagggacagcccttccactactggtgttctagcacatctccttcacttacagaagaggagacttaggtacagaggggagaaatgacttttccaggggtcctgcagtgaggatgtgtagagccaagcccagaaccatgcctcctgggtggctggcaagcacaggcacctggtctgactgtggaagacataccttccttgactgagggtgcttccggagaaggcccacactgatctggggctgagaggtggaggacgggaatgggattttcagcaggcctttcctggggacatgagatggggccaagggcactgtagtcctggttctgtgcctaaaggagctggagctctgccttgcaccccagacaggggtcatgagattcccttcctccttccctggaagagggccatctttgggcagcagccctcccaggccttgagaaatcccggatgaagcacgcactggctcagtatctccctcagcttcccaaacactgttgcctcatggggggtcagcgttcagggtgcagagagccccagagaggtggctggggtggggaggatggggtgtctggtcccagcctggagggaagggggaagccctgggaagcagggcctcctgttctgggggcagggctgggtgtgtgcctggcctcctgatggcagcaggtgctgtaccaccaacctcgggctgaagacagggagaggaattactgtaagggggagaggcaggtgttctctggtcagctggagatctggacttgggaagcacgtgagtgaggatgacagcagtggccaggtgtccctccctcaactcggcccctacatccgcccccagtccagacccagcttcctgagcactcagccctccctctgggtacacagcagccctggtgggca

SEQ ID NO: 69599 - DNA, 1130 bp, Homo sapiens
gcttaagaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccgggtaggttcccttcggggaacgtgcatctgtttttaggagcggtgcatgaaggagatgggtgtacgcgcgggcagagaggatgttgtagggccggcatgcaagagggtaggtgtagtgtgcagctgtagcacaacgggatgagaacccaggtcagactggaaactactgggtgcggggtaggaggtaggggaggttgactacctgcaaagtggaagctgtagggggttggggttggcgccgggagtagggacttgtccagcaggcggctggccttagttcagtctcctagggtgcccaactgggcgcacggtgctctgaacttgggtgggtgtggatgggggtcacagcaccgtgggggaacaggtacacagagctttggcgctgctgggatccgtacgattctaactgggattggatttccaaaaggccctccttcctcccagcctgtcagctccctcccagtgtcccggttgttttcttaacactttagaggctgtggctgagttggcaggggttccccaccctgaactttctgtctgaggtgcgttaggaagcctccggatcattgaaggaagtgactggcttggtggctgacctgtggagggctgcttgctgtgtattgaataaaggaggcttcttggggtcggggcagggtctctgtaagcacagggagaattgatttcgctggggcttggatcacgtgtgtgtgtgtgtgtgtgtgtgtgtgtgtgtgtgtgagagagagagagagagagagagaaagagagacagaggtggaaacccttgtccttggggatcctggatagaagttgccagtgttggagtcttggggcggtgctgcctagaggatacctcccaaccattccagctccagatgctgatcatccctatgccccctcccccagtagtctctgttggatcttacaggtagggtgcagcctgaggcttgttcagcagaacaggtgcaagccac

SEQ ID NO: 69600 - DNA, 1041 bp, Homo sapiens
tgccttcttaggcaggtgggctttcacttccagctcctcttccattttcacgatgtccttcttcctaggcactgcgaggggaggagaaaaggggctttgcagaggcctgggagtattcccaggaagtgcctggttggcgaaacaaccagggagctgctcctgggagctgggctgaggctttgctgggctgcctctcccactcacccttctcccggcccccaccatgccttccccatgggggaggggcagggggctggaggaacacagcttccccctgttctagcagagaaatgctggctgtatgcctcccctagggttcccaggctgactagggtgtggctggccttctgatggagcccactcatgctgggccgctgcccaggggctttgtggcacctaggtcgagatggtactcaggccaggggtcaggattcctgggtgctctggtcccggtgcctctgtctcatctttaggctgggattcctgccaccttgctgctctggggcccaaatactttgagacaaggctataggcttgtcccactgactctcctttccctccctggggtctcctctctctccagagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctct

SEQ ID NO: 69601 - DNA, 1047 bp, Homo sapiens
cgagaaagtgggctcagagaagtgaaataacgtatccaaggtcatcatagggtgtggtgattcagcagcaactctgtccccaaagcccttgttcctaatctttgagctgcattggatccctctgtgcacctagtattggtgcacccagttcctttttcaggaactttgccctctccctgaccctgactcccacctgctcctctcctctgctgcccctgtcttataccctaagaaaggctgttgtggaaaagggggctccctgtgtgcagagacagggcctcaccacttgccctcttcccccacaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccaggtatgggccgggttgggggtgggaggggttccttggacacatcctggtgagaggagataatgtaggaagagtgaagtttctgggagtcggggaaggaatcctagaccagggttcaggagttggaggggcagccacagttcagcttctcagtctgcttctgagaagcaaagggatgcagggaaggtcccttgggccaggacagaggtgaaaggggactggggcaggtatgttggggctcgtgatacatgctcccaagcctgctttaatcagtcatatgcatcagggtaaggttgagctctgctgctttaaggaaagtctagaacccagggatctagtccagttagggtagggggaccttacagtgtcgcaggtgagaagggtgtggaggggaagcacctggaaactgctcatgtctccctgatctgcttccttagtctcgtttatttattta

SEQ ID NO: 69602 - DNA, 1065 bp, Homo sapiens
gcccggttggccaccccgtttctggggggtgagcggggcttggcagggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcaggtaaggggtaggagggacctcaactcccagccttgtctgaccctccaattatacactcctttgcctctttccgtcattccataaccacccaacccctactccaccgggagggggttgggcatacctggatttccatccgcgcacctagccacagggtccctaagagcagcagctaggcatgggagggctctttcccaggagagagggggaaggggacagggttgagagctttacagaggaagtggacagcatggagggaggtaaggaaaggcctgtaaagaggaggagacactggctctggcggaatggggactattggagggttaagcggatgtggctaaggctgagtcatctaggagtaaacaagaggccttcctttgggagg

SEQ ID NO: 69603 - DNA, 1042 bp, Homo sapiens
tcacctccactcctataggtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggcaagcaggggccactggccaggccagggattgaggggccaagagaagtctgggtcggagaatagacaagacaaaccaactgcaagtagccttgctaagacgtttagaaatagcagcctgggctcttcttaaataagaccgttctgatgaagagcattctcagggggtcgagtacaccctggctcacctgaattacaggtcaaaatgatatgggttagaaaatgagatgagaacagaagtagaagcagctaacactaggagctgggggtgataaaggaatgacagcagatggagttggcagcgcttcctaaaagatggtagaaggagcaggtttgtgaaggggagggtggataaaggaacagggtgaagttacagagaaaccatcagtgagtgggtggcatttctacccactggagtagaaaggccagaactggcattgccctgagtgcaagccaaggggttcctcctgtctcttctccaactgtaggcctcctagaagaggcaatcacagaagaaaggccttgttggagctctgaccctgaaccctcctcacttttgcccctgtcacctttaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcaggtgcgtgaggggaggggatggctgccaaggtgtgggagggaggcagacggaatgaggggcctgatggactgtccccatcctgcagattgaggagagcaccacagtggtcaccacacagtctgctgagg

SEQ ID NO: 69604 - DNA, 3145 bp, Homo sapiens
catcaccggctccgtgcagagtaagcagaagcagcagcgaagccccgcccttcccgccactcttccggcaggaagtctgtgcgtcaggaggccggccaggactcagctccagccccgcgctcgcgtgtagccctacgtaaagcgtgaggggtttcgcgacaacccaggccccgcccctttggccacatgtcgcgcatgtcttcccgtcggacggcgtgccacctcgccgcgcagctttacgaacctagagcagcgccgccccgcctcctgtctccgtcctcacctccccgccccctcccagcttcgcgtctcctagctcgacgcgcccgctataatcacgtgattgcctcatccgggtcttttgcgttctctttccctctcccaacatggcggcctcaggtgagcgagcagccgagcgcggccaaggactgggctctgaaacccccctccgagcgtgatccactgatttcctgaagtcggggaattgctggcactggttcctttctgaattgagggctgcggcaggctggcggcgtggccctgttaggttactgcctctggatgtttgggggggaggggaaggacaccttcccctccccctcacactcttttcaccctttctgcgcgagattggaataggcagtaatggtagactctggcttgaattggggaaggaggcgcagaaaggtgtgcgggtggtgcgaggccttttcgtagacgtgaatcaccgtgcccgcgtgaaggcgtggaggaaggaaggaggcggttgctgcgcggacgagtgcacattagactacgtctccaaggcgcgaggctgtagcggaccggagtggggggtaggggagtaagtgtggtgggggggagcagttggaacgcgagcgcgagttggtggaggggcgggggaaggcagcggtgcgcgtgcgcggtaggagacacgagggtagtagagacgggcgcgccttcaatgcgtgcgctagaacccagatgggaagctttttaacgcgcctgtgttgcgcacttatgtccttttaggttgtctcttccctttctagagtgtgggccctgtgcctgtattcttctaagggtgtgtgtgttagccttggaggttggtgctattggcgttagatgggggtggggaatccagttaggtgcgcccacgtgttggagaagcaccggtgtgcacctagatttccttctaggcttttttctcatactcaattggaggcattttttactcagcgcagctatatgccaggatcaggtttcgcttccggcgcttccatgttggttgaatttggatagctccaatggtagatttcagccttttttttttttttttttttttttttttaaggtaactgtgcaactaccagcaggtacttttaaaatagtgcttactaatggctggagttgcttacttctttagacaaccttggaggggagtatcagtgccttgcaagtctaattacatttctaatgggcttataaaagcagtgatgacccaacatcttgtagcattgattttagtttgaggaatatagtttgttttctctggcatgaccttgcattcttcaaaacattatttgaacttctatctctgggtgctcatttcttacctagtaattcatcgtctctattacaaagaagctaagggttttggttggctttggaaaatgttgagaaatttgaggtgcatttgaacatctttcattggtgtaacgcttgacagttgaccaagcacttttgtgcatgttgtctccttccatcctgaggtactgcagagagctagtggtatttctcagctaaggaatattatttaaggccacactgctctcagctggcagagcaaggtcataatctttgagactccttagcaacttaaaagtatcaaggtgtcatcatcagtttaggacgctgcccgaaagcatctgaagtttacaaaaatgttcatatttttttctccagtgggctagtaaaagtcctaaatatattttaaactaaccattgcttaaagtacttacttggtctggatttgccaccttaacagtttagtatcgtaatttagtgaagaaaatctgtgttttcttaacttttgtgtaatttttagaggcggaacataggacagcaattcatgtccttcgttttaccgagttgagggaaatccagactgataaaagggatttactctgacgtcccattctcttgttcttccatatttactctacccccttgaaaaccctcatctcctttaattcacttcagtaaatctttttagctggtactggtatctgagcacaagtcacatctttcagtctgttcttgaggaatctggggtttatcggattgtttccccgctcctctttccagtcacactggctttgtgaagtaaccagtattccctgatgtgggaaatggatgttatgtgttctgtgtgaaaatacataaaacaacttcatacgcctcttttactgttaaatgagaccaaaaaattctttgcagcaataccagtttccagtgtgatccattattgaccttcaagaactaaggtaggtctcagaactaactatagaatgaggatagtttgaattcctagaaacttgatacattgagccagtacacttaattccttgctttgcttcttaaaaagaattcttaaaggccgggcgcggtggctcacgcctgtaatcccagcacttcgggaggtcgaggcgggcggatcactaggtcaggagttggagaccaacctgaccaacatggtgaaactctgtctctactaaaaatacaaaaattagctgggcgtggtgtcgcgtgcttgtaatcccagctactccggaggctgaggcaggagaatcgcttcaatctgggagggggagattgcagtgaaccgagattgtgccattgcactccagcctgggcaaaagagcaagactccatttcaaaaaaaaatcttaaaaatacgaagtttttcatttttcttaaattttcattgtgactactttagtagacttgccagtaataagccagttaccgcttgaatctcagtttctttatctggaaagtggtcattatttatctgctgtccccttacctagagggaatcaaatgcgtttgatacaggttaacatttaaaatgctttcaaattgg

SEQ ID NO: 69605 - DNA, 1069 bp, Homo sapiens
cccagcactttgggaagctgaggtgggtgaaacacctgagaacaggagttcgagaccagcctggccaacatggtgaaacccagtctccactaaaaatacaaaaattagcggggttttgggctgggcgtggtggctcacgcctgtaatccaggaggcagaggttgcagtgaattgagattgcaccactgccctccggcctgggcgacagagcgagactccgtctcaaaaaaaaaaaacaaaaacaaactttaaaattggaaataacatatgtaagctcatgcacaggcctttcatttccataatgcttcaaaatgcagtcctgtgtgacatcttatttgattatttttatagggagaagatgctctgcagtggttgttttcatacactgctgactctcacagtgaaatggttttaaggggtgccattatatattgcttacagattccctagtgtcaagttccatcctctatcatgtatatgttattctgtgagtaagatacccagaaggccaaaattaaaactctttatgaaagtttaaatacaaatacagaatagtgtcaattaagataaagcagtgtttctaagtaatgtcattgaaaaaagaggtatatttcatctcaaaacattctggaattctcttttcgtgatggtagaggaaataactgaacttgagtacagtattttaagtaattatttgtaattaggtttgccttatgtacatttatgagccagtttcttaaatttgtagtagatactgctatggtcctgatagtgggaaagtaccaaatcaagaagtttaacttgaatttgtgtacctcctgtctcccattttgtgtaatggttagcatggcatgcattgggcacttattttgtttgattatgtatatgatcaaattgagtatccctggagggataaggaaaaggtagtatggcatcttctgtcaaaatgaagtaattgggcacagagaggtcatgtaactgaacccgtacgggggtcaagatggtggagcttatgagttttgactcagtctttactatgctaaacttacccaatccccaactaaatcaa

SEQ ID NO: 69606 - DNA, 1011 bp, Homo sapiens
ttggatattagctgatggtactagattaagccccatgagggtaaggatctgtagctagcatcatattaatcccagacactatttttgaattaaatgatatgaaaaagtctaaaataagcccacgcactgtaagtggtttacctcatgtcttactcgtgttcgcttattaaaatctcccatagatctttgcatatgaggctgggcacagtggctcatgcctgtaatcgcagcattttgggaggccgaggtgggtggatcatttggggtcaggagtttgagaccagcctggccaacatggtgaaaccccatctctactaaaaatacaaaaattagccaggcttggtggcacatgcctgtaatcccagttactcaggaggctgaggcaggagaatcacttgaacctgggaggcagaggttatagtgagccaagatggcgccactgcactccagcctggacaagagtgagactccctctaaaaaaaaaaaaaaacctttgcatatgagctgcagcaataaaagtgctatgagacccaacctctctgtaaccgtattctttgaaagctgtggaataaggccaagtgcagtggctcacatctaatcccagcactttggaaggctgagacgggtggaccacttgaggccaggagttgaagaccaatctgggcagtgtagcaagacccctgcctctacaaaaaattttaaaattagctgggcatggtggtgcatgcctatagtcccagctactcaagaggctacagtgggagaattgcttgagcccaaaaggtcaaagctgcagtgagccacgattgcaccactgcaaaaaaagaaaaaagaaaaagcaggccgggcgcgttggctcacgtctgtaatcccagcactttgggaggctaatcacgaggtcaggagatcaagaccatcctggctaacactgtgaaactaaaaaaaaaaaaaaaattagcctggcgtggtggcacgcgcctgtagtcccagccacttgggaggctgaggcag

SEQ ID NO: 69607 - DNA, 1442 bp, Homo sapiens
ccaggaggcaggggttgcagtgagccgagatggcaccattgcactccagcctggacaacaagagcaagactctgtctcaaaaaaaaaaaaaaaaagacagttgtgattccttccctatatggtttgtttacaagtgtcaaaacagtcttcaaaactgccatactgaatatgttatgtgagatacgaatttttattgatcttttttatccaaagagcagtgaaagtagtaactgaatagaagtagttacaaaattaaagatctcaaatgataagtgaatatagtagaaaataaaaggttgcccccacactccaaacatactctccagggtgtatctcaaacactcagacccttttccgtacgtaaacatgtgtttacacataataggtattctgcaacttttaaatttcttatttatgtctgcatagtaccccttcatggaaatgccataatttaaccatttgaggagcgtccatgttatttctttctaaataatgttttacaatattgcattgtacaactctgtaaatacctgagtattggtgaataatctttctcttgccttttaaaacagcaaaaaagaagaataagaaggggaagactatctccctaacagactttctggctgaggatgggggtactggtggaggaagcacctatgtttccaaaccagtcagctgggctgatgaaacggatgacctggaaggagatggtaacttttcttttgtcatcgtgtttggaatgtttattattttctagacaaaacctattacataataattcacatcgtttgtaatctgaaaagaacttactcattttttagcacctgaaatcttacatattttatagaatctaaggtttaatctgaggtttgggctgtcagactttgcagtgaagactgaagtggtcatttaagagagctttgctagttcttgttcttgcattaacagacttcttaagttactattcttttgggcctcattttcttcattttaaaagtaagaactagatcatcttttaaaattccttttaggtctaaaattctatggggtcctcataaagtgatgtttcaggctgctcgcgatggcttacacctgtaatcccagcactttgggaggccgaggtgggcagatcacatgagatgagaagttcaagaccagcctggccaacatggtgaaaacccatctctactaaaaatacaaaaattagctgggcgtggtggcatgtgcctgtaatttcagctactcgggaggctggggcaggagaattgcttgaacctgggaggcggagggtgcagtgagctgagatcatgccactgcactccagcgtgggagacagagcgagactccatctcaaaaaaaaaaaaaaagtgatgtttcagtgtaatctgtaagctatgtttactcagagccaaggaataattagttccaggtgtcattagtat

SEQ ID NO: 69608 - DNA, 1086 bp, Homo sapiens
tttttttttcttttttttttttttttttttttttgagacagagtctcattctgtcatccaggctggagtacagtggattacatgcccagctaattttttgtatttagtagagatagggttgcactatgttggtcaggctggtcttgaactcctgacctcagaggatccacctgcttcggcctcccaaagtgctgggactacaggcatgagccactgcacctggcctgaattaatctttttttttttttttttagagttaaattcatacagttcaaaattcagaaggtataatagggcatttagtaaagtttctactatccctctgcatcagttttcctcctgagacaaccatgttcttgtgtattcagaaaaattcatgcacatacagtaatgcttttgtagtcctctcaaaaaatgacaaatgaagaagaatgctgggaaactttgttgttgattcttattccttcagatcagtgcagtgcgtttaccacgtgaacccagcaatccagagaggttgaaaggttttggttatgctgaatttgaggacctggattccctgctcagtgccctgagtctcaatgaagaggtaaagaaaataagagtggggatatgaggggtgtaagttcacaaatctcatgtttattgatcaaactggtattttttaggttgagaggctcacttcaaagattcccatatctacaaataaaggcctgcattatttaacagtgtatcacttaacatcgaacatctagcaagtcacacttcagcaaattcagtaggccccaataatttagataggtacttaggtggaaagttgtggaagaaacccaccacacaccaggtctctaattaagtcttacactgatttacccacagtgttgcctcaactcttatggcattgctttttcaaagtaatctggcctgataaaggcaaatagaaaaatcaagtttgtttagtattaaaggcatatctcattttcagggaagtgttgtaatggtatatttgttcatttaagaggatttggaaacatttcctacaaaggaatattttacaggagagtgacaataaatatctagtccttctgc

SEQ ID NO: 69609 - DNA, 1778 bp, Homo sapiens
tttttgtttttaagagacagtgtctcgctatattgcccaggctggatttgaactcctgggcttaagtgatcctccagcctcagcctcccaaatagctgagactgtaggtacatgccactgcacctggcttctataaattttgataaataattgttgtggcaccaaatatgccttttattcagctagttatgtgagaattatttttaatttactacacttgacaaattaccttggatagttaaaaagttaattctattctgtgaaattaagctttgtaaaaatagtataattgacctaatattcaaggccagcttaaatttgtttaacttttaagtcttttaaaggactctttagcccacaaattggagtgttagctagattacagtgttttcctttatcttccttcccctagtgcttctgctatgcccagacgttcaaggtcactcaagggatttgtgcataatggggcaaaaggttggttaatatggtcctatgctctcagtctctaggtaacaggagaattcgagtggacgttgctgatcaagcacaggataaaggtaaggaaactggtagagatttctgtttggtaatggtcccaggatgacaccaagccatcctttcccagaaaatttgaataggggtagtggtgggcctgcctgaatctacagtaacagttttcaatcagttttgccccacaggggacttctggcaatgtttgaagacattgtagttgtcacaattggagggagtgctgctgacataagtagaatccaggggttaattctatagggaataggacagtccccatcaacaaagaattatgcagcccaaaatgcatgtcaagattgagaagactgattgatctagatgaacattaaatagatgataaatagattagctgcctaacagcacgttggtcacaaaggggacctaatttgtatatgtttcagggactcctggcccatacagaatttgagatagctaagcattaaaccaataggaaaaaacgggaggaaaagagccacctggggttgaattggagcatgtacttatggggcctgaggtaactgggatgacagtgtgacgtgaaagtgaaaaatagggtaaaatgggggttttctatgtgtgagaaatattgggcaaagtttttatgagataacttacggtttttgttttaatgtatctgtagacagggatgatcgttcttttggccgtgatagaaatcgggattctgacaaaacagatacagactggagggctcgtcctgctacagacagctttgatgactacccacctagaagaggtgatgatagctttggagacagtaagtttgtttttatgaagttagcttcctctgtgctttgggaggctatttagtaataggacaaatgtgttacagatgatcagatcacattaacagatagaaggaggaaagcagattaagaaaaattttggatagtatctgaaagaactgatagatgcaggaaacgaatttgataaattaataattttttttgaaaacttaaccaaacaaagggacagacatttctctttttttggagacaattgtttataaagaaacccaaactgggcatggtggctataatcccaacgctttgggaggtcaaggcaggtggattgcttaaggccaggagtttgagagcagcctgggcgacaaaacaagaccctgtctaccaaaaagaaaaagaaaaagctgacgtggtggtacgcacctgcagtcctagctgttcagcaagctgaggcaagaggactccttg

SEQ ID NO: 69610 - DNA, 1408 bp, Homo sapiens
gcgtcaccacgcccagctaatttttgtatccttagtagagacggggtttcaccatgttggccaggatggtctcgatctcttgaactcgtgatctgcccacctcgggctcccaaagtgctgctgggattacaggcatgagccaccgtgaccagctaaaaaaatttttttaattaaaaaataagtggtctttgggatcaaacatgggagattcccaactgtattgttttagtgtcttgtgctttgttttgttttttgtttttgcatgtaaacctcttctccttctggaaattcattatggaatatttagggattttttaatttccaacccacccttcccaaattattagctgagcaacaattatttcaccagggaaactttttgaagaaatcagatagaaaatttaaataaacagattcttccaaattggactgatagcttaccgtgtttctattaatggtgtcagagaaaaggggatggtgttacttgtctgtttcctctagagtatcgagatcgttatgattcagaccggtatcgggatgggtatcgggatgggtatcgggatggcccacgccgggatatggatcgatatggtggccgggatcgctatgatgaccgaggcagcagagactatgatagaggtaattgtaaaacatgtcgaattgctctttcagtaactttgccttttttttttccccctccgctgtgatgattataatttgggatatatttacaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtaatagttttctttttacgtacttcatggagcagaaactgggaaaactacggaaaatttgtgattgtgttacgaactactgagttgggcacaaatataatttgcacattgtacaggaagcagcaaagcatagtagaaagagcattggctggccaggtgtgggcagatcacaaggtcaggagatcgagaccatcctggctaatggtgaaaccccgtctctaccaggtgtggtggcagacacctgtagtcccagctactagggaggctgagagagaagaatggtgggaacccgggaggcagagcttgcagtgagtggagatggcgccgctgcactccagcctgggtgacagagtgagactccccatctcaaaaaaaaaaaaaaagcattggctaaggatgacatcagtggaaacacagcagtcgaattgttttcatctcatatgccttcacagatagatttttcagttaaaatttattgaataaacagtagaaatggaaaa

SEQ ID NO: 69611 - DNA, 1863 bp, Homo sapiens
accacgcccagcctgagctacctattttcttttttttttttcttttttttatttttgagacggagccttgctctgtcaccaggctgaagtgcagtagctcgatcttggctcactgcaacctctgcctcccaggttcaagcaattctcttgcctcagcctcctgagtagctgggactacaggtgcgcgccccaacgcccagctaatttttgtatttttagtagagacggggtttcaccatgttgtccaggatagtctcgatctcttggccttgtgatccacccgcctcggcctcccaaagtgctgggattacaggcgtgagccaccatgcccagcctaaactacctgttttctaatgatctatttgccttctgtggattggttaggccactaacttgaatctcatgtagcatttcataggagttatatctgagaaatctggctttcagccatcagcttctggtgattggaaaactattacttaaagtttcatttaacttaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagaggtgtgttgtcttgatggatatcccatctaggaatccggtggttcgtaatgggggcattacatccccaggggcatttgggaaatttgtgtcgttatcacattagtggttgtcactgatgggcatttagtgggctgtggccaggggtgttaggcagtatgcagtgttagggacagttttacacaatgaagagttgttccctgtccattacaaaagtgtttactattaaaagctggtattgtatctaaaaggctagagacctactataataagtaattgccctgaaaaactaggcctggtaatgagtggcttgtagaactgtgttgattagtaaagaagggcagtattgtagattatgtaggatactgttcttaaccatattagttgattcttgctgaagtatttagggccaaagtgtgtcttaatgtctgtagctttcaaatagtttgagggaaagataaatttatatgcatatacacatatagatgaagtaagtgatggttcttgaggggtcagcatgggtctaaggtggccttcactgagccaggcataatgtgtattttgtgaatctctcgtacagacacccaagctggcgaagtgaagaaactcaggaacgggaacggtcgaggacaggaagtgagtcatcacaaactgggacctccaccacatctagcagaagtaagtcagaccagggtgggtatcgtgttattgccgttttccataaactatccataaccaaattatgcagagaccctgcaatatttaaattcagtcatgaactctttatttgggttgcatgggccgattggagtttcatatcttctgctccaaagaatctgaggaatgggtaccagagtagacctagatgatctgcttaataatctaccactgaagtgtatacttggttgttaggtttgtctctctcttttttttttttttttttttttggtatattttcattttatgtcttgacatctttgaatgttgtttattcagaacagtcaacggcttggagtttcatgtgagctgtcccaagaccagccttttttgatgttatcatcaccagagcagtgttctcaagcagtgttattactggttgatcaagcacttttagtgttttggaaacctaaatggttc

SEQ ID NO: 69612 - DNA, 1318 bp, Homo sapiens
agcaacatgatcacagctcacctcatcatttctagtagctgggactgcaggcacatgccacatccagctaatttgtctattttttgtagagctggggtttcaccatgttgtccaggctggtctgaaactcttaggctcaaacgatccgcccccaacagcctcccaatatcctaagattacaggcgagagccactgcacccagccagtaggtggtttttcataaatatgattgcatcatagtccatgtgtgttgagttttaagctgaagttgagcagtggttactagagtttggggtttcattgtaggtcctcttcacatatgtatattctccaggtcaagacacttttaacattgagaatgcagaaaggctgtaaaggatactcattcctaaaaaggtcacatggctgggtgtcccttaagttgtatacatggtcattattttttctatttctctgtgcatcagtaagacattgttctggaaatacttgtaaaccactggtttagggataaatccatctttgggagccaaaacttggatgtggaccattttccacactgttgagatcctggtagatgcgtgagcatctgcagcctgataatttgatattttcactctggcttcacagatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaaggtgagtcagtttggaaacagtagttggttaactgcagattctaaaatactgtgatgtaatgatggaagatctcctacgggatgccagcgttgtatagcaccttataagttatgctggctttagtctcttagtgtgctggaactggctcataagacctagttgttccattttctggagttccaccactttgatagcttgaaatcagctatgatgggagtactaatgccgcacaaatctgcaaatactgtaagtcagaggcttcccttttgccacatattggcagtatggtagggggtaacttcctttcatttctcttaagtcttctcatttgtaagcaaaatagcaacactattagcctggcgtggtggcaggtacctgtaatcccagctactcgggaggctgaggcaggagaattgcttgaacctgagagcggaggttgcagtgagccgagatgtgccattgcactccagcctgggc

SEQ ID NO: 69613 - DNA, 4158 bp, Homo sapiens
ggcacaattttcttcagcttaagggaaatcttaggagagggacattgatacttttacttgcctttaatttgtttacattactgcccaagcagatgaaaataaagtagatgggatgaatgccccaaaaggccaaactgggaactctagccgtggtccaggcgacggagggaacagagaccactggaaggagtcagataggtatgcttgttctctttctcatctttcctctgatccacatgtttgtgtaattaagaaattaagttcttggttctcagagcactgccagatcgctcattgtgagcaaactaaagtcagccaacgtagacagttaagattctgaaaatctagaagtaatacatcatccagacaacaaggactgttgactagaggtgcctgttcagtgccttgaaactgcatgcatacacatgtttgtattaggcgagtcctttcctaaagacatggttttatgcttacgtctctgcaggaaagatggcaaaaaggatcaagactccagatctgcacctgagccaaagaaacctgaggaaaatccagcttccgtaagtgttgaaggctgctcccaatttttcattctaagaaaaattcttagaattctaagtattcttactaagaattaaaaattcttagtattctaaactttttgccgttggacttctttccatttggaatacaaagtgtttggaaataagacattggtctttactgaaatagcgaaagaagtttagctttttcctggtttctgtcttcctttgttctcatcccttctgcaaggtgtagaggtggtatgagactatagtaagatcgcatgtgcctctgaccctcttccctagctcctctccaatggacaatgctgatgagcaagcaagtgggtgtcatctgactgtcatcccccattgccaaaggatcagtatcctgtgtcttgggttttgatgtgataattcagggccttcattatcctgtcactctcgttgtgttacagaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagacctttcttacctttttttaaaaacaaaaaatgaaattattttgcatgctgctgcagcctttaaagtattgaagtaactggagaattgccaatacagccagagagaaagggactacagctttttagaggaaaagttgtggtgcgttatgtcaccatgcagttgccagtgtgattagtgcctaggggtctccatttagcagaaatggtaatgacagtgatataatgcctggaacctggttgggcagtaggggagggaggtagaaggaaaagtgtgagatttctaccttttagtttttatcctattgtggcatatatgaattctcaaacattatctgaataaattttccactcttggaaaggtagatttagcctcaagttgttctagtctccaggaggctgccagcccctcctcttatttaattctgagttttgggggccagcctagagggaattccttttttttttttaaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgtgtgacctccagcaaacacatgaatggttatttcctggagccggaagcacttgggggtcgtggtaattcccagtgttttctgtgtcctagttttaccctttctaaacactgtcctttttgaaagttttgaatatatccacattctattgaaaccttgaaactaaaaatttagactcttatcatcatcttaagttcttcatgctactcttaacctcccaaaaagcagtatctaagtcacatacatgatgtcttgggcattttctcagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacagggacagttaaattgggagcctttcttacaaccttgatgggatttttccccccaagtttccttctccactgaaatgccacactaatgcttgttggattcatgaggtggccagaccaatgtgttgttttgttgttgtttttttaagcttcccttgagagaataaatggtaatggagagaactatttaacaaggtcctggtttctcttgcaacacagtagctaaacttgcctgcttttatatgcatttttgtagggatcagcttggtagacagtattagcggagaaacaccttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttgggttgtgggttttttgttttctccaaataaatctgatctttaaagttcattgtaatgctgaagttctttgacaaatactctgcactcccagtggtttttactgtagtcattgaccacctgctcctcctcctcctaccatctctgaagttttcattcagtattggataccatattgtccaagattagagggtggggttacaagggaatctatttcagtgtttattgaggcccaataatagagtttgcatcctagctcccctctggcttttttttttttttttttttttttttttgcctggtgttaaattttttaatcacctggatgtgcctgcagtctatttcctgtactgtttattttaatcaagatgtgggaactctaagaatgaatccttgtgtccttggggcagttccctcataatctccctccctcacttcagcaatctggagagatgctgctcccttgagttacaccgcactggtggaccagagatactggtgacaggctggtcgaggttaccagaacagaggctcacagactcagtgggaattttccaaacagctagggacagactggtcattgttgcaaggcgggaaaggggttaggacagtggcagagaatccttaaggtcacaaggaggtggagcatagaaaggagcccgggaaacctcagtcaacaattttggggatttaagagccaagatgaggagccagttaaatgatttcccagccaattggagcagctgctcttctagtttctggccagtgcatttatctctgttctccaaaactggtaaagttgaaggctatgagactcagctgtgatgatgtgaaggcttttcaatgtgggtttaggtgcccctattgtccaggctgcctggaaacctacaaggtaatgctttttcactgcctctccaccacaggaatcagtttcactcacattctccaagcctttgtttcaagccactctcagctgtgcaataatgaggtctaggtaaatgatggaaagaaggaacataaaaataggaaaggcttgttgaaagaggtttatgatggctgtgtacagaaagggtagagaggaaggccctatgtcccaaaaggtactctaaagtcagagaaaacctgggctgtaatatggccacatcc

SEQ ID NO: 69614 - DNA, 1083 bp, Homo sapiens
gggtggcacgactcaaacctgccctacggcccattagctccattccatgaagttcctatccagtaccaggcactgcaaaagaagggaatgaggtcagaccatagaaagaacttccatctccatttggaaaggctggactcaagttaaatgtaaggaagaccttctcagaggtctcctgcgaactgggaatgacggtccagctctttaaaatagggcaatgggccgggcacggtggctcacgtctgtaatcccagcactttgggaggccaagaaggggaaatcgcttgagctcaagaattggagaccagcctgggcaacatggcgaaaacccatctctacaaaaaattagctgggcgtggcggcgcccatcttgtagtcccagctactcgggaggctgaggtgggaggatcgcttgagcctgggaggcagaggttgcagtgagccgagatggcgccactgcactccagcctgggcgacagagacagactcccgtctcaatgaataaagcagggcagtggatgggatggctggagctgcttgcgggtggagatgggggcttgagcctgacggaaaggtccccagctgtgaatcctttgagaatactagcccaggagaagtctcctgtggggcagaggaccagggaagggtgtccaatgacttgggccaaaagtaacaccaggtgtcttcacctgattcaggcgcccgcctgggtaggggacgctagcaccaccaggctaagccacgggtggtcctctcaggtcaggcccaagcccaggcacactcctgtggggagggtaagaggctgacgctgcgcggcagttccctgtccccttgttcctagtcccttctagacctacgcccaccgtttcttctgcgtctgtctggctcgcgtgtttctttctgcctgtgtcccgccgggtcaggctctccccgtctctcagactttcccgtccccgtgtcctccgcggccgtctctctccaactctctccccctctcagccacttcctgtctccagtatgtccctggcgcggcccggctggccgtctgcgcaccctctctcccctcggctctttgtgagtgtg

SEQ ID NO: 69615 - DNA, 1059 bp, Homo sapiens
ggcttcctggaagcggcctggcggaggcagccgcttcccctgggcggagggtaggctgtctggctggtgtgaggagaagcccggccctggaagtggagggaagtgcaggcgggaagggggcaggtcgctgctccaggaagtggaggggggaggatgtgggggaggccaggagatcagattcccaggatctaccctgctgggagtgtcagcctgtgatcttttgctccccctactcccccaactctggagttgtcccacacctgggacaccacactctccagggatctgcagggatccatggtcttgagattctgcccccacccccggtggggccgggtgagaattctggtctcggggcagggctaaagggcaagtggggaacagtgtgtcccagccaggctccagcctgaactctcaagctctcgagggacttccgctggggagggagtggagctgggaactactaccagcaggcaggcccaggatcccgagtgtgtcctgagagtcaggtaaaaatgggactgggggcccccttcctgtctcagtttcactcgttatgaagtaggaaaaggaaagcatgcaccgcccacctttaccctcaatacaccttgcaaggccaagttccagccacaagactgctttgctcaggtttggggagtaatccattctcctgccacagcctaaggcatatgaggcccttctcctgaaagcccccaggtttctgctcctgacacagtgccccccactcacccattccctggctttgtttcagacatgatctcacagatccctagccctctttccagccctgcaacttgggctctctacccaagggctgcaccctccccccgcggcaaccccgaagcctgagtactaccttcatggctctcctgggtctgctctccttcctcagcagctgtcccagggcctgaggactggacaggaggtcccccctcccaacacatactccacccccatccatgggcctccggcctccctcctgggaacatggccaacttcccgtcctgggagtcaagggagggaggtggatggggcctt

SEQ ID NO: 69616 - DNA, 1038 bp, Homo sapiens
aaatctctgaaccactcaaagcagcgcagcactctgcccaggtaagtgagggtgctggggtggtcccacgtgaccccctttccgccggccccacacctcagcccagggcactgccccgcaacagagctccccgggacagccccccacccccaaagcggtattctccctccagaccgatccacccaccctcaggacccagcaggcttcacctgctgcccaacagacagccttcccgtcacactagccacctccgggtgccccgcccctgcgttcatgcgtaggctcctcctccccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctggtgaggggcggggccatcaggagtccgccaatgagagggatgtagggtccagatgggcgaggctaatcactgacgtcaccagcggaggcgaggccgccagggggcgggaccagagtggtggggtgggggcggggcccggagcgcggcctggagcggagcggagaatcctggaacgctggcgacttggctgtgactggctaggccgggccttagctacctttttattttctttatttatttaccttttttttgagacggggtctcactttgttgcccaggctggagtgcagtggcacgatctcacctcactgcaacctcctccacccgggctcaagcgattctcccacctcagcctcagtagctaggattacaggcgtgcgtcactcacgcccagccaatttttttttttttttttttttttttttgtattttttgtagagacggggtttcgccatgttggccaggctggtctcaagactccagggctcaagcgatccacacccggcaaattgttgtaattttagtagagatgaggtttcaccatgttggccaggctggtctcgaactcct

SEQ ID NO: 69617 - DNA, 1036 bp, Homo sapiens
tctttattattagacaaaaatagactctcttttttcccctattcatgtgatcctactctgaatctctgctcagaggaggcagtgactcgctccccacccctctcccatccctgccgtgctggcacctgcagctgggtggaactggcaggggctgatcccctggagggctgacgttctcctgcaggtggggctgcctgatctccttcggggctcaactgctgatgcctcctcacccctcacacacccatctctgccatctgctcacatgcaaggtcatcttgtgggcctgtccacttaacttagcaggctgggggcggggaaggagagcagtgtcccaggcctgatgcccactcctcattcctaagggagggtgctttctcctgggtctcctgggtccaggccaggggatgtgagggctgtggggtgctgggaggggggcagtgttgatgtgggctctgagcttgtggccttccttcattttctctggcccagtagaactttggtgatgaaggtgacaatggcgccagcaggctgatctgggtcaagctctgcaaagaggtgacacacattctcccaggggcttcccggcttcttggccacgaaaccaaagatcctagggggataaagggtggggaaggggcttaacattccttccacaagggaatgtagctggccttggtgagacaaatcaaatgccagcattgagaggacagcagcgccctggtcccttggaaggaagaggctgaattcgtggggaggcttacttggaggtggtcccgtctgggttggtccatctgcagaaggagaagaaggtgaagatgcacaccccaggggacagctgctgaaggggggccggggccggggctggggctggggctgggagctgggacctggtgggaccatggggatttggggcaaagggtttggagggagagtcacctccggtcttgagggtcagtgctggagaaggtgatgctgttcactggataatggcggcgaaagaagagcctgcaaggaggagggtgaggaaggtcac

SEQ ID NO: 69618 - DNA, 1132 bp, Homo sapiens
ctctggtctgcagccgccactctgtggcactgagtcatgtctttggcttcttggggctttggtggtatgtgtgtattagggggagacccaaagaaagggctccatcttcccccaccaaaaatgcagagaaacatttctgttgattggacattgtttgagaggagacacatagggtagagttgtctggggagtggccatcgtcctggttggcctaagggaccattgtagttggaagtaagggctaagatgaaagatcatttccttctttgtgatcggcaattccaacgtaaccccatttacactgatttagggagaggcagcaatgtgtattggtcacttcattaagtcttcccacttgtttttggaaattcaggtaatcttatcccagtttactgttgaagaaaccaaggcttaaggaggtgaatgtcatttgcctgaggttagcggctgttaagtaataggagttaggatttgaacccaggtctgttggattctgaggtacaggttgagggaccagcatcaagatcctaacagttcagactctaagggttaaccttcactcctcctctaggttcctaacagctatagaccaaggaggcagaggaatgtactcaagaaagaatctgtcagggaggccaaatattccccccacttccacccctctgagttctctgggaaggctcaggaggggtcgggggagctttgtccaggagcaggagagtggatcaggaggtttatgatggctttcactgtgagggctgggcggtcccctctgaagagggcacgctgtacaagcctcacctatacactgtacaagtacctagtcgtccaggacatcagcattctgtccgaagtgctctgtggttggcaggtagagagtgggttttaaagacccatgttggggtagtccgtcctggcttttagcgtgagaaagcacctccaccctatccagagacagaaatgcagcagctaccctcttctgagctgaggcaaagggaggggctggccgggtatttcccaaggatcagggtctggatcggctgtcttttggctctggaaatggagaacactgtgtttcctacaccgaggccagttggatagaatgggtcaaaggcagctgtggggtccccca

SEQ ID NO: 69619 - DNA, 1063 bp, Homo sapiens
ggccattgccatggtctcagttcagaccatctgctccccctccacatcagcctcctaacccatctccctggcacccagatctttcctttcccatctacccctaacactgctgcccaggtgaactttcctactgcaactaatcattccctaccctccttcaaaaactctagtgataagtcaatgctggcacttttggatcagatatgaacccttgatgtggcatccaaggctccttcccacacagccccagcctatctgggggaagatatgtgcttccatgcctccaggcctttgcccatactggcccctcagcttgaaataccctttcctaattttcagccatggaatctagttgcttcttggaggcccatggttgagatgccccctcctgtgggaagccttccttttgtagccatcaattactatgacccacctgtttctctgtactcacaggcacatcaatgccaccatacttagctcccattacatttgccctggacacatggttggacatctttctgtctctgtctctgtgtgtgtctcacttcaattactctgtgaactcccaatggccctttgagattcatctctatcaccaacatctggcacaaagtgatgccaagtaaatgtacatgaacaaatggatgaataaatgaatgcatgaggccaggcacagtggctcacacctgtaatcacaacactttgggaggccaaaggaggaggaccgcttgaggccaggagttcgagactagactggacaatatagtgagatctcatctctacaaaaaacttaaaaatagccaggcatggtggctcacacctgtaatcccagcactttgggaggctaaggtgggtggatcacgaggtcaggagatcaagaccatcctggctaacacggtgaaaccccatctctaccaaaaatacaaaaaattagccgggcgtggtggcgggcgtctgtagtcccagctactcgggaggctgaggcaggagaatggcatgaacccaggaggcggagcttgcagtgagctgagatcgtgccactgcactccagactgggagagag

SEQ ID NO: 69620 - DNA, 1022 bp, Homo sapiens
tcttgaacccgggaggtggatgttgcagtgagcagagattgtgccactgcattccagcctgggcaacagagcaagactctgtctcaaaaaaaaaaaaaaaaaaaaaaaaaaaaggccgggtgcgtggctcacgcctgtaatcccagcactttgggaggctgaggcgggcggatcatgaggtcaggagatcgagaccattctggctaacacggtgaaaccctgtctctactaaaaaaaaatacaaaaaatttagccgggcgtggtggcgggcgcctgtagtcccagctactcgggaggctgaggcaggagaatggcgtgaacccgggagacggagtttgcagtcagctgagattgcaccactgcactccagcctgggcaacagtgagtctctgtctcaaaaaaaaaaaaagaaaaaaaaaaaaaaaaagcaagaagcccggaggactgggtgcgcgtgcagggatcggaagccggttggagtgtgtgaggttttctcgctctagggagattcttcaagcaatcactatgtcaacagacacaggtgtttcccttccttcatatgaggaagatcagggatcaaaacttattggaaaagctaaagaggcaccatttgtacccgttggaatagcaggttttgcagcaattgttgcatatggattatacaaactgaagagcaggggaaatactaaaatgtccattcatctgatccacatgcgtgtggcagcccaaggctttgttgtaggagcaatgactgttggtatgggctacttcatgtatcgggaattctgggcaaaacctaagccttagaagaagagatgctgtcttggtcttgttggacgagcttgctttagttagacgtctcattattgaagttactattattgttggaaataaactaatttgtatgggtttagatggtaacatggcattttgaatattggcttcctttcttgcaggcttgatttgcctggtgaccaaattactagtgactagtttactaactaggtcattaaaggaagtca

SEQ ID NO: 69621 - DNA, 1041 bp, Homo sapiens
ggaggaaagcctcggtggagagggtagggtctgacaatctcctcacccccacacagaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtaggcgggaggaggtggggggtcgtccctgttcccctctcctgggtccatgcccctccctctttcctgctcccgggattacttttctctcggtctctctgtggctcattctacgtgggcctcttctgtctggatctctgcttttcctccccgcctatggtttctcactctctgttcacaggtacctggtggaggaaatgaagaagcgggaagggtttgagctagtcatggaggtaggacccctttctattttgtggcccctgccccagcctagctcttttgcagcccccaagccccaactaaagccctagtggagggaaaagggcagggagaggggaaaggggcagggagagggaaaacggtccccctttctcagctcacaccttcctctttctcattcctctcagcctgagtttgtcaatgtgtgtttctggttcgtaccccccagcctgcgagggaagcaggagagtccagattaccacgaaaggctgtcaaaggtaggcgtgctgtgctgctctctttacccgttagggagctgatgcaactgatgcgcttctgccccctgttggctgggagtggcatggcaggtctccttgctggtctcttgctctgaggcgtggatgctctcttttcggtaggggtggggatggggaggaaggtatgtttctgggaagtaagaagcagcgacgtgtgttacaggagaagtcagagaagtcaccagtgtgtagtacacagagccttgtgctggcaattgggctgggaactcaggcccaggacagatatga

SEQ ID NO: 69622 - DNA, 1011 bp, Homo sapiens
ctcctgggctcaagcaatcctcccatctcagcctcctgagtagctgggactacaggcatgcccactacacttggctaattaaacaaaaaaatttttttagagatggggtcttgctattttgcccaggctggtcttgaactcctggcctcaggcaatcctgccttggcctcctgaagtgccgagattataggtgtgagccactatgcctgactcaattttttttcaatagcattggatcttccagtaaaacattcaagttctttgagagtatgagctttggaaatgaaaacctaggttcgaagtccatctctgcagcttctgcttggatctttgaatctcagtgtccctggctgcacattaaaaaggacagtaacacattgttgtgaggttgaaatgggccattttaggcatgcaaagagcttagagctgggcccagcatcaggctctgagtagcttttgagatgactttacatctttctccctctacattttggcaacagggtgctgtgccgttcctggtcagtgccacctctggcaccactgtgctaggggcctttgaccccctggaggcaattgctgatgtgtgccagcgtcatgggctatggctgcatgtggatgtgagtgggacttcggcttgggggtgcggtggggtgggctgagccaaggccaaggcccacgttgttcctcctgctccacaggctgcctggggtgggagcgtcctgctgtcacagacacacaggcatctcctggatgggatccagaggtgcatacagtccccttcttcccaaatcccgcccttcaaaccattggtccagagaatcatcatggactagggagtttaacatggctggggtaggaggctgaggggagggggactggagagaggattgattggagctgggaggtcagacatggcagttcttcctgatgctggggtgagggtgagaccaaagcccctttgctggggacctggaaaaggaggaagggctctggttgggcagctggaggagg

SEQ ID NO: 69623 - DNA, 1217 bp, Homo sapiens
cacccaggcgattcgtatgcacgctgacatttgagaagccctggtctacaggatcccatttgttggagctcacacttgacttttaccttctctcccctcccccatcaagttgtgctaacttgccctctgccttcccccacagtgtcactactccatccagaagggagctgcgtttctgggacttggcaccgacagtgtccgagtggtcaaggctgatgagaggtgaaggtccttctgcccacatggctgtgacctagctttgcacagcgtaacttcctgccgccagaaagctctggcatcagacccttaccgctggtggacctctctcccctcgctattcagtagaattgctgttcctgtctaccagagcctgccagcgtctcccacctctgccctgagatctgtttcaccccctgagggaaaaactagcactgttgtctctgcattgctaaccccaccttaccctgccttcaacagagaacctgtccctgctctaccctctgcattttctttttcagagggaaaatggtccccgaggatctggagaggcagattggtatggccgaggctgaggtgagtcagtgaggctcgctggggtgatatagcctccaactgtcttggagggttatttgggctctcctttctcaaggcatccttcatccctctcgtctccatgcccatctcccctgtgggctgaagtgaccatggagagcctgggggtgaggacactacattgctttctggggctctgcccagacacctacgccgggttggattctgagaggcagggctgagtgagggagcgagtcccaggcagcaccacagggagggtgctgggggcctgcgctgtagtgtggaaggttcctgtgggctgtgagggtctgcgcagggagaggctgaggaggggagaggcactggtgaaggctgtgagtagtggggatgaggggacattagcactctcctctacttcgaggggtatgtaactgctacagccaccttggagggcattttggcaccatctatacaattttatttatttttattttttaatagtttttgagacagagtctcactcagtcacccaggctggagtgcagtggtgtgatctcaaaaataataataataaataaataaatataaatgtaaaaattttttttttttttttgagatggagtttcactcctgttgcccaggcaggagtgcaatggcgtgatctc

SEQ ID NO: 69624 - DNA, 1061 bp, Homo sapiens
ctgccctctctctactgcttctgggaatccctgtcggcagagagtttttcctcatatcctttggacccactttctccaaactttctcaggcctcctgacccctgttttctctttcttgcttccctggttctgtcaccaactcgttcttctccttggactgttgctttgctcactcttcactgcctcctttttgtgactcctgtgcagtttaagggcctgtctgggcagtccctccccatctctcctttctcgtcgttctctctcctggcaggtacacatatgaaatcgcccccgtgtttgtgctcatggaagaggaggtgctgaggaaactgcgggccctggtgggctggagctctggggacggaatcttctgccctggtttgtgagaaggaggaggacctttctttgccctttttatgagttcctcctcccccaccgttctcttgctctagtgtctggcagggagggatgattcctctttgattcctctccagctggacccaggccaggccagggaggcggctgcctggtcccttcatgctcatgtttgtcaccattccctggggtcagtggtctagttcctgctatctccggacgggggctgtctcttgggggcagccccagatgtggagaggtgtggtcaagaggatctgctgatcctggatccattctgggatggtatgatcctgagaattgtggcctgggagccagtcatacctgcttctttgatgagctcttctggtagaaagggaagggaggcaagctccagtcttgacccactgctccttcctcttgccaccgccccctccctgtgacaggtggctccatctccaacatgtatgctgtaaatctggcccgctatcagcgctacccggattgcaagcagaggggcctccgcacactgccgcccctggccctattcacatcgaaggaggtggggaagaggcacaggcccaaccctgggctcctgattctaatctccagccagctaagtagagaccttccaggtcttctccctgccctccctacatcctccaaggccagcctgcccccaggcggat

SEQ ID NO: 69625 - DNA, 1039 bp, Homo sapiens
ggtgatgaaaatgttctggcgttagatagtgatgatggttgcaacaactttgtgaatttatgaaaaaaacacttaattgtacacttttcaccccacttcctctgccatcttggtcctgctgtcctgaggagctacctgtgcaccctgcctccggctctcctgagcagagaggtaagcttgtctctgccttaggtggaaatggccactagagtccacttgctcagcactgactgccttttctctcccacctgttcccactggttttctccctgggcactctcacttgcccttgtctgtgcactggaggccgagactgagctgcagggtttgggcctcaggcccgtttgggagaggaggctcctgctgggtaggtccgggaagggttgacaggctgagtagggaatgactctgctctgccacagatcctgatggctgactcagaagcactcccctcccttgctggggacccagtggctgtggaagccttgctccgggccgtgtttggggttgttgtggatgaggccattcagaaaggaaccagtgtctcccagaaggtgagtcctttcttcctcctccttcccatcaagctttctttcttttcttttctcttttcttttttcctttcttttctttctcccccccccttccttccttctttcttccttccttttttcctttcttcctttctttcttgacagagtctcgctctatcggccaggctggagtgcagtggcacaatcttggctcactgcaacctccgtctcccgggctcaagcagctctcctgcctcagcctcccgagtagctgggattacaggcatgtgccaccacgcccggctaatttttgtatttttagtagagacggggtttcaccatgttagccaggctgctctcgaactcctgacctcaggtaatctgcctgcctcggcctcccaaagtgctgaggttacaggcgtgagctaccacgcctggcccaagccttctctttctctttccaaatctggctcagaactttcctcctttgataagatttctcccca

SEQ ID NO: 69626 - DNA, 1056 bp, Homo sapiens
agtttccctaccttcgggcggacggggagaacgcacacgtgtgggcactgccagtcccgtttctgcccgccaccgaagcacccagcgatggcccttgagctttcctccaccctagtcttgccgcctctgtaaagtgcgagcttttcgggccggcccactgggcacaaaagccccaaagggtctccgcccccttcttccattcctgagatggcaaatccaagcaactttccttttggcagagttcctccataggaggccccaattacttttgctcctgttggcttccactccttgcccaggagaccagttcctcctattgacctagaaagaaaactcttcttgactcatgtcctcgttctgagcttcacagagagcgcccagcaaaaaaaaaattcatatcgcacgttgtaatggcctgaagatgttgcatttagcagcccccctcttcctttctggtttcaggtttctgaaacagatcgtgagcttcatcaagagaattcaactggaaaaccaagactggtagactctctttttcttcagacaataggcaggagccaggcagagtccagggattcttggaacacctatcttttcttcggaggacactaagttctatttgaagacaaagttcaatatggcaacaggactgatgggacacgaaggagtcgctaccgtgatttggtgacagttcttcaaaacgacagtgtctcaaggaaaggtggacctaggaactcctgaacttttgggttgccttaagtgagaaatcagcatggctcaggtaaaaagctctagagtcctcctccaagataactgggaagcctgtttgcagtttcactcttgaatgctgccttagtcaacatattgaccaaccccagtgatccaagctctgtattaagcaccagggggagatctagaggaaggaaaggagacaggccacagcccctgccttcagggagcttccagtcaaatgaaggaggtaggctatactgcatcacaggcactgatgggacatttgcaaagcaacgtgtactcagtttacatttggtacattaagtg

SEQ ID NO: 69627 - DNA, 1508 bp, Homo sapiens
agtgagcttccaggctagttggggtcgggagagggatggaaagccatttatttttatattcacaatgccttgtatagtggctggctagtagtagagactctgaatctgttgattgaggaatgtgcaataataggggtatgtacataggagagaacagtacttctgcttggatagaaaaagaagatggaggttgaaagatgcataggattttgctaaacaagcgagaagggtgtttggacaaaaggaacagcatgggcaggagcttagagtcatgggaaaatgtgatgaggttccgagtactgcaggttgtttgatagttacggagtaagggatttaaatggggatagttatggaggtagtattgacagtgataggtgaggaagttgttccctgcagtaagcagagtgtaacccaaaggccttttatgcctcgctaagttaagcagcagagtagcatcagatcagtgttatgtagaaggtcattattgtggaggtagaggatggactggagagacagaatgagcagataggctgttgtagtcatctgagtagaatagctatgtgcacacatctccagagcttctcccagcttgcttctagggaacctccctaccagtctcaccaggatggcagtctgattgtagtataattggctttcctccagctgcttctgaatgcacagcttcctcctttccatatagaataggagcctgtcagtttcttcttcctttgtgttttgcaacccacttctcagcattgtattcagtcttctgagaatgctgccttccactaaggactgaactttgtgctagacactgttaagcgttttacgtcttagtttacttttcatcaaccctgtaaggataagcattatgacaggcatttttcatgtaaggaaactaaggcttgcaaaggtggaataacttgcccaagattatagagtgcaaacagctgagctaagattttaactctggatctttcactccaaagtcccagaaggtggagggaggggtcccagaacgtactgatcatctaaaaggaatttcttcataaatttgtgagtttgctgaccaacgatttcttaaaattttttttttcagtaagaaaagtattttctttaatgccggctaaccgaagtcagtttgaagaatgtagcagttttctggaaatttacttaaacataccttacttaagtaattgtttaaattatatatggagcaaggaatgtgaaaaaaaatgtgatcatacaagcacacatataaatggcctaagaggtcaagagaaatgctgaactccaaaaatcatatcagttgcaattggtaaatacttagggagtttaaaatctaaagggagaaatagcctgtagtcccaggaccttaggagactgaggctggaggattgtttaagctcaggagttccacaccagcctaggcaacatggtgaaaccccgtctctataaatacaaaaaaaaatagccgggtgtggtggcattctcctgaagtcccagtt

SEQ ID NO: 69628 - DNA, 2004 bp, Homo sapiens
tgtttttgccctgccctgccaggtgacctgacacctcatctcctttcaacttaggcaagtctcctggcttgtgaaggcctagcaggtgtgagtttggttcccactgcagccagcaagaagatgatgctgagccagattgccagcaagcaggccgagaatggcgagcgggcaggtagccctgatgtgctgaggtgctcgagtcaggtacagcgcttgagtccattgtggcacctggggatcgggtggcccaagctctctgccaggagataccaagctctgattccttgatgcttcctcatagggaagtggggcaaggggatccaactggggaatggatgaacattggtatttcagaaagctaaggaaggtcttttgtgtgccttcaactcttttaagaccaggtgcttggagaggaaatagttgtatacttcctctaagctttcggggcaggtggtttactctcatttatgaattttgtctgagagctgcattgggtctcatctcatgttccgagatgggctatgagtttagatttgatttgtcttcaaagggtcaccgaaaagacagtgataagtcccggagccgcaaagatgatgacagcttgtctgaggcctctcattcaaaaaagactgttaaaaaggcaggtaatggggtgatcccccaaactcatacagtttggtaatggggtaatattcctccttcttccctctaccatgtaacctggagctttccctagatgctttgatctctgatagccagtgagtgagtcccccagatttcatccagagactaccttggtagttgatctcctgccttgctggaacagtaatggtacaggttggggagcatgagatcccagatcccgaggcatgggagcaggcaggctccagctcaagtcatactcagactgctgggtttgacaggatagacagcttacccactccacctccttccccaaagggtctcttacctccatggagtacaggagatggcagcacctttagacagcatcagagaggttcctttctccaacagctggaagtggacccagagtagaacagtgtctccaggaagagggcagtggtggcctcatgacatgcctgattattgcccccaggtggtggtagtggaacaaaatggttcttttcaagtaaagattcccaaaaattttgtttgtgaacactgctttggagcctttcggagcagttaccacctaaagaggcacatccttattcacactggtaagtctcttgtttatattcaaaagggggagaatagtctatcgcttgtattccatgtctgtttgtggctctagttgggtttattttaatgggtaagtattagaaatgaaggaagaagataagtcaatgaagcagagagattgcatggctttgtatctggtgtcactgagaccagcacctttggggacctctccccatttatgatcacttaggtgtctacacattactaagagttaaagtttctgagaaaactggaatgaggtccctactgtacatacctccccacattcacttctctgtccacctgggccaggtgagaagccatttgaatgcgatatatgtgatatgcgtttcatccagaagtaccacctggaacgccacaagcgtgtgcacagtggtgaaaagccttaccagtgtgaacggtgtcatcaggtaaggctcatccctgctacaataccccacacacacttttccttccccaagaatcagggccaccctccactcctgcctgacaaaagagccaccagcgttactcgccataatagttaacacatcggggtgaagtgcatctgtctggccttatgcagctgatcatggggagcagcaattagaacattgtaataataataataatagcattccatatcacttactctatgccaggcactgtgagagcatactttacatagatgattttatttaatcctcacattgactccctaaggtagctgtattgtccttatttcacgtatgggaaaattga

SEQ ID NO: 69629 - DNA, 2549 bp, Homo sapiens
cagagctgggattcagtccaacttcagagctaatgcactttggaggaagagatacaatctttgccctgggggtcagtatctgatctgatgagaatgtaagagctggggccaaaacaagacaagaacaagagatgagaaatgataatagctaacacttcctggatgcattgctaggtcccaagctttgctctgcactcttacactgaatcttcagacgctagaataaaagctccatgagggcagagactttgttcctctggttctctactctgtatctgccttgagatagatactcaataaatctttgatgaataaagcagctgtgctgtgagtaggtacttttagcctcgctttgcagttttgcagatgagtatgcagattctgggctgttaggtaacttgcccaaggtcacacagctgctgagtgatagagccaagattcagccccaggcggtctggcctgagagcttggattctccaccaccgtgtgctcctgctgtctgtgcacgtgctgaggggatggagaatgtggtatctgcctcctgtgagaggaatgagttagccaacaggtagctgcgtttgtctgctcaggcacttaaccctccctttcttctcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaagaaagaatccttatgggaagttttggggtttggttgacccccactgtaacctgacctgacctgtggcgggtacgggaactgtcttagtaatcatggagactggctgaacctgagtgccaagctgtcagtagggtctgagatgggaaactcctgaaagtatgatttcatttcccagaaaatgtaaagaatggataccagcaatgattcc

SEQ ID NO: 69630 - DNA, 1052 bp, Homo sapiens
ttgggcaagaggaggctattttccactcatcctccctgaaggtgagggccagagaagggtttggctcaataatatgccatctcctgcaagcatacaaatacatgcattcatatctcacacacactctctctcacacacacacacacacccgattacttttttgggagtggacaaggtggtggtattggagcagagaggagcaaagaatatggttaagaatggaacctacattaggtttcttctttagtcttttctctgcagcacccccacccccatcccccacactctgttgggtagggatggccatcaggaagcaagccgagatcttgttttttgggaccaaaggacagacccctccctacctcctctacctgaatacagtgataggacttggggagggagaacagctcctactgctcaacaggcatgtcagaagaccccagattcctttgtttcttgagcagctgttagccaacttgggaccagtcttgggttgttcctaagagggcacaaggagagagaacccactttgacttccatgactccttgctcaacacatctgtctcactttaggagtcaatggcagcgaggtagccacataccatctccaagaccgactccccaaaaaaagaagaaaagggcttcatgggccactctcacccaagtttcctcctaaaggcatttgagctgatgccatcaggtgccaatgtgacatgggccatgacaacacccactggcacaactcttccttttcccttgaggaaggaagaggtgccatccactttttggatccagcccttgtctgctccaccccgtttttccttttgtccctacagtgtataaggaagccaaagtaagctcagctgccattcctgaccttattcttcctcaaaaaggaggcgaagtgcaggattgtgaaacactgaggagctactgcaactaaaaacccaatttttggggagagctggaccagctatagtccctactttggaccaggactcttatgcctctggattacctgtatccacagtttacccgctgaagttgctttt

SEQ ID NO: 69631 - DNA, 1172 bp, Homo sapiens
tactaatgtgtgtactgggtcagaaggtgccctgggttcccacagaccttggtttcctgcctgggtgggtgggagggagggaacttcagagagtatgtgcgaacagccatagcagagccacccctgccaaggacccagtgagggaaactcaggagcaggtggttggttcagttcccgcgctgatgtctggggcagtgcatgtgtgagaagagaggcgcaaagcagtgaaaggagtgatttggcatccagagggcccgggagccccacggataccccagggaagccactgactcacaccgctgcagaggctcctgggcccaatgcccgacccctgctggccagcatggggcctagcactggaagatgcctcaggtgtgtttggagtgggggaaacggaagtagggcacgctctcagagaccaggatagagagtcagggaacctgggaaagagtagtgccagttccgggtaggctgctgcaccaggccctaccagctcaggctataaacagtctgctttgccccaagtcttttccgtccacccccaacagccttgtcatcacttagctactgatcacgcccatggcttgacattggagggttacattagtggagtccgccacagcttcgaaccctctccccagatgccctttgcctctgctgtggccctggggttttatcaactgtccccttcctatcctcctctccaccctgttttttgttttttttttttttaaataatattttgctatgggggaggggaatatcaaatggacaagatcacttttaaatggtagtttttataagatgttataaacttgtatctttttaccattaaagtgcagtgtatgttccttcgtgatatatttaggatatttaaataaaaggaaaatggggcttttctacatactatctcctctttggggaagctttttcatactggttttagttgttttccttttttctccctacataatcaccccacaacttccagcaccctataagccattttaaaaccccttctccacagaggaacaagcaagtaggagcaaaaacagggcatcagttctgagcaagacgaaaaagcacacgcagcaggacggaaggaggctagacaccaacagatgcagtgtctctgacctgggacccccctgcatccgcagcacttgagaatt

SEQ ID NO: 69632 - DNA, 1062 bp, Homo sapiens
ggaggacagctctgccacagagcactcacagagccgacctaggcggccaggggcacagctggaaggggaaggcaaaggagagaagtaggtcagagggtttgatcacccctgacttgtctctcccaggaacctctaaacccaagttctcaaaagagttggagacagacaaacagctgaaaggatgttaagtatagtgaaacactgaggggtgagagagtggagggagccccagtcagggggagggcctggacatacatgggaagcttcaagggatgaaactgagtggggagtcgggatgtcgaggagactcctgtgggggggatggaaagcagcggaggaatacgggccagggttggttggttgttgggagccaggtggttgaagggaagaggaggccctcacctgcatacaccacattgtaggtgtccctggccatcactgcagtggggagcctggggctgggtgtcactgcaattacagtcacacagcgtgtgcaactccacaatcagctcctctgagaagccaagggcccggagcctcaggagatggggctctgggaggcagtgggtggcttggagagaaacccagaaagtcacctgagaagaggcaggaatcaggccatggttatacacatgcacacacacataccccaaactcaccaatcatccagaacctcaccccttagtaaatgaagggatggggtcatgttaacacccaactcctagaaacatgcctgaggaagccactcagactgctccaggaaggatggatggaggactacctcaggctctcatgtcactccctgtacctgccacccatcttttcctgcctgcttaatttcccactcccacctccccctgcccgccttctgcctgtgcttgctggctctcaccgtctggttgattcggacgtggttgcactgtcctcgatcctcagccttaccctccctcttctcaggaccctcacactgggattcgtaagaaatgtggaccccaggagggagtgaagagtgttcaagggtcacggtggaagacaggctctatgggaagagagcgagtggat

SEQ ID NO: 69633 - DNA, 1077 bp, Homo sapiens
cacaaccataaggggcagtcctgttcccaaacagacctccaggctcagatccccgccccacctcctcacctggcagagtgcagcctgcagaatggcatcgaagccaccttcaggcgagtccagattgccggacacactctggcgccccacctcccgctcgaaggcttgtgcgtcccccgtcagggacagcacatggtgaaagctgaatggtgactggcagcgctccagccgggtggggcaggggtggcgcagtttggagggtactgtgctcacaaagggcagcaccgttttgtccacaaaggaaccaaaacctgggagaggagaggaatgaaggttgtgccagaagtcgcagggcagcaacagaggacccatgagagcgctctatgggaagtggggtggggaggacggtgatgggagagggtgcacctagggggcagggacctggtaactggcaagcaaagcagtgagaccactggctcagggaagtggcaggtagaagacattaagaggaggacacaacttcctgggcaaatgggaacttccagaaggcggaagaaggcccgggtataggatatggtagcagcatgaggcaaaggaaggaaatttgaatagaggagagttggcacagaatgtggagccagggacagtggcatctaggtcttgtccagggagacttgcatcagggcaggttccaggttggtaggcccagggcagctgtccaggcccagagagtgcctgagcacagtctctccagacgctgggtctcaggcctgtaaaacggatagtctcttgagtcctctccagctctgacctagaagatgggtgtctagggagagatgcaggaacgaacctgtggcctggctaggcctgtcaacaactgggagggcaagttggggcccttgtgagtccaggatgttggcagaggctagggcagtggttgaataggcaagggctaacagggcgggaggcagcgctcggctcaccaatgcgcacagaatgggtgacttcctgcagccggaccagcagagcgtgcccgagctggcgcacgcgttccaggtcgtccttcatggagtagct

SEQ ID NO: 69634 - DNA, 1061 bp, Homo sapiens
ggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactcatgagatgtggctccctttaggaggtggtagggaaatgaccagctgacctggtgagggagctgagtgaggagggaaagcttgtaattgattggactttgcagctttcttggtagaagaaaacaggatgaagtgtgcctggattgtggtggggacaggatgggggaaagggagcccatggggactcaccctgagtgaccgggtttcccacaaccaccaggtgtgggttcagaatctcactctgtcgcccatgctggagtgcagtggtgtgatctcggcttactgtaacctccacttcccaggttcaagcaattctcttgcctcagcctcccgagtagctgcaattacaggggtgcaccaccacgcccagctaattttttttatttttagtagagacaggtttcgccatgttggccaggctggt

SEQ ID NO: 69635 - DNA, 1050 bp, Homo sapiens
gcagggagggcgtcagtgccagagtgagcaccaccccacgcacaggccttgggcagaacacgtgcccttggaggacacagtggtgggtctgaggagtgaggagaggttgggaaaggcgttccagccctcctcacatctctcagcaccagcccctcctggagcccccatccctagtcttgaatagactccaggcacccttctttcccccctctcctctctcctttttctttgggtaatctcactctggcaggattcttatgctaattgattgtatgtgtgttgggggtgggtagggcttccctcctgtggggtgggtggagctagcgtggaaccctggcatcctgggcattccttccgcccttctggctgcgttggggcgggcttctgaccaggtgggctgcagagggttagaagggagaaggtgttcatgaggtgggtgcgtgggacacaccttagggagggtcttaggaatttttttgcattaacttgggccctccaggtttgggcaacaggtcctacaggttgaataatttacaaattttccgagcctctgaagaccaaccacacgcgcgcgcgcgcgcgcgcgcacacacacacacacacacacttacccagcagccttttgaacagagcagagcatgtcctccccatactgtggggctgagaccccttttgagctgcaattgggtattttcagagtgaagacataagctcagagagggtccagaaacaggttccctcccccatcagtcctgtttacctactgtcacctgacttctccagtttgctacacctccaacggcttccagacctgagaaactgagcaaacacctcagcctctgcttccccagcttctctgactcacagccacttggatctgctggtggtgtggcactgagctggtcacttcccctctcgtggcctcagtttcttcaggcgtgaaccaaggctgtggtgcatcctctcactcactcccctgagacctttgccccatttgctccactgtctctgatggttattcaggggtagtgtgagagagataagcctgag

SEQ ID NO: 69636 - DNA, 1050 bp, Homo sapiens
gcttctggccctttctatgtaaggtactggccctttaaacgtgggggcctcagcgtctcctttgcgtgtgtgcagtagtgtttggagtgtgtgtggtttttatggtgggtgtttagctcgaacctgtggttgatgccactccagagttcctggggatagggagagaccgaggtgtgtgggtagtttgcgccttcacgtccgtggccctggaaggatatgacactcaggaccgtgggtggcgtttgtaaagcccatgtgggaagctggcagtgttaaaaatatcgtttgcagagcgtgtgaatccctggagtgtgcagcgccttgcctaggtggtgtgggtgtgggagcaagggtctctccaccagtgtcgcctgcgacagctgccaggtccacatggcctgtgaggggatgtttgtggcgtgaggccgggagggcgtgtgcccctgcgtggctgcgggggcggttttggaaagtgctgtgttcgagagtgcatcctgtgtgttctcatgccgggtggaaaaggttgtgcacacaagagggagaaggctgagttttgtacgccacccccatataaaaaaagaaatgtttggaaacgtgtatgcggttatatgcagagattactttttcctatggctccaacacacaacaacttcagcaggaagcgaaaagtttaaagcaaagtctgtgtgtgtggtggggggtggcctgaagttgacagcggcagggcgagcaccattactgggtccccaaatatctatcttccccctccgtgaaatgggagatgccaggcctggggccctggaacccctttccagagcagtaataaaaagctggggactgagaggcagtaaaaatgaagtccagatgagaggcggctttgaagcttgggccgcagtgcctggcgggggtggggtgtggggaggggccaggagcgcagcctggaacaccccccaaatttaccctgggctgggatgtgctcgctgcctgggtgcggacggcccggggatgaggggcttgggggcacgctgggaagggtgggaaggggcgggc

SEQ ID NO: 69637 - DNA, 1039 bp, Homo sapiens
tctagctgggaggggggtatgccctggtggtggggatcatagggaagggggtgagtcaggcagcagccccccttcatactcccaccaggatggtggagaacatctggttcccatgaaatgctagaaggctaatgggtctaattgctgcaataagggctggggaaactttggggaaaagagggggcactagatcccccaccctcttaccttctccccaaggctgtactaagtctgtctagaatgggggggtcagggttgatggggagggcgggcctgacaccgtaatgcctggtcctaaggaccccctccatgcaatgcctgggatgcacacacagatggggtgatgagtggggtgcatctggtgaagagaaacgggggctattgaggactcatggcttcctggagccctcccccaactcctcctgtgccctcctcccaacccccctccctgtggcctggccacttctggttctaattaccaaccaggcaggcctgacttaattgggacctttcagatttctgagggggaaggggggtactgacagcttgaagttgactaatcaaggctctttccctcttgttttcggggtactccctattttgcacttaactgtttttgttgttgtttgctgctggtcagattctgattcagaaagttctttctttctctctctctctctctctttctttctcctcctttctctttcttcctttttctttcttctttctttctctttcttttctttctctctctttctttcttttttttgtggggttcgggtgactggattcagaaatgggtatttggggttgggggaggagaagggagtttacactgggttggaaagagcagtgcattccctctccatccctgcttcaagccccctagtcagccttgccaccccgaggtttcctcgccatccacaagtcaggccttttcccagccccggcagccccccgcccctcccccgcgcccgccatccctcgcctactctggcaccccttcctgccctttattcttccaacaggcgccccactc

SEQ ID NO: 69638 - DNA, 2320 bp, Homo sapiens
cagcaggtgaggcggagtctgggcgaggtgcaagtggatgtggcagggctgggcaggggctagggggcgcagtggggtgccagtgacctggaggagtgggcctctgagatgcacacgcatgaccctgaagcaactcgagaggcctgcgcgggtgggagggatgcccgggacagaggatgagacactgagggcaaaaagaggctccgcagcgaggacgggaggtaatagaaggaagtgtacgggagctgctgtgggaaagggcagtagaatttgcgggagcgggattattgaaagggactccctcttcacaggcaaggatgggttgagtgcccagtcctctcccctgtcttcttacccctccctgccccacagtgtcctaggagacagctttggcgtggccactcctcccacccacccaactggtccctccggtctgagatcttggggagtggagttggcagcggggttgggtggagctgccatctgcttaagacagccccttgaccgtgctgcccgaaggatggatatggctctgactcccacctctcttcccaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatcattgatttgatttactcatccttacctgtagccttatcagtagtttctggtgagtgggcagctagaggttttttttttagtttttttttgttttgttttgtttgtttttgttttgagacggagtcttgctctgtcgcccaggctggagtgcaatggcgcgatcttggctcactgcaa

SEQ ID NO: 69639 - DNA, 2717 bp, Homo sapiens
cctggcgtgggttttctccccgatgaaatttctgatgtgattctttgcctccttccacgaccttcagccctcttcccttcctccagttagcttcattaacaatcttctctaattggtctccttttccctagctctccggtgtcatgaggagcttcaaaagagtcaactttgggactctgctaagcagccagaaggaggctgaagagttgctgcccgccttgaaggtgggggtgctgcctggctcgggatacacctggctttccaaactgagctgttttgtgtttgccttttgaagagatggataagtaggcgaccctctctgagtaaccctatttctagttactttctctacctctttcctgcctttgctagccccattcatatctttctctactcctaggagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgagttaaggacctggaggtagggtggggacgtggtctgtggactcactaccagcctagggtatttggcaagatctggaggtcctggctccctccttgttaagctgctctctggacagtgcctagcgagccagcaaacagcctagtctatcctgagagggcagtggcccttctggatgtccttcctcgtgctccctgggctctgtcagctctccaggactccgggtcagtcttcagcttggagccctctttatctctactcctcataccaaccttccgcttccttcctcaggtgtatgggggctcctccaagcaacagcagtcttttcttcagatgtactttcagggacttcacctctacactgtggtggtttatgactttgcccaaggctgtcaggtactgtctgggaatcaaggtacctggactaggctcatagggtttggggttgctccactgccctcaaacagctttggggttgctccactgccctcaaacagctttggggttgcttggctttgggtgtggagtgcggtggaggtcatcttggacccagcatgactcctcactctcaaacccttcttgtcccttcagatagttgatttggctgacctgacccaactagtggacagttgtaaatctaccgttgtctggatgctggaggccttagagggcctgtcgggccaagagctgacggaccacatggggatgaccggttagtgccctgggtcccaggcacagagtttgtgggagggtcatcacccattaggcaggtgaatagtacttgctgcgtggttctgaccactgtgagggttccttatggttcaaggaggcagtgagagaaatgtttataagtaccagctactctgtgtttaacaccagtagagaagtgatgaagctaacttacaacagcagacactatttcctcgactggaatctaacttggcattaacagttgcacctaatatgcaaccttatgacctttcaacatatttttttatttctatattttttaatgtttttttttccttttcttcacttatcagaatccagaaatcattacaaatgacctttctgtatatttaagtgtttttttttttttttttttgagacaaggtcttgctctgtcacctaggctggagtgcactggcacaatcacggctcaacacagtctcaacctcccaggctcaagcgatcctcccacctcagccccgcaacgagctcaccttgcaggttcaagcgactctcctgcctcag

SEQ ID NO: 69640 - DNA, 1036 bp, Homo sapiens
gtgagggagtcagccatgtgggttcctggaaaagaacatccctggcagaagaaacagccagtgctgaggcaggagggggtctcgtttgtaaaatgagtgcagatgggctgagtggtgtgaagggcatgggcctatttggggcaggaaggggagagccgccccttccccattcctagcagtaggggttcctgtctgatctggaagctgctgaactgaccacagatccagctgatctctgctgcctctccaggaggagagggtggtgggagcctttcctatggtcaattgtgccttttctcccctgcagcttcttacaccagtaatttggcctacagcttctatagtcacaagctctatgccgaggcctgtgccatctctgagccgctctgtcagcacctgggtttggtgaagccaggcacttatcccgaggtgcctcctgagaaggtacaagggaatgagagatgcaggaaaggagcttatgtggttggggagcggggggagcggggaagggcctcaccagcaccctgccttggagtgggaggttaatagcagcatgttgacaccagtatctggagcagtgtttcccaaacctcactgtactgttacttactgttgactcatttttttttttttttttttttgagacgagtctcgctctgtcgcccaggctggagtgcagtggcacaatcttggctcactgcaacctttgcctcagcaaaggttcaagcaattctcctgcctcagcctcccaagtagctgggattacaggtgcccaccaccacgcccagctaatttttgtattttttgtagagacggggtttcaccattttggttggccaggctggtctcaaactccagacctcaggtgatccgcctgcctcagcctcccaaagtgctgggattacaggtgtgagccaccgcagccggcctgactcactttttatatttagcctggtcctaagctactggtttccagccaagctgcacattagaatcacctgagtgacctttaagaaaattctaatgtctgccccga

SEQ ID NO: 69641 - DNA, 1001 bp, Homo sapiens
tctgaatattttcaaagatcccccaggtggtcctttgagcaaggagagtgagaacctgggttcttggttttttggttttttttttttttttttttttttttttttggagactgagtcttgctcttgctttgtcacccaggctggagtgcagtggcacgatctcggctcactgcaacctccacctcctgggttcaagcaattctctgcctcagcctcctgagtagctgggattataggcatgcgccaccatgcctggctaatttttgtatttttagtagagacgggggtttcatcatcttggccgggctggtcttgaactcctgacctcatgatccacccgcctcggcctcccaaagtgctgggattaccggcgcaagccaccgcgctgggcaagaaccagtgttcttaagcaagaatacctgtgaactgatgcattggcgggattggcaagcaagatgagtcatagaggggcttgggtttcatcttaactgagatgataagcctctaaaggatttaagtggaggcatgacagcagacaggcattttggatttccctgacttcgctgtgatgaatggagtgcaggagaaaagaccgggtaatcaggctgctatagtattctaggcagggaagggtgggctgaactgaagcagctgcacgagggatggaatgcagtggatcggtgcgagaagccaaggattaacctggtaggtgactggcgggagggagagcgagagaagggaacatcagagatggccccacatttcttactcaggagaaggcagtgccatttgctgagaaggattacaggagaagcaggttttcaagggtgtggatgatgaacataggggtggagtggattgcagcctctgagttgaaggcactcagagtatttcattcttaggtgtctcctgccttgggtgggtgtggctcaggaggcccacctgccaaccccgccccctcatgtggtgtatgtacctattgcatgcatatccccttccac

SEQ ID NO: 69642 - DNA, 1123 bp, Homo sapiens
aagccaaggccttttgcttggaggccctaaaacttacaacaaagctgcagataccacgccagtaagtacagggccagaggatatggcaatgatggcaccaaagtgccatgcacccttgaacatggattccaaactgttccacagattacatgctatgtttagatacattcgtggaaaaaggcattccacagctaaataagtgggaaatgctgagttaatcaaggttagatgtttttatttcctgtaggactctcgtgtccttcagtatgcggatgtgccttgcaaatctccaaaagggagatctagtgtacagtgtttccctaagaatgttttcccacaggattcttttattgaggaatgcagtttgggaaatcctgtcccaaggcacaaggagagttgggattagagagaagtgtagagggttttccccagggagcctttaagtcagcttaagggagtgaatgccttttggaggcagggaaggactcaggtagcttggcctgggaaagaggcaaagagaaagactctccaggaaaacaaaggattcctctgattggttctcctctcctctctcaacaaggtgtgccctgttcctggtgctgaagggcgagctggagctggcccgcaatgacattgatctctgtcagtcggacctgcagcaggttctgttcttgcttgagtcttgcacaggtgagcagccatgtccccatgaccataggcggtgctgaaatgacacacactacagcacatctttctatgtaaaggtttcgttgcctttttttatttttgagacagagtctcactttattacccaggctggagtgcagtggcgtgatcttggctcactgcaacccctgcctcctgcctcctaggttcaggtgattctcctgcttcagcctcccaagtagctgggactacaggcatgcgccaccacacccggataattttttttatttgtagtagagatgaggtttcactatgttggccaggctggtctcgaactcctgacctcaggtgatccacccgcctcggcctcctaaagtgctgggattacaggcatgagccaccgctcccggcctttgttccctttttaatcagatactgacttctggtcccagggcaa

SEQ ID NO: 69643 - DNA, 1694 bp, Homo sapiens
aaaccccgtctccactaaaaaatacaaaaaattagccgggcgtggtggtgggcgcctgtagtcccagctactcgggaggctgaggcaggagaatggcatgaacccgggaggcggagcttgcagtgagctgagattgtgccactgcactccagcctgggcgacagagagagactccatctcaaaaaaaaaagaaaaaaagaaaaagattttacctaaaaaataataagccatactaatatttgatatgttatacagtaatacatatatatacacacatatatatacacgtacgtatataaaacacatatattagagaattgggccccaaggtcgctcaggaagtgcttgatgccatttctccccgttttgtaattcttgttctgccttctccccagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaggtgggactgttgctaggtggtggtgatggtgttggatggggttagtcctggaggagagtgttttatagagcaggtgtccctgtggaatagctccccagggcctagtggaactttaatctcctgctatctgcagtaccccaatatcttgcttttttgttttttgttgtttttttgagaaggagtctcgctctgtcgcccaggctggagtgcagtggcgcaatctcagctcactgcaagctccgcctcttgggttcacgccattctcctgcctcagcttcccgagtagctgggactacaagcgcctg

SEQ ID NO: 69644 - DNA, 1030 bp, Homo sapiens
ccaaagtgctggggattaccggcgtgagccaccatgctcagcctctttttttttttgagacggactctcactctgtcgcccaggctggagtacaatggtgcgatctcggcttactgcaacctccacctcccgggttcaagcaattttgcctcagcctcccgagtagctgggattacaggcgggtgccaccacacccagcttatttatgtatttttagtaaagacggggttttaccatgatggccaggctggtctcaaactcctgacctcaggtgatccgcctgcctcagcctcccaaagtgctgggattacagacgtgagccactgtgccaggccaacatctttcacagcaagacctatttccaagtctccctttgtttcagacagagacattttccttaactctaatgtttcttttaccttttcatcccaccttctgttccctcattttctccctccttccacacccaagagtcgctgcccctgatctagagtgttggctgtcatgtgagaagttagttctgaaatcttccagggtcctgtgtgatggtgcctgatggtgcctccactacgccacctgctgtcacaaggtgtcttgtcactgaagacctcttagcccttcaccctttcactctgatctcaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtaggacagcaagggtga

SEQ ID NO: 69645 - DNA, 1082 bp, Homo sapiens
accccacttggcacattgcccttcataaatggtagttgctgtttgccatgtgggagatgagatagggactgttccttcttggaaagttcctatcaactatgaaataaggaattcagctgtaccaagtgtcctgacgttcttctaggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcaggtgggtgctgaccatccccaagactcctgctggggcagactagagagaaggtccagactttgaaggaatgggacctcacccctccccgtgttgcttgcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggtatgcgggcagccttctggccggctcctctgtcctcttctgcatcttcttacttgggagctgggtgaaggagttttaggcattggttagtttacatagatttatgacccttatgtcataccttttcacctgttagcatcttacatcaggaaggtttgttgttttttttaaacctcaactttgaattaccagcaaattcagtgtctttcctcagaggtgagttcagatgactggggtcttctgtgctaacatgaaacatattcacatgatttgagtgcctcactttgttagttgctgtgagggacacaaagtacaagtcatggtctctgtgcacagggagctattagagcaagggagagcaccttgacctctagtgaccagggaaggcttcttgatgctggcttgagtgatggataggaattgagtgcccaa

SEQ ID NO: 69646 - DNA, 1650 bp, Homo sapiens
ccctgccatttccatgccgtgctgggaggaacatttgaaatcgggcctggcggggtaccagcaggcagcaatagcaagcggggtggagaggagcagggccaggcccccgagccgtcgccatggcaatccagcctgctttccagtagcttataccacccacgtggagtagcatacactactttgtaatatcgtggttgtgtcgtgagaactttaagattttgcagttccttgtaggcaggagtcctgtttgctgctactttacaatactaggcttaagacattttatgaaatgaactcacacaacagtctctgagaggctcaagcccctccttcccttccgggacggaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccaggtggggacgggccccagaggcacctctttcctgctctacatcccccttgcccacgcgtacttctcgcgcccggttccaagttggcagcctacctttcccaggcgaaacctctatccgatcccaggacctgccccctccccggccgcgctcctttctccccttagtcctctcattgacccgctatcccggtcctctgtaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctgtatcctttccacaggaacggctacctgctgccttctccctttctccttcactcccccaaaaagcggggagggggattgttttgattacttcagattaccctctcctcacaatgattttgaggataccctttttttttttctttcttttttgagacggaatttcgctctgtcgcccaggctggagcgcaatggtgagatcttggcttactgcaacctccgcctcccgagttcaagagattcttctgcctcagtctcccgagtagctgggactttaggtacgcgccaccacgaccggctaatttttgtattaatagtagagttgggggtttcaccatattggccaggctagtctcgaactcctgacctcgtgatccgcctgcctcggcctcccaaagtgctaggattacattacaggcgtgagccactgcccccggccaagaatactcttattacacactttgtagctcttttatctgact

SEQ ID NO: 69647 - DNA, 1007 bp, Homo sapiens
cacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggtacggtccgcgaaaagtgaccctgggactgcgtgcatgcatgcctccggggtggatggcattccgccaacagggtcactccgatagcgcccggcagcccaagcacccttcctacccttcctgcctccctgaagtccagcattaatcccctacccggcgacacccggcagccccttcacccctgtgtacctcgcaggatgcagagattgtgcggacccgggatcccgaaaaactcgcttcctgtgacatcgtggtggacgtggggggcgagtacgaccctcggagacaccgatatgaccatcaccagaggtaggttctcagataccatttatttaacttccttgacctcagctttcctctgtgctccaattcagccatccactgccgtagtccgcgtcagcgaaaagaactgcttcatcactgaaatcaaactcccactaggactacatcatccttccggccctgcctgttcttcacccatctccctggcctgggacctcctttggttcccagggagtccctcaggccccttatctcatctccttccttagccaaggctttttttccatcagcaacttcatcaccccaactaaataaacccatctgtgattaatccattctggtgcccttgctgctgcacctaactgctgggcccacatgattgtggcagttggtgacagttcagatgtgtgaagttttctacttcatttacacccttccaaagggaaatccttcttgctcaagggtagcccattccaatccttttcttctccctcaagcctctaccgcatcaaactgagtgtccctgcctcttttcaaaagaagttgagcatttcctca

SEQ ID NO: 69648 - DNA, 1067 bp, Homo sapiens
ctcatcattcccaggcagggttcaagcgtgcaatggatctggttcaagaggagtttctgcagagattagatttctaccaacacagctggctgccagcccgggccttggtggaagaggcccttgcccagcgattccaggtataggccttggaggaggcattatggcttgaggattactgactgccaatcaacaggaactcctgcttcttctaccctaaaccctggagtgcagtggcagacaacctcaacctcttaggctcaagcagtcctcccacctcagcctcctgagtagctgggactacaggcacacaccacctcacccagctaatttttgtattttttgtagagacagggtcttactttgttgcctaggctagtctcaaattcctgggctcaactgatcctcccacctcagcctcccaaaatgttgtgactacaaacatgatcaccatgcccagcctaccttaaaccttctagctatgctctccctctttcaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggtgaggccctagggaaccactctgcagaccttcaggcttgtctcagccttgttaagagaaggctgccaactctgacccctgctgtactccctctttctgcccaggctgcccctgccagagccatggcggggtcttcgggacgaggccctggaccaggtcagtgggatccctggctgcatcttcgtccatgcaagcggcttcactggcggtcaccacacccgagagggtgccttgagcatggcccgtgccaccttggcccagcgctcatacctcccacaaatctcctagtctaataaaaccttccatctcatactgacccagtccttgacttattcttgccctacaccattccagaaacttgtgaaaagtgaaacaactatttatgtgta

SEQ ID NO: 69649 - DNA, 1715 bp, Homo sapiens
ttttcatatttttcaacatgtttcaccatgttggccaggatggtcttgatctcctgacctcgtgatccgcccaccttggcctcccaaagtgctgtgattacaggtgtgagccaccgcgcctggccttttctattcttttttttttttcttcttttttgaggcagagtctcactctgtcgcccaggctggagtgcagtggcacaatctcggcttactgcagcctccgcttcctgggttcaagtgattctcctgccctgcctcagcctcctgagtagctgggactacaggtacgcaccaccacacctggctaatttctgcatttttagtagagacggggttttaccatgttggccaggatggtctcagtttcctgacctcgtgatccacccacctcagcctcccaaagtgctgggattataggcgtgagccaccacagccagcctggccttttctattcttatcactctctaatctgcagccagactgctctttctaaaatgctgctgtgtgatctgtttattcttctccttagaacccttccatggctttccattcattgtcttagagcaagtcccaactccttaacctgctcacaaagccccaaaagtcctctgagccttggttgtctcatccgtaaatgggtagaatctcgttcagatttgtgagatatgtaaatgaaaggacagcccgtagagtgcctggtacatagttggcactcattaaatgtgagtgcccatatttttaatacatgtatattgaatgaatgaaactggtagagagggacagaggggatcagagtaagctgacccacattttcctcccttatcaggcgtgatgtgggcctttttggggtgctaaatgaaattgcaaactcagaagaagagggtaagtatttttccctccagccttccctagttttgtggttatctcctctccatattcttgaactcacccccgacacctgttggctcagcctcttttagccctatttttcctgtcctctcctctacctacccaaataacccagagtgggtgtccagagtgggtgtccagagtgtggtgttgagagcacttactgggcagaaggacctggggagtgcctgtccttccttgtctttcacctagaaggtacctggtaagaggcctgtgaatggtttaatcagagctgcttcctcaaccctacagtgtttgagtgggtgaagacggcatccggctgggccctggcactctgtcgatgggcctcttccctccatgggtccctgttcccccatctgtctgtaagtttggcttcctccccagccctctgcatttgctgtgtccccatcctactctgccctcattcctatccttgcaggtcagggttgggtgtgatgacttcagagggtaggagtggtccagctcccctgttggaatattgaggagatggactccttttgccccagtgtgtcctgtgtctatcttgttcttacagctcaggagcgaagatctgatcgctgaatttgcccaagtcacaaattggtgagtgcacaagccctggagctttgtggaaaggaagtcctgaacctcaaaactccctttggggagaaggcaaagactcctactccttttctgattgctcaccatattctcattcctcctgttcccccaaaaaagaatacaagaaaaagtaggaaaaaaccatgtccttactggaaatgaatgtgagcttctgggct

SEQ ID NO: 69650 - DNA, 1099 bp, Homo sapiens
ggggcagtgaaggcttccggaagaagcgctgagaagtcaggtgtcaggcctccacgaacttcagctagcttcttgggctcgagggagggagggcgcgcaaagccggaaggaggggtttgcggctggggagagccagagggcccacccctacccggaaactgggggtggagaggccccaggccagctcacgccagtcttccagctccgggctgggcctgaggccggcaagccccaccccattcctctgggcacctcgtggcccgggcaggtttgtttacgaatccggctccctcctcctccagcccggccctccgcccgcccccagggtggccccagttccgtgagagggggaaacagagccagcccctggtccgctgccctcctctcgcctccccttcccttccttcctccagcctcttcctagaatgcccacggagggcaggtccttttcccacacctgtctgggccatgctccttttctgggaatggggtggtgtccctttctcctcaactctggactctggagcggactcagggctacttgtctcaggagacgaaggagaaaaggaaactgcttcacttctggttaaaagaggaactttttttttttttaaatgctgagctgggccgggccgggccgggcgtggtggtccacgcctgtaatcccagcactttgagaggccaaggcgcgcggaccacttgaggtcaggagttcgagaccagcctggccaacatgttgaaaccctgtctctactaaaaacacaaacatcagcgggacgtggtggcacacacctgtaatcccagctactggggagtctgaggcaggagaatcgcttgaaccctggaggcagaggttgcagtaaatggagatcgtgccactgtagtccagcctgtgcaacagattgagactccatctcaaaaaaaaaacaaaactaaatgcttagctgccaggcaggacttcatcccacttggggtgcaggggtctgggtttgtgtgggtaccacaggggttagttgacattaagcacaccttcctcaggggtgtggcaagcctaggctccctgagaagccttaggggtttgggtatttggggaagggaa

SEQ ID NO: 69651 - DNA, 1067 bp, Homo sapiens
gaaaagagacaggaaaggacgcatattgacgtgaactaaaagccaattaaacgccgaattaactgagggcggaaacttggagtggcagaggagaattggcggctccctcagttattcaatccaatgaggggacgaagtaggcctggcaccgcctcctagttagccaatgggcgttactggagctgcccatcatgagggagggaagagggctatgccaagaggagaccgtcgccatattggccctcctcaggggacgttgttacagtcattaggtgggacgctttagcggagtcctgcagctcaacaggtgtcagagccaaggcattcggcgcgcagttccgcatcaacactaggacttgtttgcgtcttcatttaactgcccctataaagtacctctcaaatcttacccccctcccgggtggtcggacaggcgggcagatgcctcaatgtcgctgcaagccctgggaatgcaggcgggacgagatctggtgacagcactcaccgaataagttaatactgagctgaccaatatgcagagtctccgtgagactccagaaaacgcgattttattaagttcccccagacaaaggcgctaaccacttaaacgactggttaacttttcaagccttgaggctaaagtgcggataagtcacttccattttttcccccttaatagtaaataccgcctatgcataaagcaagatagctgagctccagctttttgcaatcacgaaggttaagaaactttactgcaggcacctggatttctggcctcctctttatccgtgttttggtggagccggccttaatagcttgtcaatgacacgatgaggtcatgtccttcagtatttgtatcttatatgttgtcacctgcttatatgttcttatgttttaaaatgtgaattctcctaaactattttaagccctttgaaggtaagaactgaggcctctgctgctttaaacaggtaaaaaggtgaagtgattgctgactgcctaccgtgttaggtgcctaagtcagggaggcagttagtattccatgtcatccttaaaaggaagattttattaag

SEQ ID NO: 69652 - DNA, 2834 bp, Homo sapiens
ccaggtgatctgcctgcctccgcctcccaaagtaatgggattacaggcgtgaccaccgcgcctggcctctccatctcttttaaacttaattttagcaagctttccatgcacccacatgttgttttatgccttacctgtccttttcctttttttcccttaggatactttttcttatttagaaactctcaccatgcctaccgtccttcacatttcctatccccaaagcactttttgaatgttttcttagtttaattttgtacaagggagaattaaggcccacttttggcacattgaacctagttcatgtcctgcatgccctgcagctcccctctgccctccaatccattttctttatactggtggctttcgccttcctgttagtcattgctatttcatcatagcctccttttatccttcctacttcatttcttttcttccctcaagtttacgttgtttgttttttaattattttagaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggtaagtgataatcatagagtggggaaggtgttgagaagatgtaaatattcttagataattgccttactcttcacagaaagcgttttagggagagactaaaccattttatagataaggaagtaagagaatggagatccccaaagacaaaggagtttcagcaatacagataggtcagctttttgtttctgttttttgctccttgtctgcactacgttgctgtttatttgttgtatactgccccctaggctggcagctgggtgtcactaactcctttcctctcccttattttcggccaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtaagatttccaatcttgtgcatttattgggaaccaactctagcatcgtagctgaaacttgagtctaaagaaaggaatagagccttttgagataacactttcttgagggttagtcatttaggcaaataaatttgagaaatagagattctgtttaagtaatttggaactgaagtaaaggaaacttctccagttagtttgaggaaggagcacttctgggcaatattctggagtctgtaatactcagtgtttttggtgctgcagaataatggttgacaagctttctgtaaagggccagatagtaacgtaaatattttagacattgtgggcctcatgtggtcacattttcttttcttttttttttttttgagacagagtcttgctctgtcatccaggctg

SEQ ID NO: 69653 - DNA, 1034 bp, Homo sapiens
ttgcctcctgggttcaagcaattctcctgcctcagcctcccgagtaatgcccaccaccacgcctggctaatttttgtatttttaatcgagattgagtttcaccatgttggccaggctggtcttgaactcctgacctcaggtgatctgcctgcctcggcctcccaaagtgctgggattataggcatgagccactgtgcccagccgctaatttttgcatttttagtagagactgggtttcaccatgttggccaggatggtctcgatctcctggcctcccaaaatgctgggattacaggcgtgatgtttctttttttttaaattgacacccctccctcttttatcaacagcttttcctttcattttgtagtcatattttcccagatctttattttattttattttacttttcatttaaagcctcagatgtttttcttagccgctgctgaatcctgaaactcttgccgcaggttgacggggagttggcttttaaagatttaagtttggatgacttcttgtgagttctgtctaataaagagtgcagggctgggctttggcaggagaatagaacatatttccttgatgggtataattcattcacaaaccaaatttcaggtactaaaaataacaatttcacatctgctgggttttattggggtcaggaaaatgtcttctcttagaagttaagttgaatgtgataccagggttggtttgccaagggtgtcactaaacttggagtcagattgctgagagctaatttgttaaaaagttgtgttttagagcagtacatttggacattaatgaaaagtaggtttagatgatttaaatgtcttaccagttatcatttttgtgcaaaaggtcatatgaaagaattttctattttaagattatattttatcaaatataatgttgaatgtttctgcgtcttttgtctttccctagtattatacttgtttctctttttaatttaaaaaatttattttctagagatatcagcacagaaagatatacttgtttcttagggtgtttggtgcttt

SEQ ID NO: 69654 - DNA, 1140 bp, Homo sapiens
ggagtacaatggtgcagtctcgctaactgcaacctccgcctcccgggttcaagcaattctcctggctcagccttccaaggagctgggattacaggcatgcgtaccattcccagctaattttgtatttttagtagagacgggatttctccgtattggtcagactggtcttgaactcctgacctcaggtgatccgcccacctcggcctcccaaagtgatggaattacaggcgtgaaccactgcgcccagccactcttggtattttcaatgatgattcttgagatttcagtgagtcttcaggtgtcagtgaatggaatggctaaacataaaaaggcttcaaaacttgtgatactgtgaatgtaggatgtcagttcaaaagaaatgatgttgtgactgtagggtatcactgagatgccagtgataacctgcccatgtcacatgttgacccttttctctcttaatttcaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggtgagttgacccagccagtttcttacaaatataaagaaaaattaatagatttggagataagaggaagaagattaattttttttttttttgagaccgagtctgactctgttgcccaggctggagtgcagtggcgcaatcttggctcactgcaaactccacctcctgggttcacgccattctcctgcctcagcctcccgagtagctgggactacaggcacctgtcaccacacccagctatctttttttatttttagtagagacagggtttcactgtgttacccaggatggtctcgatctcctgacctcgtgatctgcccgcctcggcctcctaaagtgctgggattaccagcgtgagccaccatgcccggcaaaggttaatttttttttttaggatttaagactcagagctggatgcatataatcccagcactttgggaggccaagataggaggatcacttcagcccaggagtttgagaccagcctcagcaagaaagcgagagccgat

SEQ ID NO: 69655 - DNA, 1108 bp, Homo sapiens
gtggctcacgcctgtaatcccagtactttgggaggcggaggtgggcagatccatcacctgagctcaggggttcgagaccagcctcgccaacattgcgaaacctcatctgcactaaaaatataaaaattagctgggcatggtggtgtgcacctgtaatcccagctactcgggaggctgaggcaggagaatcgcttgaacctaggaggcggaggttgcagtgagccgtgatcatgctactgtactccagcctggacgacagagtgagactctctcaaaaaaacaaaaaagaagactttttcaaaaaataaaagtttgggttagtttggtgtcgattgggtgattgctgttgatactttgtggttctttagttttctctagaatgaatgattaacagttgtgtcctcactttcaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagcaagagcctatgggagagaaaaatagtaatagactagaatgaaaaacacaaaatatacctacaaaataactaaaatttctgagcaacttaatttgaaactgaatatatgggtcacaaatggaattggagttaatctggaaaatttttaagaaggaaggaggggctgggtgcagtggctcacgcctgtaatcccagcacttttggaggccgaggcgggcagatcacgaggtcaggagatcgagaccattctggctaacatggtgaaaccccgtctctactaaatatacaaaaaaattagccgggcatggtggcaggcgcctgtagttgcagctactcaggaggtggaggcaggagagtggcatgaacctgggaggcggagcttgcaatgagccaagatcgtgccactgcactccagcctgggcgacagagcgagacactgtctcaaaaaaaaaggaaggagccaggtgtcgtggctcatgcctgtaatccca

SEQ ID NO: 69656 - DNA, 5896 bp, Homo sapiens
aaggaaaatatacttgaagttttttgttttttgttttttttttgagacagagtctctgtcgcccaggctggagtgcagtggcgcgatctcggctcactgcaagctccgcctcccgggtccacgccattctcctgcctcagcctctccgagtagctgggactacaggcgcccgccaccacgcccggctaattttttgtatttttagtagagacagggtttcaccgtggtcttgatctcctgacctcgtgatctgcccgccttggcctcccaaagtgctgggattacaagcgtgagccaccacgcccagccacttgaagatttttcttgtttttgatcaccttctcatactggccttactcagcttagtagagtaagcactgaattgggtaaggtaacctcacttcctaacatgtcagcttcttatcttttcttcctttacctaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggacttttttttttttttttttggccttttgtac

SEQ ID NO: 69657 - DNA, 4647 bp, Homo sapiens
cagtccactaggggccactggtttcctttctgcccccacgctccctctctatcgcaattcgtcgcttgctagcagccgttgtctcgctggtgcctacgctgtcaaaggagccgctctaggcttttgggaggccgtctgcattgcgtggggaaggcttggacgacgcaatcgcctcgccggcccccggggtggttagcgcttccggggtcgaagggtgcgcggggttgaaagcaggccgctccgccccgtccccctcccagaccagcagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcaggtaagcctaaaaatttcccttgcgcccccggctatggctacaatttccacttttgtcttcttcttagccggctcgggtcctagtcacgagccgcggtctcgcgtagtcccgcgtgagcgcctaccacctcactgtgccaggccggtcattcacgcgaggccctggctctggcgcggcctagtaggcctcgcgcaaggcctattcccccctccccccgccttttcccggtggcggctgcgcaggagtcagggagggcgcgcgcgcggtagggggggcggcggtggatttgttggttgtggggggttgggggaggcgatggccggcttgctggccgggcgggtgagcgcggctccccgcgggggtcaggcgctggcgcagccacacggggaggcgctattagtccggcccctccccctgtatcgcagcgcccccccccgaccgaaccgtttattttttcccccctctttctagtcgagggaagggggggctttttttcttaagtggaaaatgcttggataaccgaggggagagggggctgcggagttaaagaaagggtagacgggctcccagttgccgagttaatcaggacgtttctcggggtaacgaatttttaaattacaaaatgcctgccgatgtaatcccagaccgagctatttatggaaggggtattggacagcagtgttagcagctggattgctggaatggggtacctttatcttgacctagtcaggagggaaattcgacaaatttcttggattacttggtttggagttagaaatgcatctttgtactttacctcaagaaatggcttcaaataggtttcctgttttgttttttttttttttgccttttcgaagttgcgttattgtgatatttgtaaagggcttcctattacatctgcaagagggtaaggaattaaactaccaggtctttaccacatcttattaaaaaaagaaagtcattcttacagacctaacgcttcttcccccaccaagcactatttttccatgagtgaaaagtgttgaattctgggattttgccagcaattaattgtattctgaaaatggggaaatgatgtgctttggggatgcacttatataatcacttacattcttggagtagccagaggacagtttgccatatacagaatggtgtgacagacacttaagcacctaagatatttagggtatgggctttgtgttagaggaaagttaacacagtggctggttttgtgaaggaggaaatctagctgtgggaggagagagatgacatgttgagttttaaaaggatggatacttaaaatgtcattggggacattctacaacttgggagaggtcctttctaaagctgttacgattaggtgctaaaggaggtattgaaggcaaaggcatatccaaaaaaacaaattttctttctacacataactagttactctaaagcagaaatgttaggaacaatgttaggaattgtttcataggtgggaaaagggccatcttgtataggaaaggtgcatttgctgctgttcttaaaaacaaaaaattttagcaatgccagttttattttgattgttttctttggaaggaaatttaagatttaatagacttgaaataaaaactggatggtaaacacaaaagcaaggaaaacatctcaaatctgagtaacaagttgggttggaaggaggaataggagaaaaagactcaagtgtacttaatgtatcgagtcattttctaaaggggaatatggaaccccagcctgcgtggaaggcatctcagataatgccttttcagtgagggtgttgatctaaatcttttagaaatcatttggtgttagccatcaacggttgaaatttgtaatgtgggatacatctcaatttccttatctacaaattgctactacaaagaaaatttacatgtgttctctctagttttcaacttaaactgctccccagcagggaaacaaaaggtcatttgccctcgctgtagttggagatttgcactcatgatttccaggtgtttctgaattctttgaagctttttctgctgaaggacaagtggtgcacgttcagcagtttccttagaaccattgccaattgaaagaaccttgttcatcctgagagtcagcggaaaccctgtcattaatgagaggaactggaaagttgccttctatactgtgtaacagaacctgagctgtatattttgtcatgcagttgtgcttggtgtgtatataagtctgacatactgtcatttaaggaaaagtgtaaagtagaaaatattgataaggtgaaaataacttgggaaataataaccttgttgttttcctcctctgattttggtcatgtttgcattttagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggtatgctctagcttgggaaatggggtcatagtaactgctaggggaggggccaggaagagcagacatgcatcttggagctcatcagattagcactgtggggcatctggctttagcacatttccctaatggagtagaagtgagtgtagtgggaaaatggacagacttgactaggaagctccactgagcaggaaaggcataattagaggctggagccaaaaactctccatacctggatggtaaggtttttctcatggtgattgcttatagcaagtccactccccccaataaatcttcaaatctttccaatcttttggggtaataattagcatagatagcagtctgttggctagacagttaaaattccttttcataatgaatacttcattagaacatgtagaaaaaggaaaaataaaatatatttttaaaaaggaatacttctgagtttcctcttactgacgttagttttctccattgcaggaagttggcagtatcatcggaaaggtaagacaatttcacttcaacttcaattaccatttagtaattctggattgaagtagcagttggagctcatgcttgacttttcctttacagaaaggagaatcagttaagaagatgcgcgaggaggtaagttatgaaagactgagattgttaactttgggaagtaaaaaacctttaaaacaagtgaaaattctttttcagaaattaggaaggtctcaataagggaaatatgtattttttttcggcttggttatttgtagtgataatctggggagtgtattttttttttcccctttttgggaagtgtggttttgacaagtcagaattctttcaagacttaaggcagctgctgtaggctatctttgaggatagtcatggagcagtagtgtttggaatgatgctgactttgctttgcatcaggatcatgtacattggcagtcttataagggactgtagatcctgtacatactcagatcttctttgttttaacttcttttggatcttgtttcctatctagagtggtgcacgtatcaacatctcagaagggaattgtcctgagagaattatcactttggctggacccactaatgccatcttcaaagcctttgctatgatcattgacaaactggaagaggtttgttgtctcccactccctcattcttcatttttaagtgcttccagagagcttgttgattttctaagagctttttaaattcaaggacacactggaccttgagactcgctgtaaatgggtccttagcttcctgtagcctcccacaaaattcgagcatttgtagtttaaaaaagagtcacttgaggctgggcgtggtggctcatggctgtagtcccagcacttttgggaggctgaggcgggcagataaacgaggtcaggagttcgagaccaacatagtgaaacctcgtctctactaaaaatacaagaattagctgggcatggtggtgtgcgcctgtaatcccagctactcaggaggctgagataggagaaacgcttgaacccgggaggcggaggttgtggtgagccgagatcacaccactgcactccagcctgggcaacagagtgagactctgtctcaaaaaaaaaaaaaagtcacttgaatcatcaaaacag

SEQ ID NO: 69658 - DNA, 1050 bp, Homo sapiens
cggggtctcactatgttggccaggctggtcttgaactccctgacctgaaatgattcacctgcttcagcttcccaaagtgctgggattacaagcttgagctaccgtgcctggcagtatttgatttaattttgacatcatcttttttccccattgcctggccaagtgtaactgcaaaacagattattacttttatccttagcaagtacattccttcagggtgaaggaaaatatatttatggctaattttgaggaatttttcatgagcttttatctttacatcaaaaatagtttgagaggggcatggtatttgaaccttttgtctatggtggattatgacctcgcatgtcctaataagatcacttaccctaataagggtaagtggttctttaatggcagttactagtttccagggatctgcttattgtggtgttctttctttctgtaggacataagcagctctatgaccaatagcacagctgccagtagacccccggtcaccctgaggctggtggtccctgctagtcagtgtggctctctcattggaaaaggtggatgcaagatcaaggaaatacgagaggttagtgacttttgtcgtccttttagaaatgttaactatttgttccaaattggctctttgtatggctaggaaaagttagcaatgagatgaagatttttattgaagtaacagttctagaggattacaatgtgattgtactgaaaataaaactcatgcaatagaattattttgcataattcataaattttaataaatcagaacatgagaatgttaatcagaattttcaactattacatatgacaagtttctatttttttttggcaacttttccatgaggctacatagttctttttcatgtctcaagggatgagtttgctatagtagcaacggtttttctattttttaatttttaactttttttcttttttttgacacggtctcactctgtctccccaggctggagtgcagtggcgcagtcatggctcactgcagcaaaacatcgaccttcccagcctcaggcgatcctctcatct

SEQ ID NO: 69659 - DNA, 1313 bp, Homo sapiens
cctcaagcctcctgagtacctggtaccataggcgcgctccacaatgcccggctaatttttcttctttctgttgttgtagagacgagtctcactgttttgctcaggctggtctccaactcctgagcttccgatgattcgactgccttggtctcccaaagtgctcggattacagatgtgagccactgtgcctggcccctacttcctgtttaactatggaagttacgttgaattatggaagattttaattgtatctagatgttactgaatttggtgttggaatgaaactcgaatggctgcttgagtttttgggagcgtatcgtacatggcacgacagagatcttaattttgttaattgctatattcgaagcacttctcatggtacctggcacatagaatggccttgatgtaaatattttttcagtaacataatgaaaggtgggtgatacttgtggggcttttgcttcgcccagagaactatcattagttgaaaggcaactatttagaaggaccttttgcttgagagtaggttaaatttaggctgttattcacgcttattcttgtctttcagtggctaatttatttttaactctaattcactaaacagtcctatctggaataagggaagagtgggacaaagaacaaaaagggaagattggaaatggataaatatctactagagttttaggctctgaaattgctgctggaggaattggaagagcatgaactgtttttctctgattttgaatttctttttactccaaagagtacaggggctcaggtccaggtggcaggggatatgctacccaactcaactgagcgggccatcactattgctggcattccacaatccatcattgagtgtgtcaaacagatctgcgtggtcatgttggaggtaagccctcaggctcatgctgaaaatggggggagggccattctggggacagagggactgatctatatttagtaagactagaattaagtgaggctgttaaggcttccagtgggggtggggctaaaaggttccctgagttcatattttccttcccctagctttgacttttcttatggtctgtgagcaaaaatagaaactgctaagcagcagtgatcttttggttcacagcagttgtagcagagtcggggagaagatgcactgcatggactaaggaggccagagatttatttgagttcctgagtagctgagttaaattactttttgaattactgtattttggttacatggaaatttgacatgttctttaacaacttgtcactttgtaggagggtattcaaagtgttacatagagtagaaaaat

SEQ ID NO: 69660 - DNA, 7248 bp, Homo sapiens
ttattctagacataacacttgagtactttatttgcagttttgaccttatttcctattcaggccaaaaaaatgtgagatactaaaaattatcaacaaaaatatacgtttaacagtttttcatgtccattaaatttatctaaaattttggaaatagtgccgaagattattacatggacatctcccttgatgagaatcagtttgaattgtgtagtccttggacttactgcattaaaggcaaataactttcagtagataaattgagattagatctagccagagacaatttggtaggtaaggggatggaaatagtttttaatttaactgacctgtgtgagctaaagccacacagctgaagcagctttgaaaccttatctctttttgtttttttcccctctgactctctcccagtcccccccgaagggcgtgaccatcccgtaccggcccaagccgtccagctctccggtcatctttgcaggtggtcaggtaagaaaattctcatttgtgggctagaatgaacagagattatatttgaaatgtcaactttgccagcatcacaccaagccactctgcatgcttgctgaaacctatactctggccatagtttgaccggcttttagttttatttttgtactggagaaagctgaatgccttaatttttagcaggcaatggaagttttgtaggcactcggaagaggtaacttacttgtgggttgggttagaatataagagttgaattgacttactgtctctacttctctccctgtccccaccccatccatgttttatgtgtgtggggtgatatttagaggtctaaataaaaggtagcaaagagttggacctctgaaggagattctggatggtggtctcaaaatttgggggtcctgaatttgagtgtcctacaaacttccccttccctccacctcacctcccctactcctaccccttcactcccaaactccagtgtgttgtcccctaggctcttaacctcataaacactggtttgaacccacatggcataactgaaatcagctggggtaagagttcagtgtgcaagaatagaaggggggtgagcatgttgggctgtggtgccgtgacctttggtgttagagtaagaacaccaaagcaccaccgtggcctctctgctccttcctcatcaacctaaactcttgatctttggcacgtggactattctgaagttagattattatgacagaagcattgaaggaccatggtagtcctatgctctgattgtatttgaggagtaggtagatcaggttttaaaatacagttggccctttgtgggttccaccttcaacctacctcagatcaaaagtattcagggaaaaaaatgggtggttgtatctgtactgaacatgtacaggctttgttttgtcattaaacaatagagtataacaagtatttacatagtatttacattgtattaggtattataagtaacctagagatgattaaaatatgtgggaggatatgcttaggttatatgcaagtactataccattttatgtaaaagacttgaatatccatggatatttgtttctatggggggaatcctaggactaatctcccaccaataacgtagggacacctagggacaactgcattgggattcaggttgaaatagtgactgattttggtagctgcctaagcaagtgcgttgctcaaaacaccttttcccacttggggctggtctgttacaagcatatttagttaactagttccatcttacctgcgtttgatctgggagccatttagagggcaagcataaacttgggagtccatctctttcacattgtgttgaattggcataaaaatgaacaagtttttagaggtttagtttgtcgtgtagttatgagaggtttcacaggaaggtcggttatgtcacagtgttaaccttgagtcagtttagtaccttgcttttagaaaagtacaaactggtttgttcaaagggctctcagtctagttagtcagagttgggcaggataagcaaaggcccagagtcagtgtcgccagaaggatttagccttaggagtttttctttcccaggaactccaggttcctgctcttctggattctcccactccccctttggaatagagtcccatactgggtggcagcaatcctctgtacttaaaattcttccttcacttccttttttttccactccccatcacacctcccccttcatacctctttgcttccctacccaccctccctccctccctcccctttatttagttgatgaccaccgtctaaaaatttgcagcttcttctatgagtggccctgtcatggattgttcccacaggcctttttaaatatacaatgtccacagatggacctgtgtcttttgttcctttgtggcaaagtgggctctgtaggggttcaacttaatcccacactgaccaggagctggcatcagctctgttgccccaccccttcattcttattgaaaatagcccaattgtgcagtgtgaaatctgccactaggtaacttttttttttaattcactgattacagctcgtttcaaattgtgtctgagctcctttttaaaggaaaaaggaaaaaaataaacaactttttttgtgtgaatttcatgctggtgacaaggtgccggattgacagccctggagactgaaatcctctatttatccacaggacaggtacagcacaggcagcgacagtgcgagctttccccacaccaccccgtccatgtgcctcaaccctgacctggagggaccacctctagaggtgagaggggatgttcagtctccaaggctcactcaatccttccgcctcagccgagactgccaacacacggggggccagtggcgctggtgatttttggtgctgtggacaccacctgtccacggggacctggactgacccccccaacctcatttcacccaggccgcgtagcccaccagatggtaacaccaactttttttttttttttaattttttttttgttcaacccctcttcccctctcccactcctcccaccccattttcaccttccttccacccccacctgggtgtacttttgggggtactggccactgtgatgtgagaaacttcacatcctgttaaccagccactccttccatcccctccctccctgttcccttttcctttcctccttttccctaccccattgccctgaagacccagctccctttttgggaggttatgttgtgggggggaggagggcatagtgggagctgcaaatgcctatggaggggaggtgggagaagacaggaattagaacccagtggtttttgtttacctgtgatcagctccctactgttagggactcagctagcatccagtgttcttaaggtctttaggcagatagagaaataagttggagaaagggaagtgttttaaaacataccatgtaggtttgtgcagttagagatcttccacatcaccacaattggtagaagggttggggtggtgagggaagagatcattattcctcctaggctatcttgtatacagggaggaagagtggggcttggtcagtcgaggcattgctaatctcacttcccacattttcattaagaaacagttatgtatattttgcctttgattgcagggaacttggctacctttataggattccccggaacaaagtcatatttagggttcaaagaaggccaatttgggtctgaccatatttgtgagattccatctactgcctcaatctctggcctcccccattctctagttcaactctggcttcctggctagttgaaatgtctttttccccccactgggtggctgtccgtgattggtttttaataggaactgttttcctccttttgtaggcctataccattcaaggacagtatgccattccacagccagatgtaagttttgttttcacttcttgttttgaaaagctccctctcccatccaaaattgtctcactcctctctcccaagtagccagaagtgagttgggtcttcagcatttgcagtattaagttgttttcttcacaaggtcaatcccatattttagccctttaatcagggtaatgccttgtttgccttttaacatttaacccctgaaatttaattcagcacattagcttctcctttccccctgtgtttcagattaccctgtttctaaaagggaaatgttccatggtatactgtgatttgttatctcagggcatagtttaaattgacattgggactgtgcttccttgcatgcagttctcttttccatgagggtaatgggaggttgggtttgcccttgggaactcctcaatctgagatgacaatttgaaaagtatttggagggatggggaaggggcttatgttacacagagagggataggaacctgaacatttcagaattcaactcaaacctttcttgctgctaaaacctcctatttaaaagtgccggtatttagacttcaagggcatttttttctgcacttttcttttatccttactaaccttttcaggtgctgagcattattagacttgggaagttgagtttcggtcttggttagtggtaggccccaggagagagggaagtagacgtgaagaaggattattttatgacagtcaggacagtttatatagatgaataaaaatagctgtagtagtcagtggtggcggtgatgggactaaacccagtatggtttcttcacctctctcctccttgcagtctccctgcccccctcatctccttccctctccccaatactgatgaaaccctgcatggtgtgttttccctagcaccactgcacagtttgtttacctagcctgtctgtgcttgtccctgcggcaactgttgcaatggctgcaaactaccttcattaagtagcctccaagggggatggtcgttgggcaagtgctgttgcttttctattcccacacccaaaaggcattcattctcttccaggcacccattctatttctaacccttacccttcatattctgccaatccccaggattgtgatgcaagccccatccctaccctctgttgtagtttgagtagtagagtcaattttgggaatcaggacctgcattttcaaattcgaatgtgcttgagccctggctctgttaaatcttctaatgccaacctcctgtttcctccttgcagttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaacaaaagacagggactaaatctggagaaatgaagtcccctcacctgactgccatttcattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatgtgcaagtcagtgaggttttgaatgctgtgcattgaatttgcttgctctcttctgtcttttagcaggtttggatgcatctgctcagactacttctcatgaactcaccattccaaacgatgtaagtgtagttaggttgcatgggatgaaaataagaaaatagactgtaaagaaatagatgtcgtttcagcagtgtcctgctaccctttttttttttttttttttaaacagcccaggctgtagtgcagtggtgcgatcttggctcaccgcagcctccgcctcccgggttcaaccaattctcctgcctcaacctcctgagtagctgggattacaggcatgtgccaccatgcctggctaattttgtatttttagtagagatggagtttctccatgttggtcaggctggtctcaaactcccgagctcaggtgatccactcaccttggcctcccaaagtgctgggattacaggtctgagtcaccgcacttggcctacatgtcctgctacttttaagccctagggaaagaaactgggaattttattattttatctttatttttgtttttgtttttcataccccaggaatggaaaatgggaatttttagacacaaaaataagttgat

SEQ ID NO: 69661 - DNA, 1954 bp, Homo sapiens
agcacagagatacagaggctgagattcgaaaatggcttaaaccaaggagtttgagactagcctgagcaacatagcgagaccctcggtttttttttttttttttaaagggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctggccacagtcgtaggatttggggtgggggggtgggattcttagacctagccatgcaactctaattcggtgtgccttgtttttctttctcccttaagttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggtaagattgctctaccttttgtcttatttatgccaacacagtaatgtgtgtgttggggagagctgcagtgtattaaatatgggattacatgggcgatgggtaaagatggccaaaaggtttttttttttttttgctagctctactttcttagagtgtagcagaaaaagtaaactgcagtaagttttcaaggggttggtgggggggggagcacagattgcccgcatttaacttgatggtttggtaagagggaagagtggtccttgtcttcagtaagagtcctctggctagagcactcacaaaatcaaatgtgggtctctcttgttctacatagcatatagactactatttctttcactgatttgatttggagtccaaagcacccttaattgtaataaggacattggagtaataggacagcaaggcagtttctgggaggcagcaattaccatttattctggaaacacccatttttctcacactgcatgtgtgttttattcagagcttgtgggaatgtgggaagcacaggtattggaatgtttcggaagtgtgaagtgtgttttctatctcactcctcccccaatctcatcccttaatgacttcctgagggttttatttcccttatccatagctaggtagtgttactactctcaattttaggacactgttcacagtcaaatgggatcctacagtcatttatattacttgctttctcaactcatgggctgaagtcacacccttaattgcttactaatatttcaaagcattgttagccttgaggcccttaggtctcttttaatagggaatgttgtctagttatcatttacctttcttataagtgtttaatctctttgtcataaaagttttacatgagttcctgaatctagtacaggggaaaggaattcctaagtatgtggtctgtattgtgcttgtactgaccatgtatatatgctatggttatttagtgctagctaagaacataccatttccccagtagcagtctgacttttgccttaagacttcatatcttgaggtgctactactctttgtgtagaaaagctttccctttcctagatttgttttcttgtccacccaccaagcacactaggtccttaatgttgagaatgaaatggtagtagtaaacttttgcaccaaggttgtttgcaaagaggtctttttcttttttagagatagggtttcatgttggtcaggctcgtctccaactcctgacctcaagtgatatgcctcccaaagtgctgggattacaagaattgtttttctttcttttttttttttttgagacggagtcttgctctgtcaccaggctggagtgcagtggc

SEQ ID NO: 69662 - DNA, 3582 bp, Homo sapiens
ttgaccttgtcatccacctgcctcggcctcccaaagtgctgggattacaggcgtgagccactatgcccagcttgtttttcttatttgtaattaggattttggagggcaagaagttttcagttttcagtggcaagaatcaggtttttgaaagctggaatttgttttgttctttcgataggcttgcccttcatgtaatttaaattgtgactgtttaaatgtgacctgcttgcctagctcctgcaataggtcagtggctacattgtaaggaagcagaattctcttggtagagtggctcttttcaggatcattgttactgaatagcaattcggtatcttagccatggattagggtcaaaacttttcaaagcttcatctaacaccaaagcaaagattatgcatgcacaaagcttattctttctcaacttggtgcagtttaaatgcagaagtcaaagggtttttttttttttcctttctcattttttttaagtcaagaaggattttactggattctgagcattttctcctgtctcttgatttttcatggtggcagtctgtccttttatatagttagttgacttctgtatccctttcctttatggattgcagctgtccttggacataggtaaataaaatgaggttttaagaggagcctttctgctcttgaagacttagcgttgtgggctcaattgtccaggcacacttcccaaatatatgtagttctggcttagacacatacaggcatttgggagacatgtacccttactgttctgtggagcttattttgggagtggaagcagcagcattttcgcttaagtatgaatttttaggtgatacttgagtttctcttttccacttctgaaaggtccacattagaagtatgatcagtcagaaacaactttttataccacctcccaccagaaaagcttccctagttcttatctacacttctgttctcagcatttttctttgaaaacgctacattctttgaaatttgaaattagtcagtgacctactttggactcttgtctctttccaccctgatactggtttgtttgctgtggagatgtaagcagactttaatacatagctggaaggatttttaaaaattctgctttataaatattcaaagcttcacaagtaattgtgggataattgattttctgttagaataggaaattgacatttgattagaggaaacatttcttccttgttgggtgattgatgagtatctttttctacccgaaatcattccttcaacatctgggttgggtcagtgtgtcagatacatgaagtatgtgccctatgatttcttttctctgtcagctttttcttcaccatagcagtttttaagtagctctgtggaatggaaatatacatatttagagggtgggacataggctaaaagaaagcttgtcacaagttgacactaggtcttcctaattgtcaaccagaggcacttactgatataactgaagcagtttttgtcctgtacttactcccttttgtggtcttcccttccacccaccctttttttttgttccttttttcctctgttacagtttagaaaacgctaaaccctcctcccaggcagcctccgtcacgatccctgatcacctcagcatcaacctctctcaaccctccaccccttcttcttcttcctcctccaccaccaccccctcgctcgccacagcggggacctccgacgcaccctccagcctccccaaccctcttccgaccgccccttgtgtctccagtctgcttggcatgaaacccatccctctcctggctctaaatgttgtgtctgctgctaagggtaccggggcttcagctaccaccaccaccacctctgccgtgccatgtgtaactaacaaactgaaaggcgagaaacagagattctctccctactgattgcataccttgaggcacctcctccagtattattttgttcattttgttttcctttgttaacattggtgagaatgaaactattgtgagcttgttaccgtttcctttttactactttgggggataactgggtgggggtgggggagtggtaacccttgtttaggtttaggccatttcagctgagtgcctgtttcagggtctgacttgaattctttatctagagccacagttttctcttctttcttgtttgttacttttctttgtagctttattctgccttgcaatataacaatgtgttaggctctgtgttaatgaataaaagctgcttcgttaacttttttttttttttttaagaattatttaatggttaagctatcagcaggccttcttggccatatttgtgtttctagctgtaataaagttggcgcagtaagaaccttagtacactgtgtgctgtgaagggtaaagggttgggggcttgtgacttgtggctattcagctaggaagcctgtataactgacatgggctttttgaatcccaagtgaattttatagtcgtttgtcaatatttccacaaagagataacgagtctgtggcagtttagatcctgaaggtcctctgtaattggcaacaagcttcactagtgaggaagtttatctgacttctcagatggccttaccttgccagcagcagctaacaaggtgttcatcccaggattcctctggtgaatggttaccatgaggatctcttccaagtcatacattcaaagaacatacttctttacccagaatgaaggggaggggcaaagtgggataagtctaataaaattaggcagcttctgtctgcattcctctgaattagcattatgcctctttctgtgacattaggtatatctcagccaacccgtgacattatccacaacttgacatgatgccatccactagtcctaaaccaactctgtcaaccaagtttctttacccttttttctattcctggccgtatcctttctgctccccaccagcactatcaggagtaggaagtgacatgcttagatttggaaggaaccttaaggatcaactaatctgtaacacattgatcccctcattttacagattaaaaaatagaggccctaagataatttaaattcataggttatgagtgactagccaggactaacaacttaagctttacttttactcaatcgtactaacctccctgaaatcttgttcattttcttatactaagatgggcacaggcctctcataaaacagtagaaatgttcttagtatggtggtataaggcctctgatagccttccattcaacgagagtacacgttgccacagtgctgaaagtgtaatgctcttcccagggcattagagaactcagtgtagagatagtttccctgatgaccttttcccagcatcaccattggctgacaaaaaaaaaaaagctgttagtattccaatatattatctcattctttgatgttattttggcccctccatcccagattgggcctgtgaagaagtgttacacgtctcaagtatgcataaaggattagatggccaaacctgtccagtaaggagttttatttagttgctcctttatcatgtggtccagctctctcccttggtaagcttgctcctcctgtagttaggacttaatcatgctgatacca

SEQ ID NO: 69663 - DNA, 1079 bp, Homo sapiens
ccgggcacggtggctcacgcctgtaatcccagcactttgggaggccgaggcgggtggatcacgaggtcaggagatcaagaccatcctggctaacacagtgaaaccccgactctactaaaaacataaaaaaattagctgggcatggtggtgggcgcctgtagtcccagcaactcgggaggctgaggcaggagaatggcgtgaacctgggaggcggagcttgcagtgagccgagaccgcgccactgtactccagcctgggtgacaaagcaagactctgtctcaaaaaaaaaaaaaaaaaaaaaaaaaaaaaccctaaatattcccttaatactgaggtggagaaaccatttctgactaaaagtaaatagtttgtagtcgaaggactttgcagttttttggcccttgcttttctacccagcttttggctttgcattgttgtggaagggatacagatggtgaattaccaatcatgttttcatgaccacatatcacaaatattttatgctaatcagtttaaaatcttatgaaataacttatcttatgaactgaaatgaagtcttatacatttggttctattcaaaatgagggcaaagtcttgctgcctacctacctaccagtgaagcatactgagtacttaaatacttttccctgaaagccctaaattggattccaggacctcaaatgactatctctttgaaacagaaaggcattgtagccaggtatgtttagatggaggatatggcttgacaagatctaggagcttgtagagtgagctacagagttgaaacaaattattttgtctgctacttttaagtcctgaaaactttttaaagaactttttaaggccgggtgtggtggctcatgcctaatcctagcactttgggaggccaagacaagtggatcacctgaggtcagaagtttgagaccagcctggccaacatggtgaaactctgtctctactgaaaatacaaaaattagctgggcatggtgacagctgcctggaattgcagctactcaggaggctgaggcaggagaatcgctagaacacgggaggcaggggttgcagtgagttgagattgc

SEQ ID NO: 69664 - DNA, 5417 bp, Homo sapiens
agttgtctcagcattaaacccttgagactactctcagatgactctttctttcctaaactggtattctgtcagcagtttgggaggagccaaagtgagctcagcaataaagaaacattgcttctgtgtattgtgagcactctttagaggggcctgtttccagaaagtacactccttggttagcccaccatggaggtggaactaaaagagaacatagtttgagggacattggataacaagggctgtttcccttggttctgaggtaatagacctccacatgcttgaattgcaaggattaaaggatcatggtactggtaaatttaagaaaccttaaaatgtctcccttggtactccagcactggttatttactcttcacatttcatgaaccaggtagagatgaggtgcagctgagcactggggaaactaactgagttcttgtttctgtgttacaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggcgcatatatatatatatatgtatatatatataatttatataaatatttctctatgtacaaggaatacgagtggctttcatggagggagggaagctgggggccgcaaggcatcaacgctgttggagttgtccaattcagtgctgtcacagtctgagtcctcagaattgggagggccctgtgagaaagagtagaaatggagtgagattccttggggttctttgctggggtcattttaatagccagtggcttactgatttgttttttaagacagagtctcactctcgcccaggctggagtgcagtagcacaatctcggctcactgcaacctctgcctcccaggttcaagcaattcttctgcctcagccttctgagtagctgggactacaggcatgcaccaccacgcccagctaatttttgtacttttaatagagatggggttttaccatattggtcaggctggtcttgaactcctgaccttgtgatccacccgcctcggcctcccaaagttctgggattccaggcgtgagtcaccatgcccagccagcttactggttttattccttccagatttcagttgctcaggccattctccaaggtgtcagactcctttcagaatcattccctggctgcaatttatagctacatgcaagctactggtcaggcatcgtaatagatgctctgtgcaagaggcttctgaaattccaccacgtggatatttgctctttatggtactttctggcctgtgcagctgtctccccaaaagctgttaaaagacaaggcatctgcttacagctctccctgttcaatatctgctttttgctgttgtgccactcacccgctctctgagaagttcctggtgtggaatgggcagggagctgggttcagggccagggatgacctctgaaggaggtgggtccagtgggatttctgagccctgggagcacatgtcatcagaccgctcatctggccgctcatcagtgttggtgctgccaacttcaggtgtgccactgggggaaggttcactagctgtgccttcctccccatctgatggattctctgagctgaaggtagatagtgactggcgcatgttcaggctctgaggccacctacatgttgaagagggggattacagcttggttctgcccctagcagaaaacaagaatgccattaattcttgtaatgccatcacttacctctggcttgatgtcagctctacttcactgtctacctctccttcctcctcttccgatgagatgccacgtttctgcaggagagatggggtggggggggtctgattagaagtggaaagaggtcactaagaatccaggagaagggaacatagttacgaagggtgaagtagggaatggcttaaaattgagcataatgtgggggattagacttggaccccagggaggataaggaaaaagggaaagagcttgggagccttcccatactttacctgacttcgggtgacggcagccctgtacagcagtgcagctggggtcaagtgctgggacccagcccggcttcctccccggcctgaggtcccttcccttccagttcccagaagccccacaccttcaccaggccctactggaggaggtggttcccctttggctcccccaggtgaatctgggctggtggagccaggggctgagccctcacttggtggggtgtcaccccgggccggaggtggtgagccaggatccccagctccgcctgtggccccccggccccgggaccctagtgctgctgacagcaggtctggggacgatgaagacattttgcggagcaggaggtcatgatgaagcccacggagggcgggagggcaggcctcccaggctgagggtccccctcctaggccccctgggcttcctggtcctccaggttcatggggtggcacagctgtacgaagcccaggcaggtccccacagctccccttggcgctggccttgcggtgacgggtcttgccacggcgactccgtcctggtgagggggggcccttaggacacccaggaagccccaccccactcagggctgcatctagtttagggagcaaagactccgtcttgaggatatctggcctggaagaagaggaaaagtaaaaggttaagactgccaaatctatgtactcaaagcactccctaaccttggacactaaagtacacatctccctgctaatatacctgttgccacttcagtatccctcttgccatattggaaccacagtactcatgtcccaccttttgctatggggtgacagcttctgtggcacattcctcttcttgataagcttctccattgtgtttccatgcaggaggccccgggaagggtgtggcttcagcaggcctgggcacctccgctctaaagcttgctctcgcctaaagatccaggcaccttctcagctgggcaaatgaccaggaaggggcaccccagtctcagtaggacctctaaggcaggcacagctccagggcttggtgcataaggacaggtagggttacctgagcagctccctctccttgagttccagctgcaacatgagggcattaagttccatatacaggttgttggctctctccagcttcctttcatagtgctccctgatgtccagggcgtgtctgcaacgggcagaaaggttccccaaggtgaactgggttcacctagggccataacagatctcagtctcagaattcctgtccacagtcctttcgtagtccttccacccgccctggggctgggtaggagctgactgggtgcatagtccttgctgttagtaaaatcacctccccaagcacgggaactcacctgagctcctccctcctcctcatcaccagttcctcttctaggcggtgcagacaggtcccttctgacttaatcttttcaaagtgcagttttacttcttcccgccactctgcctatgggttgagagcagatgaagagtgagagccatcccttcacccagtgaaaggctctgcaggttgcccacaccactgccaatgtgtgtgctggagcaaaaaggagtggattgactcagccctctaagagccaatctcttcagtcccactcaacccatttcccagcctccccctcaaatagcatcatctctgcaaagaaggggagttaggtatttattttcctacccacagcacacctgggacttaaagtaagtctcctggggtgtggagagtacatcagctgaggcaatgtccagatgcagcaggatctgtcggaatgatgggcgatttcgtggtttgctattcctgaaag

SEQ ID NO: 69665 - DNA, 1817 bp, Homo sapiens
aaccccatattttccaacttgtctcccaaaataaaagccttttctgaataacttcattgaaggaaccacattttgggaaatgctcagtgacagattagcaatcgtcaaacttccctgggtctaggttccaaatgagggtctggggtcctttccttctgtgttctaaggttgtttacttgaggctcaaccaaccatgcttggtggttatgctgctccttccttgtacttgtatgcactcactggcacttcatgacaaatcaggaatgcagatatcgttaagtgtattttatagatgaggaaacaggttcagagtagataccaattacccctggtgactcagctcagaaggtagcatgagcctgattcagatgaaagtcagtctctttgaattaaatgtacccctgccatttattggtcagtccagcccagtactaccgtgcttctcaacttctccaggcccagtatcccagcccagaccatccttaccagcactggcgaagcaggatcttgaaaccatctgggcaactggagggcacgggcagatggagactgttgcttcccacaccccagataatggctgaggaatctacgtctttgtaggggatctcaccagtcagcagttcccatagcaccacgccaaaggacctagggatgaggggacatcacttgtgctcaagccctagaagttgcccacaatccccccagggctggccacccactcttctcagttttcagcctagttctcaccagatgtcgaccttctcagacacaggttcattgcggatcacctcaggggccatccaggctactgtccctgcaaaggacatcttggtgctcttgtcactcagctccttggaagtgccaaaatctgagatcttcaccacatcgtcgtaggtgattagcatgctggtaaagagtgtagtcagctggggtccacacccctccacacacctcatctaactctgcagcaactctgcctttcaggtttttttgtttgtttgtttgagacggagtctcactctgtcactcaggctggagtgcagtggctcaatctcggctcactgcaacctccacctcctgggttcaagtgattctcctgcctcagcctcctgagtagctgagactacgggcactcgccaccacgcctgactaatttttttgtatttttattagagacgaggtttcaccatgttggccaggatggtctcgatctcttgaccttgtgatccacccgcctcggcctcccaaagtgttgggattacaggcgtgagccactgcatccggcctgcctttcagtttaaaatcatttgggacactcaaaggtgaggggctcactacagcccttctgagatgggactgtcacttggaagaggtttctgagatggccacatggacctagggcatggtttggaagccgggagaaggccacactgacttgagtgggtcacctgcatgcacatctgttgctccctgcttgcttactcacttgggtgacttgagatccctgtggataatcttgtgcaggtgcaggtagttcatgccaccagcgatgcccatggaccagtcaaccagtaaggagggggtgacagggcggccagcccgcagtacctcatacagctggccctgggcgcagaactccatgaggatgcagtagcagggagcctgggtgcacacacccctgggagccaaacaatggtatgaaggcctcagctggctcagcattcacctgattcatacctggaacccccattcccacccattccacctatggatctcctctggggaaggatggggtaggtcccactgcccaggagggt

SEQ ID NO: 69666 - DNA, 1124 bp, Homo sapiens
ctcgcaccttcttcacagccacctcctccccgtggaagcgccccaggaagacagcaccctgggcccctgagcccacccactgcaggtccaggatttcctcaaaggggacctcccaaaggtctgtgggcaggaggcacagtgccacaagcctcagaaagagccacactcaaggccagggacaggatagcattgggttggctgaattgacttaaggagggtgaggcagaaagccaaaaataggccaagaagaaggttcgaggggacagggaaggaatgaatgggtggccttaaaagaagctgggaagttagaggctgatggatggctaagggactagggctgggccatggggagggaagggaccattgcgtgactttagcggagctgaccaacagatctcgggctcagggaaacagagaggaggctcccacaaggacgtggcctaccttcctgctgctgcttgtgctcagtggagtaggctttgccaatcatggtccagacagggcgcaggcagccaaagaggccctcaaggaagccactgccactctggcactgcagtcgcacctcgtcagctcgaactctggatgcccgactctcaggtgacccagctgctccccctgggccccctgcatcctgctcatgtagctgcaggacactgttggcaaaaggctcagggggcggctctccacctggggaggggctgggccctcccccaccctgcccaccaaggggtaccacatctcgaagtacacactgggtaggcgtcaggtccttctcgggagtgcagtcagaagtgtctgggtccagcttgcgcatggatgcctcacttagggtagacacaaagcccccaaaggaaggagagggtgttcgggtctcatggaggcaagccatcgcctctggcccctggtatgatggtgaacactgggccctgtgggaatgaaggaaggaggggctgggctgttaaagccccaggactgcctgctcaggacacttatcccagaggcacagactggggtgctgggttcacagtagccccgctggaggtaacacttgtggctccgtttcccatggccctccaaattgcaccttgagccatcttaggaaatctgatacacttgggcttcct

SEQ ID NO: 69667 - DNA, 1293 bp, Homo sapiens
cagcctgcacctccacttggaacccagccaatggatgctagactgtctggggttccttggaccctatgtcccccataatgtgcctaggtctggtatggaagtgcttggctaggtgggtgcagagaggggaggtgtgatgtgggtctgtgccccttcccccagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtgaggaaggcttgggcagcctggctggggtgtgcatttgcaggtccccatggctttgtttcttggagtctctctcttcacagtccttttctccaaggccagtgagggaaggagagatttcaggggaaaagctactgactggattgggagaacagggctgtaagaaggtgggtaggacgtgggagagttagaggagcgagcaggactcccacagtgatctggcagatccccatcaccctagaggaaaagtaagagaagataactgaaatcccagtggagtatttgggggagtgagtgcctggcgtgctgggctctgttcccggtgcttaaccaaattcccgtttaattttaaacctcagtctaaccaatgattgtaggtggtagtatccgcccccccgactcctccccccgcccgcccatgttgaatatgaggaaactgagtgtttgagatagtaaatggctggtgcatggtcacatgcctagtatgtggcagagtggggcttttactccagagcctaccctctcttattccagctctctgtatttattgagggaaaagaaagtgctttgcaaaggaaattaaagcatttgcgctcagaagtccacccaaggcgtttgagctcagaagtcctgcttggcatggcttaattctggaagctaacggaaagataagggctcttccttccagcaattagtgaaacacttccagtcttcagcagggggaggttggtcagaaggggcttgattgattccctctggctacgaggagagaggctgtgggatgctggtttctttcccgtcctttcagtgacctccagtattgcccatgccccctctctcaggtcagggccccagcaagaaggcagccaagcacaaggcagctgaggtggccctcaaacacctcaaaggggggagcatgctggagccggccctggaggacagcaggtgagggaggaaccga

SEQ ID NO: 69668 - DNA, 1154 bp, Homo sapiens
gcaaaggatccgaggaggaagctgttggttgagcctccctgattctttggctcaatttggaagttctcttaggggattgggaggtcaggaggacgtgggtcccccacccctctcttccccctatacatgggtgtgaatcaaaggcccccttcccctcgggaagttctttttctcccctagactcttcactgcctgaggacattccggtttttactgctgcagcagctgctaccccagttccatctgtagtcctaaccaggtatctgtgtcccctgactgcctgaggtgggtggaggaaggggttctggtttttggtccctcagtccttggacccaagctggtcaggcatgaggaagtctgagaataaacagaatggaatagttgggaaccagaacttgaagaaatcacagcagctggtaagctcttgggacaagaggtcatttgtgattttcagacagccttatgaatgatgtccgaccatgtttaagggtcttgcaggccccattttcttctgggttgaccacatgtcagttctgtgtttgaggcccatcaggcacttctgggactggaaatacagctcttctcccactgtcctggcttagatgatacccaagtgttccagaatggaaatgggctggggcctggagaaggcctcccttgagtgggagggggaaggaagccggctagagcaggaggagcaggctagatgtgtggacagacagctccccacccggtggaatcgggagatggtagtcaggaatctaaagtagtggttaggtttggagctcatgggcaggctcagatggaacccttcacctcaactttggccctgtgccttttccttcaggagcccccccatggaactgcagccccctgtctcccctcagcagtctgagtgcaaccccgttggtgctctgcaggtgtgtcccatcctcatttcccatgcatgcctgtcttcccttgagccaggggccatgagggaaggctatgtgtgtttgggggtgggggcggttccttgtactgaggccctttccacccccctctctccttcctctcacctagagtctgaggctcctgcgtggggaccagcgtgggtgtgagaagccttttttcactcagcctcatgcaccctgtgtctcccttccaaggagctg

SEQ ID NO: 69669 - DNA, 1124 bp, Homo sapiens
ttgcccaggctggagtgcagtggcgcgatctcggctcactgcaacctctggctcctgggttcaagtgattctcctgcctcagcctcccaagtagctgggactacaggcgtcaaccaccatgcccagcctgtatcttttttttttttaattaaaaaccattttttttttggccgggtgcagtgcctcacacctgtaaccccagcactttgggagaccaaggcgggtggatcacctgagggcaggagttcgagaccagcctggccaacatggtgaaaccctgtctactaaaaatacgaaaattagctgggcgtggtggtaggcacctgtaatcccagctactcaggaggctgaggcaggagaatcgcttgaatcggggaggcagaggttgcagtgagctgagatggcaccactacactccagccttggcaaaaagagaaactctgtctcaaaaaaaaaaaattattaagatatagagggaggctacaggattttggagcccactgaatgagtgtggcttccaatctttgcagacagacccccatcctcactagagagcactgcttccgacctgcctcatcgcccttcctatagtcactctccacagctgaagcactgctgccaccctgtggtcacagctcctcattgccagctccggccatttccttttcctagaatagacctctgcagaggaagtgaggagggtgaggctgagtggaggtgctagggtccagtctccagggagtcccagaaggacaggagcaggctactgtggggctggactatcattctgaccccgactctggtctccacagcctctgcctggccctggctctcatatagagtagcctagaatcctgtcttaagaaaaatcagaatcactaatcctcagggagaggccttcaaagccatatggtgcaggttccttctaatcctcgagtcccttttggagcatccccaccagtgtgggtctctagcttgtgctgaggaagagccatgacgtaaaggccttggcctctgcttgagcaagctgtctcccgctctgagcttcagtttcctcacctgaaacatgggcccattttacaaggaacgccttcctagggtgtgcattacttaacatacttttt

SEQ ID NO: 69670 - DNA, 1734 bp, Homo sapiens
tcacatatgccttgttgatatgctctttctgctttctttagacttaatgtttgacgggggtgggggtgtctggaagaacaggaaaggtggggatcctaaggcagattaaaggactccctccaccccactacagcctcccataactctagtcatccctctcatagtacaggactgatttctctgtgtctgtttgtacacacaaatgtgcatacagacataaattcccccaccccataccaaggtggttacctagcaggaatgagcgtaggtggctgctggccaccattaccaccgtctgcatcagctgtgttgtctctctttggggtaaagtcctaccccagaatgagaaaaggctggggagagtagggcaggttaaaggagcttatgtcctctgtagatgtaggtttgtatcatagctactagggtttatttttttaatggggggctaatagcacagagttatctcaccagcagtagctactggtgagtgatgttttagctgtaagaagtggctatgagcaatagtttcactgactttaccttagggcagtgccacagtaatctgggaacttgttagaaatacacattctcaggccccatcccagacttattgaatcacagactctgggggcagggtttaaaagcactccaagtgattctaatgcacactaaaggttgagaaccatttcttagggataagctgggaaatttttacaggtgtggaggatatttcaaatacatcttttgcctttgcactaacatgctttcatttctttcagtctcttcctccattccctttaaagtcttccccatcatatcactgatctcaaaagctagatttgtcttcattttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtgaaccactgttatgtctgatgcttcactcctctatccacagcccccattgtccccttttctgggaggtcactggcctttcatgtctgtcatcttcatcactcccccatttcttaggacagaaggaacagggatttttgtctctagtttttatacatgggagatacagcctagagaaagtggatgatttctataaattacaaagtatgacagaaggcccagggcagagctcctgtggactgccttggag

SEQ ID NO: 69671 - DNA, 1539 bp, Homo sapiens
tgtctctcttctgtaactacttcagactcagccctcctggaggctgtcatgtaggggactctcgagttcctttgttctaccccatctctccccctcacacatctgtctgcttttctgagctagagtcttctgttcacaagtgcccatcaccgtctggactatcttctttctctttcaccaggttcctagcttagccactaggtcttccaggtcctccagagtttcttcaacccatttcttctctcttctctttacatgcagtgctccaggatcttgaagcgtcatagccaagatgctgagtgggtttacttgagtataagattgaaaggagggaggaagaggagagggaaagtgcagaactggtcccagcaaaggaccccaggttctggcctgggaaattggtgactattgctctcaaccattcttactttgaagagttgggttgcagagggagcaattcatctctcttgtccctcttccacgttaaggcttctcatctccccttggctctgaactatgcagtttctaccaggaccataggaagcaattcagagccagaggcctgtggatagataggtcagctttaattgcctttccgtatgaaacccttccagttgtcccagagccactttctgccatctgtgcaagccaagaatgtccttctctccatctttcctacctccatcttaaacatacatacaaaataactgccagcttcctttcttattttgtctccaaaattgactgtcacaggggaatgagaaaatgttctaagctacaagattcccgtttccttaaagtgatatcctgtcctagtgaaccagtcaggtaacaggttctgctgcatttgttttaaatttcccctcctgcttttcagagctggtgctgaacaggccacacccctaaagacaaaggagagaaaacacggttttctcatcctctaccatcaggtacccaacaggaataggccctgaagtgattcagactagcaaatgttatggcagatggtcaggacgcaggttaccacatccagggacttcacttttgcctttaaaaattcacagccgtaacttgtgctcaggacttcccctttagctggctgctccctgggattttctcctgctttagagttttgtttcatttttttattgtcttgatttcccagtagcagccttgccctaaagcttgactgagtttatggctcctaaggagctttcctaagactcttgactatttttcttcccccttcagtcaagtgtttttacagttaagaattaatttgtaactgcatacatgccctgccagtctgtccctgtgttgggtggctaatttatgtagcgggtcttttttatttcttagcccccatgactaattatctagtcctaacttcatttttatcagtgggaagatgtgtacgggacctcagtgaggagcactgccagaaccacagtaacaaaatggcactgaaataaggaagcagcaggtcagaaccccctagatagttcttgagttggttctcagtctcactaaggaggcaga

SEQ ID NO: 69672 - DNA, 1037 bp, Homo sapiens
ttcagatttggccatcatgtgacctaactcagctttgcaaaatgacgactttgatccaacttcccctttcccaaggcaagccagtggtaggaatgtttaattgttctaaaccctttaataggattagcttcctactatttgagtttgcttaatttgcaaagtataaagattttgccatttttctccatctataaggtaagttgaataggattccctgccttctcaccttcatgagggtgtcaagatttttaccatgctgccctataccttccctaactagagaagactggaaaatcttctgtaattataagaggaagatccatggacaaaaggtctgtgttatgagcatttcacttcatgtctcctctaggtctcccactggctccctccctcttgtcatgcatcttgctaatggacagaccatgcctgtgttgccagggcctccagtacagatgccgtctgttatatcggtgagctctgtagttggggcagccaaccctaccaacatggtaatccttcccttccacctgaatggtcataaaatacacatgagccccagggaaatgtgggctctgatctatattagctgagcatggcagcctgcctaaactcttcactaacctctgccaatccagcactatggaacactagataaagactcatctggacaattggctcctggtctaggaattgatcttgccagcccactgattagttgctttcacttggcacgtagcacctcccaaattgcccaacaatttcctcaagataacagccccaacccttcccacagaaattgccccaacactgaaggattaaattccctactctggtgctccatggagaaaggtatttcccaggctgtccctgcacgccctatgggcacattgcacacaacaggccctgatgtgccaatctcaaaagcgcttcattttagggaaactgttgccccaccgatggtattatgttcccttctctttttttttttttccttctctcgatccagctggccagacctgtgtccatggtgcccaaca

SEQ ID NO: 69673 - DNA, 1050 bp, Homo sapiens
gttaaatggttctcctaatcctgcataatttatctccctgttagcgccctcataaaagagtccaattcagccctaccatggagggcttcattctcaatttcctatttttgtgatggccaactagtgcccagcccttcccttctctattattattattaaaaattgcttccccttgttcaatacgagtttgccttaatgtttttttcatttggagcctcctacttggaccccactttaccaacaatctgtccacttctgttgtttggacctgatattacagagcagttggtgttgtggtcttccccatctcctcttctccctgcgttctagcacccttttttctccatctcttctcctcttccagttttttctccctctccagttcttctttccagggaccaatctcattgcaagatgtttggtaggacattttaaaagggcaccgaatcgggtttttgtttttgttttttcatatctccatttctgtttcgtttcagagatttacaaacgaggaccacctggcagttcataaacacaagcatgagatgacattgaaatttggcccagcccgaactgactcagtcatcattgcaggtatttgctgccccaaaagccacgtgccttgataccaccaggcagttaagattaataccagagaccagatgtactgggagctgtactccctttctcccattaagagcccttatgtgatctgcatttaatcaggaaaaaggaacactaaaagctcccaagtttctcttgtaccctccactctatttttaataacaaggttgtgttctgtggtttttgaaggtaggtgtgttgaggtttcgtcttagttttttttcggtctattaccgtctttctttctatttattaagactttgaaagatttacagacaaaagatccctttgacatttttgcctacccacagcaaaggggtgaacaaaagaatgcaaaaaaaagccaatctagcctggttgcttctcttccactgggtgtcagctttcctccagcaggcagattgtcagttcataaattcaacttcc

SEQ ID NO: 69674 - DNA, 1062 bp, Homo sapiens
tgaggtcaggagttcaagaccaccctgaccaatatggtgaaaccccatctctactaaaaatacaaaaattagccgggcatggtggcatgcgcctgtagtcccagctactcaggaggctgagacaggagaattgcttgaacatgggcagcagaggttgcagtgagcggagattgcgccactgcactccagcctgggcgacagagcaagactccgtctcaaagataaataaataaataaaaataaaacatttttgtatagaaatgggtttttgccagattacccagtctggtcttgaactcctggcctcaagcaatctgtccacctcagcctcccaaagtgctgcaattacaggcatgagccatcgcgaccagcctgggattttggatcttaaattggctttagttgtaaattcaggtaaaataaagtagtagaaacagtttggtattgctttcctgacaggtaggagctggatggggccaactcccgtgtattttgtttgcagtcaagaagagctttggaaaagaaggctaaacgtatagtatttggtgagaagtatacacgtgatgaagaaagtaaaaagagacgactaaccaatcaccatttttagaagcaaaaagacaaacggaaccatgtttcagagcctcagtgtgaaggagctgtggaaaactgcagcatccgggctgttactgtgttgcagtcatgttttaatgaaggaatatggccaggagcctcaaagggacttttgagaatattattcttttgaattactgctgttcatctgttcccttcactctcccccttttaagaaggggtaggagcataaattattgtccagtaaccctattttacttaatcataaactggatagagttagcccacttttcttcattgtcctttcacccaaatcccaaaaaaataaaatctctataccatctccctttctcttccctcatcctgcctacaggctcctccctacccctaaaaaaatattttttcctggcatttttattctaccattatatagtcatcagcattgtactggcctttttatggctgatggag

SEQ ID NO: 69675 - DNA, 1587 bp, Homo sapiens
gcatgtgccaccatgcctggctactctttaaattttttaagagacaggatttcaatatatattgcccaggcttgtctcaaattcctcaggtgatcctcctgcctcagcctcccaagtagctgggattaccagcatgagccacagtgcttagctgcaatttcattctttgcccctacctgcctgcctgccttctttgagtgtagacctctagtctgtggccagcattctaaaaaatatcacttatggttagaaagtaaacatccaaaattgaagttttccatttgcctgactttgtaaaactaaagatagcttatcagagctttcctggttagacacaaagataatcagatgaatatgtcaacaaattatggtaagaattttttgctgcattaaattaagatagcagggcagaattagagcacttgaccagtttatggtttatatagaagacctgccaaactatttgagcctttatcgttgcctatttctttaccaggctgcaacctcttctgtggtttccgagtccctgggcctgtaagctttgatagcttgtttaaaacaaaagcttaatactgtattttggtattattttaaagtgagggaaggagagagagagaaagagagagagagagtgtgtgtgcgtaatctccttgtaaacttgaaccaagtttagagacggttttagagacgagtgcatgtgagcacgctcattggttctctccccctcctcaccttccagttatatattttcttttggcttgactgttacagtactaaactgcataaggccttaaagatcagggcagggtttttgttattgtggtctcagtactgacttgtatgtgctctactctgaatgcattgtaagcattcaaaattttaaaactcctgtattatcaggaagtatttacagtatagtttttccacagtgaaattttcagcagctcaagccaaaccacaatgtagtaggttcatacttttcactctgtaactttgtccttcccacccatttgtgagatccagaaattgtaacacttaatgtgtagcaaattagaagataaaagtatttgatacgtttttcaaggattttgtacctcataacatcctaataagaatttggggagagagatgagattgaaaaatagaaatgtataatgtcaacaagaacttaatagggctgtgtgataattattttgattttaaaataaccttttcttgctttgttaagaactacagttatccctttggggactttaatggtaccccagctaagtggctacatctggataggagaatactaaaaggtctaccattaggcaagagctgtggagaaagcaattagccatgtaactgacataggaccaggcctggctgaattgctgctgggatttctctgcctcctaggcactggtcctttaaagtttgttgagcatttaacccatccaagtaagtagctgccatctaaggaaagataatggatctatccttgttaattcttaagcgtagttcccaagagtgccctggagtttgataaaaagccaaacactgggtattgaggaagaggggcagcgagaaataagaaaacat

SEQ ID NO: 69676 - DNA, 1202 bp, Homo sapiens
ccttgccaacagtctcgtagtttatacaccagggagccagattatggccctgtaaaatggagcacccctcctataatcccttaattaattaaatgacaaattttggtcttctctcgttcagaaatatggcttccgcatcgagcgttcagtgaatttattgacataaggaactgcactagttgtaattcaacagactggagaagtgtgttatatactgtagtagaaagagggaaaatctagcaaaggtttgaaattccttgactatttagatctcattctttctaattaaaagtttcagttgagacacagtagatcatatgccacctgtctaatgggtctccccaaagtagcctgtgtttacaactttgatagatggcattcgtggaacacctgtttctagggttgatatttttgaagcactttttttttttttttgctccagcatatttaacataactttttccctcacctccccctcctcagctcctctctgctatatgaaatatgggagacgacagaccgtttgtgtgcaatgccccgggctgtggacaggtacgtttacaatatactttattgtgaatgtctcgttgtgaatcaaagtggctgttttatcactaaggcaaagagtttaaagccagtattttacgtgatcactggaggtaatcagatcagaggatttgcagtgtgtaaatccaagttatgaggaagtgtaggcactctaccgtaatgaaatctgccttgctgtcttccatattgttattctactggtgtttgtttcccaccacacagtatggaaaaatacatgttgctgtctcctcctttctaaagctgtccatctaaatacaaagcaagtttagaaatgttttctcttcatgccgggcgcggtggctcacgcctgtgatcccagcactttgggaggccgagatgggcagatcacctgaggtcaggagttggagaccagcctggccaaaaccccatctctactaaaaatacaaaattagctgggtgtggtggcacatgcctgtaatcccagctactcaggaggctgaggcaggagaatggcttgagcccaagaggtggaggttccagtgagccgaaattgtgcgactgcactccagcctgggtgacaagagcgaaactccgtctcaaaaaaaaaaaaagaaagaaagaaatgttttctcttcaacctgcatggatataaa

SEQ ID NO: 69677 - DNA, 1003 bp, Homo sapiens
ctaatcttaacatcttctagatttttatgactctttgatacttacagtgcattatccttctaatttttttgtacctagcagtatctgctttttgtcattaggaacctgataacaggcccctggatgtgtttgtatgtggcttttattccttgcttagagttgggccatcttattaacatcagttggttactagagaaaagatcacatcacaccatatctgcattcttttttcttattaaattatattgtaatggtaatatcacacgaggtttagagaatttactttgtagtcctcagtgacagactccatgcttagtctattaaaatatatagatatagacatatatctagatatacataaataatctgttttcttacacagtgaccattttaggatctacctctgagattttatgaaattatctcagttattaaaaatcattctctaaatcttgggttttcttcagttctctcccagcatttacgtaactttctcttttgagtaagtattaagtttttttaatcatttaaaaaattctggtgactgagtacctgagccttttctgcagatgttggcctctaggacagcttttttatgcatctttgtcttccctgttctaagatgtttgctgaaagcatcccacttctccttgtcagtgcttcttaatgtgtgtatccctcttctgtcatttattgtttagttctataaaatgcttatgtttcatcctgaagaataggttgggaaggagatgacacactgagtgccatgcccagacacatgatctgcttgtcaagcagtatggttataaatgagctgtgagttaaattctagtgagtggcagcattgtttttcaagatttccctttatgtctcagtctgtttacactacagaaatgtgttgctttttgtttttgagatggcatcagtgagacctcactgataattaaagatttgttttaagtgttagatagaaatcagcaaaatgacattctttatatgtagc

SEQ ID NO: 69678 - DNA, 1023 bp, Homo sapiens
gaatcacttgaacccaggaggcagaggttgcagtgagctgagattgtgccactgcgctccagcctggtgatagaacaagactctgtctcaaaaaaaaaaaaaaaaaaagaaagaagtctgagtttaaaaaaagaggtccatatctgcctattctaaagcactaaacagtatatttaaaaattatacaaaactactcattttctaactacaaagaaacagaaccaagtgacaaattaagttcaaaaaggaccataaaaaattctaaagttataaaccgtttcatatagaaacaaacacggtggaaactcgtttataaacacacaaggtaaaacaggcaattcaaaatagctcctccttttgttaccttccaggacccattttgaatgcttcctaacaacaattatgcttatatcagacaatcagaaattgccccaaccatgcatcacaaagggaatatagagctgaaaccaagtttagcaggtaccgaatacctttcagctcagtacaaactagctgaaaaacttagaaaggtacccaaacagagctctatgggctctatttctttatgataataaaaaaattatatgcaaacagctctcttttaaacacacaacttcagttaccacgtttcagactctaagataatttagctgccattaagcaaagagtacaaatacgagatcttcgccacagcagtctcaacattttatattctccctaggatactcagtgctgctctgatttccattacatctagcaaagtgacttaagattccagttaacacatgaactgtgagactataatgcaggttatgggaaccccagaaaacaaagtagactactcaagttttactaggcagtagattatttaggtattaaaatttctcttcataggccaggtgccatggctcacacctgtaatcccaacactttaggaggctgaggtcagaggacagcttgaggtccggagttcaagaccagtctagccaacaaagcaagagcctgtttcttttctttctcttt

SEQ ID NO: 69679 - DNA, 2403 bp, Homo sapiens
caggctggggtctcccctcccagtctgtgttggacgggggcgctgaggcggtggccgggccctgtctgaggaagagggtggggcataggccaaagccgaccaatgggagagaaggaagcctcgattggcggcgatgagcgctaatgggagatcgcttttacgttgccgagcgccgcccttctctccctactcccgcctccttcctttggggggaaggcggggccagaggcttgaagtgtggggagaacttggtgtaagtagccccggggggcacagggcgtggcaaggagaggggaattgaatcctgagggaagggtagtctagtggagcctaatggaaggatcatgggatggggtggaatgggagaaagaggagggatactaaactaagttagaaacccagggcttcccaaagagtgggattaggagcttggaattggaaaagggtaataggaaggaggtaggaatgagtagatgagaacaaagatcttgatctggtgacacaacaccccgttgggtttggcagaaaagatagatggggtggattattggaaatgagggtcatggcattttgattgaattaattaaaagaacatcagggacatgatatcagagagaaagtatggatttggagaaaattaagtgaattaatttaagaggacagtatgggtgagctgagtcgccataaggcatggcttctggaaggatatgagccttgagagcgataagaggtgtttgggaaggagatggctgatatacacatgtctttagcctaggtatcaggtggttgggatattgatttagggcttctggtggatatggcacccagactggtgaccagcctccaagatgctgggatgggggttgagaaggagaaaaatagaacgctttcatcgcttctctgattttccttctccctctcttctattacccaaactcttcccagacaccaggatgtggtcttgggacttaagcagtccaagttggagccccatagggacttaatatgttgctctgaattgcttgttatgttctctgactggggtgtttacaacccagggcacctcctacccagattcccgcgttgctactttcctaactttaaaagtttgttttctgcttaacagagggtgttttagtatctctgagggtcatgtcatattaagtacaggtgtgtagggggtgtgcagagttttctcagcaagctcacatgagtcctgtgtttaaaaattttgcagtagtgtaattcttgtagcgatatcagtctttatgggcattctaagcagaaatatactaaaatgaagtttgttttgttaaatgtggcttccccagtcattctcgaagagttgtcgaatgggtggttgcagtttgttttagttaacttacataatgtgtttttaaatagtgtaaataaaatagacatgttatttcaggaaagtgaaaaatgttcagttttttcctttgtgtccagactcagaaactaaagctatgtcataatatcttaggccaagggctggggaaatcaaacacaatttgtacttacacatggaagttgtaaggtaagtggaggctcttgcgaaatgtaacatgtctgtaagaaaagaagctaaagaaaagtttgcaagctctgctaagtagtcttaccagttcttaattctgtacagaaaagggacagggctttgccctttgtttgatagttgtgtatcatttaataacgaattggactaatatagccaattaataacttctttgctcttgcgtagattttgcttttacattccttctcttctccttttacttttgagaagggaaataatgtctgaaatatcagtaaagctattacatgaagagaaaccagagtacgtagttgtattaacctttggttttctgcaatcagctgaagcctttctccctggccaagaagttgcccctatagcacattgagaccaattcattgctgacccgttagcattaactactgagctgggttctagtatttcacagtaagtgcattgctattggacattcagaacatttccagtttgcctggcagcagtacagaaaattacccagtgagagagcagagtcccttgttttggtcttctgccctagaattggtgattgctttgactagggcactattaaacccaagattttttttttctcactagtgctaccatctagcagaaagctagagtgataacactgctcatctttcaacttgtggatcaaagtttacaccctgtggtagtttcagtgttgtaatttttaaacacgtttgtttaccacggttttaaaatgttaatagctctacttactgtatcttgttctctttcctttcctcatttccaacccaaaatgaaaattgttttttcaaccaactcttaaactacttctttgcctg

SEQ ID NO: 69680 - DNA, 1209 bp, Homo sapiens
tggtctcgaactcctgacctcaagcaatctactcatctcggcctcccaaagtgctgggattacaggcgtgagccaccgcgcctggcctaatttttgtatttttagtagagacggggtttcaccatgttggccaggctggtctccaacttctggcttcaagtgatccgcctgctttggcctcccaaagtgctgggattacaggtgtgagccaccgcacccagcccatttgtagtttcttaaagccccagatcttctgactatttgaaatgagagaacataatctgtccctcttactcttgtcttctagaagagcggtgttccataaatccttaggattctgaggttatgccccagagactgtcttagagaataaaggggagaccaagccgttaaaatttccccactacttttgtaccattgcagtttggcttttagatgtttactatattggagttctgcttaaagtttgaaaacactgctctagatagacccttccatcctatttgggccctggatattaagtgtctgggccaagaggtcttaatttgtggtaatgagatgggtgaaccattagtgaaggtcatgattatacctgggccatgttacaggattttagattgcctgctcccccttcattcagttcctgtagagcctttggggaatcagggcaagaatttgggcatgatggtgttaccctaaaagcttctttattatgtgagataatcttgaagagggggattctccctgagcccatcttagatatttatccttttctttgtgtgaactagaaattcagtcttttctcttctccttctaccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagatgtttcttgagtctcctgtgtatatttcttttccacagttggctgagtgccttcgtgagagtacaaggcccgaagggtagtgatggtgctaaactcaacatggatttggctgagctcactttttcttaat

SEQ ID NO: 69681 - DNA, 1235 bp, Homo sapiens
ccccaggctctcccctcctatctctgctttctcttctcatcctgacttgtgccttctttattctgaaatctccagactttaggccccagaacctcaggtgctccgagcaatggagatagtggatcgtctaaagtcaccaatccctctagtcagcacccctcaatttaaaaagtaaaccttgaacatggtagaagtgggaaaaaaagccaaaacatcgcctcccgttaggttgtggcttgggatagctaaggcagaagagagaggctggttgctttggaatcactagttatttaccagtacctttctcgcatcccggcacgctggtgaagttgtaaaagtcacaaatggtgggctagagatgagggtttctgttgaggcagcaggcccagaaaggtggggtaaggccaagctagtggggccagcatgagaccctgcctgccagctttcctgtgaaggattaattaacctccccagattctgctgttacaaggaaaagaaggtttaaggaaaggaatagttaagttactacccctgtgactcatctacactgaggaaaaagcccgtgatgattttggagtcctgattctggatagtgcctttgcccaagttgtaggctaacaattgcagagttgccatggttagatagccaatggtgggatcacttaattgccaccccttgttgtgggtttattatatgccagcaccacattaaactctttatgtatgttaatttgtaaatgaacatacttaatccccctaagagctgcattttacaaagaagataataaggtataattcccttagaaaagaaccaccccttctttttctaaaagccttaaagaactattggattttgacccaagaaaacctgaatagtacggcagcaaaattgggttagagttacatataggcaaaaatcagagttctagataggacaagagttgaagacatccattaacttaaaagtaattaaggctgggtgtggtggctcacacctgtaatcccaacactgggaggccaaggtgggaagatcttttgatgccaggagttccacaatagcctgggcaaaaaataaattaagagcaattaagatgttggattcagaagtgttttaacctgggacaatctgagttcagttcatttaatgaagtggtatttaatagccctaagcattcactgagtatttcagcctgtgacatattagaaagcatgtaacttaaaagatccaagttcaa

SEQ ID NO: 69682 - DNA, 1015 bp, Homo sapiens
taaacatctcaaagattcctaggacacaaaacaaaacaaaacaaaacaaaacaaaactccactaaaaataaatacttttttgatcacagcctcctagagaaaaatatctttgaaataaaaaaagtatatcccaattgagatttaatacacttgcaaattatggcatggaaatggatataaaacctagcatgcctcagcagctatgtgctcccacaatccccgtgtggaaatagaattgggctgatgtatctcagtgagtgcagaggtacagacaagaggcagacgaataagaaattatcttcagacactctccatctttctacccactcagagatcttttagaagtagtgagatttcaagataactctgtctgtgcaattgtggtttgttcggcaacatgtaggcataaacactgctgtctctctacagtgcctctggctctgagaatcctcatctgtggtagtctgggctggtgtgggagatggaggcaattgttcagcaagatccagataattagggccaagatgtgtcgtggcttcttccttctcccaattatacagactcttgctttattgctctggtttttttttttttctccctacggtgagtgtagactttttttttttttttttttttttttttttttttttttgagagagagagagaagcagaaattccaggagagaatcagaaagggagaaaaagagagatggggtttaggagagagaaagagggagaaagaaacagtgggctatttggaccacactagaagtctttactgacaagcctttggatttgggttgggaagagtagcaagctggatttctagctggacaaggcactcttcagagcccagagcttgcctgtgggggggcgggtggtcaagggtgggtgggctgtggggagctgaacagaggggccccgaagcccaaaaagaaagccatggctgagcattgagatgatttttatttactcctcaaaggtgtctattaggtttccaggcatgaagtcattc

SEQ ID NO: 69683 - DNA, 1065 bp, Homo sapiens
gaccaggccgggcagctaggcaagcaggggcggggaaggggaaccggccaagcagggcaagggacaggcaccgagctgcgagcttcgaactgctccgggcagggcggcgcccgcggggacacatttctgtcggagtgagcagctacggtttgggatatgaaatcgcccggggagcggtggaattcaaagaatctgcgtttctctctgccgcgtcctgcagaggagagaggggagggagaggaaaaaaagggagaatcttctctgcttcgatctgcttttgcagctttggcttattctcaggctttctctgatatttaactttcacctaaatgggtttctttctcattctctccgaatctctgtctccaattttctttcaatcttctggtattttttcgtatttagacgtttactgaactatttatccaaccctgtattacttaagccatgcattggttagaagctcgaaataatcacatggaaattcgagtgttttttctattagaccccaaaaggatacatctggtttgggggagttttattttgtctttctttttaatccgcttggctgtgttctgtggacctagttgagatcggattgtggttttgcagatgttgattatctcaccaatggccagcattgcttctcggccttctctggagggagcttctgagtttgcaccataaatataatttcaccccccaataagataattcttcaagggttttttccctcaatcctagccccctcaggaggcaacctactgcgggcctctgcactgctatctgatggtcccaggggcaggcttggccggttctggggtgcagttgtctcctccgcagtgagaattaggcccctctcagcccagtcaagccctgttaggggtccaaagcttcccactgcaaagactccaggaggcccccagaagctcctcagttccccggaaatgacagcagaagagtagttcgcccccagattttcaggagcaggcaggcaggtccatgtggagctaggcacctccttttgctgcattctctacctcccttccgcatccttcctctagc

SEQ ID NO: 69684 - DNA, 1036 bp, Homo sapiens
cagaggcaaaggcaaacacatacacacagctgagcccagcacagcactgggcccaccccactctccctagtgcactcgcaagcaggcagcctcataatccccacatggcccagcagaatggagataaaatcacatgcctccatcccccgctgggtatctgacacctgacaattccccatccacacatacttgcttcacccatgtacaagttcccccaaattaccaccattccagctgtctgcagtctcctgtggtcttcccctgggcatgaagcactccccaccttgactggtcacccactgtaccccctttatgcagcccttcctgtgacctctgggctctagggtgctggatttgagctctaccactccagactaacctgattcccaatctaataatgaagagggaccagaacactctaaaaggagtgaggggacaaagatatgcaatattctctttccatttgctttaaacttgacttctgtgaggttctctgtcaatctgtgtcttgttctctgtgtctgtcgctggtacctagtgtagtccctgtggatagttgcccttcccctagctgcctccccagctctctgtagtgtaattctcctattccaacgtctgtctttagcacgttttccctttatatagtccttgtacagagttgcttcatcatattaatattgataataataataattaaaacatgaattatgattatgtgattttttgaaaacaaaagttctaccccaaaataatgggagtcccagcctcttagctgttctccactttattttctccagctcaggtgaataataaaaataataaatgtgtaataataatgaaggaagagtggttgcaggggcaacaaaaatacataagcaaccaagatctgttgatgagctaccatctccagtcccaagcaattatagcagagagaaaattggggggtggcagacttgggggaggagagggagctttgagaagtcatggggccataaaaataatgtggacagcctaaaggaggttgaaaccagcttca

SEQ ID NO: 69685 - DNA, 1049 bp, Homo sapiens
ccgtcttgccctctgccacgtttgttccgggaactgccgccttgctcccttgcctgcatttctctgcgtggttcgctttcaccttcgtctggcgctctcttccctcctctggctctctctctagcttcgtggttgctttttctaccaggtcggtactggcttaggccccaacgagcttgtgaaaaaaaaatacaaatgccccctggttatctcttgccagagtgaacacccccagataagccagacccaatgaaaataaagttaaaaaaaaaacaacaaaccttgggtgtaattgctggtttaggttgcagcacttctctcgccaatgtgcatacttaacggagagatattgatattaaagggcaggagggaattaattttacttttatagtcatctattaagagcagaagatgatctgagtctcctttaaagggactcaaaaaagggggaagggaaagagaaagaaagggagggggaagggagaaatatgactgaaggggaacaaagatctttgcctgaagaaacaatgtaacactagacagaactataaagtctgggaatgtaagaacgcaggactctctcagcttcccccatttggaattctgtcccctgcacttcctgctgaaatcctgaccctgactacacagtggtattccaggaagaattcatgcaattattcggataattgtagagggagagagagaaagtatttctcttttattgtctgaccctctctgatgtctgtgcagaggaggaggggccaggggtgtatgggatgtagaggaaaaggagacagtagggtctcccaacatcaccctaagccctacaaaatggctattcctaaatcaaggaggccctaggcaggagcttatagattttggaacatactcaagaacgcacaagagatcgagtttgaatgcccctgatttagtttcattttccaggatatttgcttggctttactttgtcagcatagacctgcctcctctagtattgtaatcattacaagtaaggggataatagataattacaggggtatcaataatat

SEQ ID NO: 69686 - DNA, 1140 bp, Homo sapiens
ggaggaaggatcccgaactgagatccttgatccttttcctccagggtagcactggggatgaacagagagaaagaaggagaggaaaataattggtgtggggatatctgcggaggacttacctttttcctggacctcacagctcgttttcgcctcctctgggctcatggagacattttaaggcctaatcattgctttttaaattgaaattctaatggcaagggaagggaaggatgcacagaaaacaatgatggggaattctggttcaatctgatgctccaaaagcctctaattgttgtcacctccaccctcctcaactggaaaaatggcctctgggatctgcccccacctcccactttacctttctgattgagagcacctccgggatattagggacctgagggtctaagtcccgggtgggagccgccaggagcaggggtgttggtctgtggaactcccaggcctcagtgcctggtgctctcttaccctgtgttttcatcataaaaaacaaaggaagaggatttgattatttctggtgatgttaaatgatcctggctttcaaagcagctctgaccccaagatctaaggtgataagtgtctctgccatagacgtttaatctgggcaaagtgccacttatgttacaaaatgcctgggctcaacgggctggaggggtagccgggaagccccagggagggaacagcaggctctctttggcagtatctagagttcggtggatagtattttaaacagttgaaatggactggggaggccctttcttatgtcccctcagtctgggaaggggagctccagttagtgaggtggtttatgagctggacgcttccccctagtgtgggaaagatagagatagccagacctcaccctacaaaaatgtgcttcatgtctgtgacataaaattggcaggcactttggagatttagggacttgcagagagtggggcagggccagacaacctggtgaaagcagaggctgaggtgtgattcagggtgggtgggggtatctgagggagtaagcctgggaaggtatcacccaaaaccatttcctgagagaagccaaatacacacaatgcactccaatattgaaaaacaccagatgatctgcttggaagggatataaacaggcca

SEQ ID NO: 69687 - DNA, 1034 bp, Homo sapiens
cagagaatttcaggtgaaggccaggactcaaagcagatggaggggtcacaggcacccaccagataagatacaaataagccacctggagcgggcttgacaaggaagggattgggggccagggatggctcctgtacagggaggtattgatgctgtggccagaatccacaggctgagagggtgcagcctagggcaaacatctcagctgaagcgtccaggtagcctggacccagggctgggcagggaggctactccagaccatgggcatttttgccagtaaatgtctagctgacctcagtggccagggccttctttccttgaccgtagcagcaactgacagttgctagaggttttttgatttgttgaaaaactaagccatatcaacactagagaacattttaaactttatgccttacttttaaggggaggaatattactttccagaagtctctgttgggagaccccagcgtttcctagacatcaactctttgacattctttcttgcatttcttttttgtttcaaggaaatagggccgccagcagctccttgttgccgcctggctcacttttatggtggcccaggaataaactttggtggtcaaattcaagtgctcagtccagcagctgtctcctcacaggatacagcccctacccccatctcagtcctggctttgctgaatctgccttgggggattgggccccacatcaccctggagggccaggagggggaaggaagcagagccttgggtggaagtggagaaagcgggatctgagactcgagccctcatccacacctctgcaaggataggggtacctctcgcttccctcttgctggttcctatcactgtttgggcagcattttgccttcaataaactcgagtttaatgaggtcagtgtgaaccccattaaaagccatagtccatagttccccaccactataattaaaaatgctggccccatctcactctataaaaagggctagaggaaaaaggaaacacagcagatttttcttttcatggccccttaccaacagaagt

SEQ ID NO: 69688 - DNA, 1100 bp, Homo sapiens
agggctgagaaataggaaggaggcactaagatctggtcacagccccagggacagaggctgggggctttgactagggagtggccgctgggcctcccctgatgccacagcatccaccgctcctttccactgtctggttagtctcttctggagacccatacctggccccaccacccaccttacagtcctcaaaatcatccaaggataagaaccccaaacctagtcccccccaccatattcttcctggacccctacactaggcttcttttcagcgcactagctgaggctgagccactaagccaaagggccctgacatagaagatacatggctctcattccaatccttttctttggggtttgggatttgaaaatccacagtggatgtagctttcttcacattgattgacaataaaggcaggcatgaaatattcacccagggccactctctcatactaaatatttaacacaacattagagaaggtttttcccagacttcgccaggcaccggctgggcggctggcgcactgctcaccactcgtttatgactaatctgactccctagccaggggcagcacagcaagccagacaaagttgggacactggcttgcagctgggctgcctcacctttgggaaacttcagatactcttccgggagtctctctaaggactccagaaaggtagtcttgacacccagctctggccaggaaaagagtggacttcttcaaactcttgtgaacaggcggtgtctctgcgggttggaagggtaagagtccctgagatttaagggaaaggattcacttctctggggaaatcaggcagtggggaaagaagtcctcactcccaccctcctggtgctgctcacagagaggaggcaagacccccatacatgagagccctcctccttcccccaatcctgggggaaaaaagagcagcagctagaaaaaaatacaattaccccttcccagccaccaccctcgcccatcccaccgcccaccccaccccaaccctctctctcctcctttgctcgtgctgtggtatggagagaaggggagtgacgagagaaaaacgaatacaaatctgcaattgattttcataatgtttct

SEQ ID NO: 69689 - DNA, 1088 bp, Homo sapiens
ggtgggggagtagggggtgttagctgtggtgtctccttatttgacaactcaaccttttccacagagcccctgcagacacactatggggagctgtttcccttaaggaccctgcccctgagggaagagaggcagaaacaagatggggcaggaagttggaaagggtgtctgcatgatgccaatagccaggtgaaaacagagaaatcagcccactatctgcttagtttcaaatagaataaagggatccaattttgtagctttcatctgatgtaatggataatgagatgcaggatcagccttttgcagtgattcagtttaaagcccctgggaaggatctgtttccccctccccaattatcctgccacaaaaaagccttaagttccaccattaaagcacatggtgttaagtacagtcctctgcagatcacatcctttaaaatacaaaagcaccactgggatacttcatcaaacaaggatagaatcagaaaagtagtgcttagggggtatgcttagggagatgaggggccctgaagattaatctctagatacttctcagtttcacattgcctgatccttgtgggaaagctagattctgcctgaggaagtgggaactcagggactcccctagaaaccagatgcctgcaattatgagtatatttctagtcctgggaaatgggtggactctaagtggtgagggtagttatcacaccaaaaaatcacagaggctgccagtaaaacttaaatcagggggatggaaattctgataatatacgtgcatttgggtcagccactatagaaaccagtgtagaagtacttcatggggccccctgtatgtccagaggatataaaactattccagagggggaaaaatcccttccatttctatgattatctactgtatatctaacccataaggcatggtttgaaagtattaaaacctagcagatagggaaacacacagccagggttcagatctagtgatgtgaccttgggtgggtgacttaacctttctgagaatagatttcctcatcaaattcagtataaagcaactggcatatagtaatcttctagaaatggaaactattatagtta

SEQ ID NO: 69690 - DNA, 1002 bp, Homo sapiens
caaccaaatccagctttattacttactaactgtaagaccttgggcaagttgcttaatcttgctaagcctcagtgtcctcacttataacaggggagcagtaatacccacctcatgggattgttgtgaggatcaatgaggtgtacctggtgcagagcagtcgctcaccacctggaagctattgtaattagccttcccaggtctctgggctgtggctgtgcacttgcatttcattcttcagcgccgtgctttccagaacagtccattctggctgggcttttcttttttaggatgaccttaaaggtgctgaaaggatgccaccagtaaatgtttattgaaaacctactatgtgctcggcatagcccaggaactagtgacctatgcctgatggaaaggagatttggagtgggagatgtttggtggctatggcttatcctcaccaggtgccatgtgaagaggacagataatggaagtggggagggaaagggcccttcattaccaagaactgagatgagttcagtcctacttggtggttggtagatgactgacatggtctcttagggtcccttctgagcccaggaaatggtagtgggggccctggcaagcatggatccctcctactctgtggctgagggttgatggggcttctgtccatctcttttcccaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtaaagggtttggcttccccagtgggtggagtgg

SEQ ID NO: 69691 - DNA, 1023 bp, Homo sapiens
acacagatgctaggaatgtagaagctcacgaaaggggcaattgaggccctctaaggctgtgtatcctctgcctccaggcagtatcttcttcactcaaacagatggctggaacttcacttctgcagagctctgggcaatgaatcaacttagcatccactctcatgtgttctgagttagaataatctttgctctggactgtatcaccttcctgaaaatctgagaaatacttggattatttctgcatcctgaatgacttcaatttttaccctagtatggggagttggagggcctggaatcccaatgctttcttaattcccaagcctgttttaggtggtcccaggaagggaatgagaagggggtgtgtataaaagagggaagttgaggggatggcagtgcaggtagccgcaggtaaggattccccaatcctcattagagatctcaattgaataactgttgctatcttcaaagaagagatgggacagacagccccctttactccacaaggaaatggcaggtctgtgtgtatataagttggaaggctatattcatttgaatataactctctgaatacatttttgtcttcatttgaatatattaaatttcactgagtccaagttgagtcactttaatggaggggaagcaatggcctaaataattcaaggcggtagataatccccaaatcatttatgaatgtgattgaaaggcacttggaaggggctttggaaggtgctttgtggacttctctgggccaaaaggaagaaatcattaatggaggtaaatgaaaagctactcttagacctgtaccagaatagctgtacagaccccatgctattggaagagcaacaagcaggttggaattctgagggcacaaagagagtcgcagttatgtatggattgagagaagctaggaaacaataagctcacaactggcatcactcccgaattaaccaatataccacctcggaacagcccaggcactgggcaaaatccttaggtaagaatttaagtctggctttgttattc

SEQ ID NO: 69692 - DNA, 6162 bp, Homo sapiens
agtttaccccagctttcctaaggtacagtgaggggttggagggatctgtgtttggcccggggagcaattgtctctaccttaaggttcagttttgagggcataaaatactactttgcaatgtcatgagaacaccgttagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattgaaccttttttttttttttttttttttttttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgcttttcaaatatggattctgagtggtggtttaaagatctgggtcttatgccccttctttaatttgggccctggagtgtcagctcaatttctgaaagagcaacaagacttggagaacatgggcttcttttctaaggattattggtctctgactttctgcaaataaccacaggttggcgcaagcctgaggaaataagataatgcgtatcctgtttcctactcttatttccttaactggttcagtgtgtacct

SEQ ID NO: 69693 - DNA, 3317 bp, Homo sapiens
gagccaggatggtctcgatctcctgacctcgtgatccacccgcctcggcctcccaaagtgctgggattacaggtgtgagccaccgtgcccggcccctgaatgtaggtttgattgggttcactcacatgctcatattcacaaataaaaattttggaagcagattaatattatttattattcatctttttaacctaagcccaccatggtttacatctaaattctagctacagacatctgtttctgtataatatattagctattaatccatttacttacatttcttcttgaaaatattgaaagggtccttttcaccttgaaaccaaggtgaggaggaaatcaagtcaactaaatccatataatgacataaacgtatgtctggacagattctttcactcttcctctccttttaagtctcatattctttctctccaggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgaggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagc

SEQ ID NO: 69694 - DNA, 2060 bp, Homo sapiens
aaaaaaaaaaattacctggcttgtataaaattttgctttttggctctcatcagtgttactacacatggatttgaacctgtgctccttgtctagattgtattactacatttagaccaagtttcaatactcatctcatgaattatcaaattttttctctctcttaagagacaggttctcactatgttgcccaccatggagcacagtggcgtgatcatagctcactgcaggcttgaactcctgggcccaagggatcctcccacctcagcctcctgagtcggagtagcacacttcaagtgtgcatcactgtgcccagctaatttgcagagacagttgcccatgttggtctccaattcctagtctcaagcaatcctcctatgtcagcctcccaaagtgctgggattacaggcatgagtcactgcaccaggccagttttttgtttttgttttcttttttgtttgtttttgttttcagtcacagtccggttctaccttctaatgctaacagtcatctacatccagaggggataggcactgaccagggccttctctctaaccaagcatataggtattggtgtttatgatctctgaaattttgctatttaatagtattggccttacataattcttacctctattcttccataaacacaggtgactgtgaaatgtgtcaaaattattgtttagtgttaaggtaaactaaaagtctaaaaaaataaagattgagagagaggtagtatatttgaagtttgtaaaatgaaaagatacagttagggtaaacatggtattctttaccatttcagaagcttatttacaatattaaggagattccaagtgagtgggattagaggagttcctagatgttgactccagagtatctttcttttcgccccttttcttttttttttttttttttttgagacggagtcttgctatgttgcccaggctggaatgcagtggtgcggtctcagctcactgcaacctccgcatcccgggttcaagcaattctactgcctcagcctcccgagtagctggggttacaggcacctgccaccatgcctggctaattttttgtatttttagtagagatggggtttcaccatgttggccaggctggtcttgaactcctgagcttgtgattcgcctgccttggcctcccaaagtgctgagattacaggcgtgagccaccatgcctctgactccggagtatcttataggacattagagacttttagggttcaccaccagtcttctggaggaattccaggaaagataatcacatcttacaaaaatatctcttgacatcactgtcacttcattgtcactgtcagtacttagtattaagttctaaaaatttttctgaattggtgaaagaaatgatatcaggagatattaacttaggttatgttttgttgagcctagaagcagggagtttctttactctttccacaagctgtaacctttctttatcttctatttatagcagagcaatgatatcgctcggggctttgagagaggactggaaccagaaaagatcattggggcaacagattcctgtggtgatttaatgttcctaatgaaatggtgagagagatttggcttcgctttacaattgtgtttctttgccagtgacttgaatttgtgtggaagatagggtggcaagactgcatattcccaaaccatgaattttgaatgtcagagatctttctttttttgagacagtgtttcgccctttgttgcccatgctggagtacagtggtgcgatctcactcagctcactgcagcctccgcctcctgggttcaagtgattctcctgtctcagcctcccgagtacctgggatgacaggtgcccgccaccatgcctggctaatttttgtatttttattatttatttatttatttatttatttttgagacaaagtctcttgttgcccaggctggagtgcaatggtgcgatctcggcttaccgcaacctccgcctccgggttcaagcgatactcctgcctcagcctcccgagtagctgggattacaggcatgtgccaccatacctggctacttttata

SEQ ID NO: 69695 - DNA, 1035 bp, Homo sapiens
tcactgcaccctccatctcctgggttcaagtgattcttctgcctcagccttccagagtagttgggattacagacatgcaccaccatgcccagctaattttgtatttttagtagagagggtgtttctccatgttggtcagggtggtcttgaactccctaactcaggtgatccacctgccttggcctcccaaagtgttgggattacaggtgtgagccaccatgcctggctcaattaacaattttaaaatgtacagttcagtggcatttatattctcttgatctattatttctacatacttggcgtacaaaattaatttttgtcttttgaatcttcttcagtttgggaagtgtatttatgaaattttggtttgatttagttgctttaatccttctgatctttagctctcaagtaagtagcataagcactgttattgcctctctctcttttcatctgtgtgtgggcgcataaatacacacactctaccacctcctcccgcccccagcttccattccttttatttatttcaaggttatgaagccttttgtggtgaaggatgtatcatacactttacatttcataaaagcgtaagtctacttcggaatcttccagccttccagagtagctgccacaatcatccctatgtatcttcattctaattagatttatacctttctagagcattagttctcaatgctacacattataatcacctggggggtacgttaaaaaaaaaaaaaaatctccagtgcctaagatgcaccccagaccagtaaaattagaattttttttttttcttttttttttgagacatagtctcactctgttgcccaggctggagtgcagtggcacaatctcactgcaacctctgcctcctgggttcaagcgattctcctgcttcaccctccctagtagctgggactacaggcacatgccaccatgcctggctaattttttgtatttttagtagagatggggtttcaccgtgttagccagaatggtctcaatctcctgacctcgttatccgcccatcttggc

SEQ ID NO: 69696 - DNA, 1182 bp, Homo sapiens
tgagccaccgtgcccggctgatctgctttctgtctctataaatttgtctttcccagacatttcatgtaaatggaattagtatgtagtatcttgtgtcttatttctttcacttagtataatgtttttggggttcttccaagttgtagcatgttttaatattttgcttattgttgttggataatattcctttgtatggatataccacattttgtttttccatgtcaccatccattgatgaacatttgaatttgttttctgtttttggctattaaaatgctgctgtaaacaattgtaaataagtctttgtgtgggcttttttttttttttcatttttcctgggtagaaatctaggatcaaatttgttatcttctttaaagcatagggtttctctgtcctttttgtccgaatgtcctctttgaaataaggcattggatttttttcctcattctttaccccccccttttttttttaattttcccatttttcttacccagggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagaggtaagcttcctttcccttttccccaaaaactattcttttgccaccaaaataataataataaataaaagtatcatattttggttatttctattgtaaggatggacctataaggtaaattgttgaacaaaagagcttccagggaggtatgttgattacagctccctctcctggctaagtgagaaatgtaatttgtggccactggattgtattaagggggcaaaattaaatctttgtaaaatgttaaaccactcctctgccttctccataagtagaagacttagttatcttagagaaggaggatcattggtgaattttttaagaatagaaaggggctttgaaatgttttgttttgttttgagacagagtcttgctctgttgcccaggctggagtgcagtggctggatctcagctcactgcaatctccaactcccggctttaagcgattctcatgcctcagtagtagctgggattataggcacatgccaccacacctggctgatt

SEQ ID NO: 69697 - DNA, 2417 bp, Homo sapiens
cacaatgcttaactgcatgcatctaacatggggctggttttaaccccagcgctctgacctaaactgctcagctcccggaaattccaaggtgagtggtggtgggggtggggtactctccctggaatatgacatttcctgtctctggtgaggttggaggctgttttattttaaataaagcacataagatattttcttgaagcttaggactcttctaaattcatggaaaaattattttaacccccccgcacctacattttgctactacttcctcttccaaatagagtattttaataaaaacttagtcttatagggcagtaatgggtataggcagttttttaggtgggcagacctatagctaataagttctggagatatggtctccaactatatattcttgtaataatttttaaaattttgctaatttgaagtgaattgataattgccactttttatgtgacttgaacatcattctgaggttagtagtgggccctccctgacccagtggttttctggtcagggtggaaatatttagagggtgctgataaacatctttaaagattacaggaaaataataatggagttcagctaagaaaacaatttctgctactctgtaatccagactgtaggcaccatttagcatggttaaggaagaattcttaaaaatgattatggaacaacaacatgggaatttttaaaactagattctctgttgagtaccccctggtgtgcatatttctgagcttaactcaatttccatttgtgtttccttgcttcagctttccttgggcctatgaatggttcctctgtattttgaggaggcttcatgttgatgctgagtctggggccagacttctttttcctcctcctcttcctttggccctgagtcaacttcagttaagagggagaggtaccttcttaactatttgggttagttgcatcttgggaattactgaataatctagtgactaattttgaattttaggactgaaaaattttttctcctttctgcctccctcccatccccaaattagctttctaaaaaggaagattagtgtgtttgagatgtcagccttgcttttgtgagctgatggatgctctgaagggacaagctcaatttgtttaagggaaatgtaccaagtcactgaaaatgtggtgaaaggtgcctaagcaagccttttttgtgtgctgctaagagactgggcaagatgctcagagcacagaaaactcatattttagtggcttttcttttttcatttttataaagacgcttattcaccttggagaaaaaggttttaattttatcttggttcatttaactaaagattttgcacatttctgtttgagttcctggcttgtaaacagttacaaacatagccaggaataacataccacactacttgtcttttggaatctgaaatagaagagttaaacagttgtgccttctaataattttggtctctttagccgaagaggaggttgtagttgaggaagtgaagactgattcatttttaaattaaactcttaggactcatctgtagaatgatttgagactcaagagcagggcacatggcaactcagtgttatccccttttcatcccatcaagaaaagacaaagtttttaactcctcacatggattctaaccattttgtcctttgcctttgcagggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgagtaagttccttttttcccccaggcgttgggactctgtagagatagatacctttggtttacttccttaggaatcacaagcatttttgtctttttcttccccctcctgcactcttcctaagagttagaagacacagcagtaaagaaaacaaaatctctccgcttgtggagcttacgttctaatgatactgcttttgaaaggcagtataatgaattggttaggagcacagactcgagagtcagattgcttgggtctagattctaactccaccacttatgatacaaactggatggccttggctaatttccttaatcattttatctcctcagtgaaataaggataagcagtagtgcttataaggccaggcgtggtggcttgcactctaatctcagcactttgggaggctgaggcgggtggatcacctgaggtcaggagtttgagaccagcctggccaacatggtgaaactccatctactaaaaataaaaaaattaagtgtggtggcaggtccctgtaatcccagctactccagaggctgaggtaggagaatcacttgaacctaggaggcggaggttgc

SEQ ID NO: 69698 - DNA, 1050 bp, Homo sapiens
atccacctgccttggcttcccaaagtgctgggattacaggcgagagccgctgtgccggcctacctcttgtttttctgggttgccctagcttgcttgtgatgccctctctgtaattgctgaggactgataagttttttgtttggtttttttttgagacggagttttgcccttgttgtccaggctggagtgcaatggcttgatctcggctcactgcaacctccatcttctgggttcaagtgattctcctgcctcagcctcccaagtagctgagataacaggtgcctgccaccacacctggctaatttttgtatttttagtagagacagggtttcaccatgttggccaggttggtctggaactcctgacctcaggagatctgcccgcctcggcctaccaaagtgctgggattacaggcgtgagccaccgcgcccagcctcttttctcatctcaatgggccttaggtgctgtaatctatagttattggtagctttaccagatagttcctatgtatatttaagagagaaggctgagagctgttatgcctgaaagactccagaaatttgagaagctactcaccctttcccttggagatttccacaaggataaggttgtgttcagaggctcatcttcttttcctctgtcatggtattgggattctatcttaatcactccatcatcctgccagccatgtctcatttctcatgctggaaagctccctcctcctaagctcagtgtgaaccaccagtcttgatgctttatctggtctaggctctagcccttaaattgtttgactggctttgtgtttcatttgaccctaatactccgggtcacactgtctaaaagagaattatgtcccctccgatgtctgagtgcatttctcatttcttactgctgctcctgagcagatctgtaacttcaaggttaagataagacacattccatcagaactatgtcgtcatccttgccagcttctgatctgtgactgtctaggagatttacaagacaattgcatgccatcctttaaagaatattatggttgtactctgactc

SEQ ID NO: 69699 - DNA, 1811 bp, Homo sapiens
gaattttctttccagtagtagtagttcatcaaaattaaacactgacagatttttttctacctgaaactaggtcatagagtaaaaattttcacttgcagtcttactcttcagactcactgaatgcctgttccatcctgtttcattgctaggaaggacactagataaagccatgagcttgagatggtgtacttgaaaggaccgtttcaagatcaggttttataacacactcattatttatttcttctgtggagaggagaaaccaaattggattcaagtatttttctgatagtaatctatgtttcttagaataaagcaagttcatatctgagccagagggcataattatgtcagaataaaatataattatgtcggaataaaatgccctgtactaaagaggtcaactaacaggctgggaaatcttaagttttgtttttaagacaaatccttgaactctctgtgcctcgtttctcatccctaaatctgtgcaactcacctcacagggagttgtggagggtaatatactgctaatttgttcagtgtttcacaacaataaattatgcctaagatctgataaaacatagcaaacctcatttatgtaagtagagacaagcatggataagacttacagataataaagaaaattcattaaaatttttttaacttccttgattattaaacatttttccttctgtttcctatatattttccaaagtattttcctattgtttttccataatagacttatgagatagggcaaataacaaacaccaggttatataataaatgaataaattcatcaagcggacataacaatcctaaatgtcctaaaagctaataataaagcttcaacatacacaaaggaaaacagaaatgaagtaacaagccaggtgcagtggctcacgcctgtaatcccagcactttgggaggctgaggtgggtggattacctgaggtcaggagttccagatcagcctggccaacatggtgaaaccctgtctactaaaaatacaaaaattatctgggcatggtggcgtgcgcctgtaatcccagctacttgggaggctgaggcaggagaatcgcttgaacctgggaggtggaggttgcagtgagcggagatcgcgccactgcactccagcctgggtgacagagcaagactccgtctcaaaaaaagaaaagaaaaaggaaataacagacatctgcaattatatttggaaatttcagtgcctctcagtaattgataaaacaggtagatgaaatcagtaaggaaacggaagacttgaacaacactaccaacaacctgatataattgacatttatagaatagtacaagcaacagcagaatacatgtgcttttcaggtgcacatggaacttttacacagacagtttaccttctgggtcaataagtctcaaattcaaaaggattcaatcataaaggttttttaaaaaaatttaaacggggtcttgttctgtcacccaagctggagtgcagtgacacaatcaactcactgcagcctgaaactcctgggctcaagtgatcctcctgcctcagccttctgaaaagctgggaccactggcatgtgccaccatgctcagccacccacccttttttctttttttgtagagacagggtctcgttatgttgcccggattggtgtcagacccctgggctcaagtgatcctctcatctcagcttcccaaagtgctgggattacaggcatgagccactgtgcttggccaaggtatgtttatttcctgatcatagtgcaattaaataaaaaatcagtaacaaagacatcaagaaaaatccctaaa

SEQ ID NO: 69700 - DNA, 1040 bp, Homo sapiens
ttgctcctgtattcctcgacttgagcatttttcccccgccccctcaccacttgaggtttggggaacaggagttgtttttttttgtttgtttgtttttaaataatactttcagaagtcgcttctttaggaagactgttaaaatgttagaacgaatgggagaaatctctatgtactgtcatggaaaggcgttcaagaaatatctccttcctgatagtgcatatttctactgacaaatatgtttgtaggtccacagaaaagttttggaaagctacacaccaaagtgtcaatcctagggacacagtaggatcgaggcagattagatctttaatgtttaaaactttgcaaggttaataatttgtgattaaaattaaataaaaaatgaagtcgattgttttgtgtttctagtcataatcacatacttacaaccccttttctgttttatgtaatccatgtgcccagtgcttttattttagtctctttctcccgggaactttcatatatttcttttctttacaccattgaagatatcctaaagtccctctttttgctgttcctttgaggatatctgactttggaataaaaaagaaacaaagagggtaatatttagggttctggggacagaagattcatccatcacctggattattccttgccttttaattagatttccttcgaagtgtgttttacatgcagtctatctccttttggtaatgcccactctgcttattccaggatcttttggagaaataaataaattttgataacattggctgtatcagagtcttactgctttattcaataatttattcaggatcaagggaaaatatttaaatactgaaaatcaactacctatgaaatacacttataattagagacctttccgactttataccaaagacagacgattttaatagcagtttatgaacagaggagagatttccatgttctctggcactagcaaaaggacaaacctataatttatacctggctgtaaacctatttgtaggtatgctagtaatggagttgctgagcttctgaga

SEQ ID NO: 69701 - DNA, 6699 bp, Homo sapiens
accaatggactccaaggggtggagacggcgtagaacgaccgaaggaatgacgttacacagcaatgtggcaccacaggccaatagcagggggaagcgatttcaagtatccaatcagagctgttccagggcggagtctaccaatgccgaaagcgaggaggcggggtaaaaaagagagggcgaaggtaggctggcagatacgttcgtcagcttgctcctttctgcccgtggacgccgccgaagaagcatcgttaaagtctctcttcaccctgccgtcatgtctaagtcagaggtgagttaggcgcgctttcccacttgaattttttcctctccctttcctgaatcggtaagatgctgctgggtttcgttccttgcaccagcccattctacagttccttcggtcgctgccacggcctacccctcccaaagttcaagtcgccattttgtcctcttgatcgccatgaggccgctctccgccaaccatgagttatcatgcgggactcgttactcgtagcaaaattcttaggcacacaggatctttgtctttttttaaaccttgccttggtgagcgagttttctaaagagcgattagtcccattgtggagatgcacccctaccgcccaagcctttgttgcgcgtgcgtcggaaggcgactagggacgcatgcgcttgcgatttcctagcactcccaactccagcatacggcctcccttgataggcagaagcacgtgtcttgttgcgacctgaacgaacaataagtgctaggtacacagttggtgtctagtttttcttttcctcgatggaaattgtttcgtgttgtagcccatttaacacttccccctccccccactctagtctcctaaagagcccgaacagctgaggaagctcttcattggagggttgagctttgaaacaactgatgagagcctgaggagccattttgagcaatggggaacgctcacggactgtgtggtaagatttggaagggacaaagcagtaaaacagccgatttccttggcttatcttggtgcagtcttctccgaatgcttatgaaagtagttaatagcattatagttagagctttgttggcaaaggaacgtcctgctttgattttaaaagctacctcttaaatctagggtagtgggaaactggacgactttttataaaaggctggtgtaaagtttcctattgccctattcaaagttaaaatgacaaaagcttttgcggtcagactttgtgttacataaattaacactgttctcaggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagtgagtgggttttttttcttcttcttcttaaacttacttggatatgtgctgctatggacttaagattcgggagttttctaaacttaccaaaattttttattcgagtataggctttgctaatctaaacctatggtttttctcctattaggattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcagtaagtatcagatagtggcatttagtaagggttccacaatctgtatggcattctaaaccctgataccatgttgtatctatgttttttttttagttcagaaataccatactgtgaatggccacaactgtgaagttagaaaagccctgtcaaagcaagagatggctagtgcttcatccagccaaagaggtatgcttgttgcttaattaaaccttaaaggtaactttgagttactccagtatgaatgatttaatgcttaaacttcatgtcttaaggtcgaagtggttctggaaactttggtggtggtcgtggaggtggtttcggtgggaatgacaacttcggtcgtggaggaaacttcagtggtcgtggtatgtatggtttatctacatgtagttctgacttctcaccatctttgctatgaagattttacagtacgggaactgcattcagaatgtcactttaagtccaagtcatacttaaaacttgaaactttttcttacaggtggctttggtggcagccgtggtggtggtggatatggtggcagtggggatggctataatggatttggtaatgatggtaagttttttaggaataagtagagaaaaattcctggcaacctggatctttagaataggttagtagagactaaaattctggtgcatgtcaaactcaactttgcccataacacgcatgctgtgagcaggccttcagccgttacacttgcacaagttttcattgtcaaatacttttgtcttattgagaagaattgtattcttgtaggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggtaggtatccagtgatccaagtacttggtgtgacagctagattagccttttagagcttgggttctggtgctgttgaagcattgtgtggtacactgcatggtatattaaaaacaaatgggcttgctatgctacctcctcctagctttaagctggggccgcctcactcccaaatagtagagataagtggatagtgttgtctttgagttagattagtatcatagaaggatttagtattttaactcctttgggaccttaggcgcttagttgatgtatccaagatacttctgcttgctgtggccctggatccgtgaaggccttcaaggctgaagggtatgcttgtgccactctgaaaatctctttattttatgtcatggtgagttaggccagttttctttgtattactggattattcaactgaatgcctttcccagagaatgaaatgcaaagattggagtcaccatagtttgggagaaaggaaggctgataactcaaccttattttattctgactgctaaacagaattggaaactaacatcatcctcaggtaacagataaaggccctctttcccattcataggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtatggtatctatgtaattttggataatgtcaaaagagtgtctgtagctactgctgggaagaaagccctttaactgctatgtctgggcagcaaaacgtttatagtttagaaccttcagaaagtgataatttgatcacaaattagaaaaatcatgggacctctttaccacctcccttgtagtagggccatttttaaatggccagacacttgaatttaacttttattatcccaaatatgaaaacattactgttggcactttgaaactttaaaagaaaaattgtacttttcaggtggctatggcggttccagcagcagcagtagctatggcagtggcagaagattttaattaggtaagtaagcacctttttgtgtgttgacataattttttaaattgctgatgaacccaataaccctaatgtagctgagcagtgcaacatagttaacattataattgcagtaattgtggatataaagttaatattcagatcagcaaaatttgtgggaaacaaacttgatattggattgtagccttgagtcttaatatgtttagattaacaactttattccatattgttcaacaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggtaagtttttacaaattagtgctcagcaaaagaatgccctgcgttcccaaagtaaaagaatgacaagctgtaccttaaaccaaaacacttcgtaatctcatccaattgcaaaaagagttattagccaaccaggtattcccagtagtgacagtggatataactgtgtagtcattcacctctgcttatatgaatactttacaacctcttttgccttttgcaggaacgtccttgtgaagacctttatctgagccactgtacttcgttatcactgccatgcagtttacatgagctgttctgcagctcaaattccattttgtgaatgggtttttttttttaataaactgtatttaacttagttctgcttgttttgtcctcctttgtgatatctatggttaataacatgttgaaattcaggttagagaggatatggttgattctaatgtgaatttctatatttagattcatcccattcagcttcatggtttaatgaaaatagaaat

SEQ ID NO: 69702 - DNA, 1088 bp, Homo sapiens
ttgcaataccagcacagttcttaacaagtgcttactaagtctttactaaggttatattacctcagaagaggaaagacttctgattgtatgggttaaggtatggcccaaatgaccctgtgaggacacaggacagaggtccagtgtctccagagcccattccttctgtgcctctgctgcctgcaactgataaacctcttatctggcccaggcaggggagcccagggccaggataggaggagagggcagagctgctatcaaccaccaggcctgggccatatcttggagaggaggaggggctgtctgcttgcctctttccacaacttgttcttggggatcctcaagcatatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtaaagacctcctgtgctaccaaaggaactgactgtggccatagttggcgaggtggagatcacaacacaggaaaagactttccatcttaagggattgatgaatccagcatgagtgaggatggggaggaggcggtctctccttccctcaggggaagctggagggagcccctccaaggaggtagtgcaaacttgctgaccctagcaggtgtagctctaacacctcttttcctttgacacaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcaggtgagtaaggggggatagggcaggggaggccgtgtgtcggagaagagagaagcagggagttggccaggactgaggcagagggcaggagcaagcagggctcagggctggtaatgctccaggc

SEQ ID NO: 69703 - DNA, 1002 bp, Homo sapiens
aggggcagcagagatgctgtggtgtccacaggggccgggagtcagggttcagcccgagtgggagacggggaaagagagttccgggtaattcttggggactgagcgttctgctgacctttggaataagtgtgtggcctagtgtaggagctaaagccttggtttagagtaggaagccctgccggggagagggcatagagtcggtggaaagttgaaggcagcacatggactccttaggatacacagacctgtaggcgtactggattaggacccttcaggttgccccttatttttagcattgtggatgataccctgattttaatttaccaaaccaccaaactcgccccatattgtaagaaaagaatacagatgttttgtcgttacagactcctcctgatggtttcccaagtttgactctccattgccgattccctgccacattccttcaggaaactgttttgtcttcggtttcctgttaatccctattatataggtttgtcaaataatcagtattccatcaaagttctgggatacctgataaagttagcatggattgtggaatattttttctagactccttattctgttctccttttctctacccatttagaccttaggaattctttttttttttttttttttttgagaccgagccttgctctgtcacccaggctggagtgcgcacgtggcgcgatcttggctcactgcaatctccacctcccgggttcaagctattctcttgcctcagcctcccgcgtagttgggactataggcgcgtgccaccacgcccggctattttttttgtatttttagtagagacgtggtttcaccatgttggccaggctggtttcgaactcctgacctcaagtgatccgcccgcctcggcctcccaaagtgctaggattacaggcttgaaccaccgcgcctggccaggaattattattattattattattattattatttttgagacggagtctcactctgtcgcccaggctggagtgc

SEQ ID NO: 69704 - DNA, 1062 bp, Homo sapiens
ttctcttcccttagttctctgtctctgcttcttcagtgaagtctgtttcagcctgcttcttccttattcttttgctttaatctatgcctaataggctgcattcacagatccctgctaacttgatcaggtaaccctggactttgcttttaaaaccacactggttctttgttatgggaaacctatgtaatgcggttagggacaatctgatcaaagcatattcttctgtccttaactctacaaggtacatacatagctgcaggatgtcgagaaaaagggacaggtaagctacagggggtcaagaagaactgttgatcaaagtttgcattgattgtggaatttctaaataacagtaagttcccttcttttaggtactttacagtgggtcacatggtcacatttctttcttgaattaagtaatccagctctagctttcaagcagatttgtctaatctctctcaggtctccttaggctctaaggaaagagaccctttcatctcttttagttcccaatgcttaataatagtgatctcagcctgcatctttggacttggcttcttctctcttgctgtatctgctggttctcgctttttgagttgtgaatgaagaggatctctgcagatcaccattctccattaataacctgtggaatcttaaagataaggatttccccttcctccttcctgctttactttttttctttaaagctgaattactcgggccgggctcggtggctcacacctgtaatcctgaggtgagtggatcacctgaggtcaggagttcaagaccagcctgaccaacatggtgaaacccgtctctgctaaaaatacaaaaattagctgggcgtggtggcatgcgcttgtaatccccagctacacgggagactgaggcaggagaatcgcttgaacctgggaggcggaggttgcagtgagccgagggccattgcactccagcctgggcaaaaagtgaaactctgtcttaaaaaacaaacaaaactgaattctgtatcggtttagatctttaaatctttgttcataggttttatttttcctaatcctctctgga

SEQ ID NO: 69705 - DNA, 1051 bp, Homo sapiens
acctgtagtcagctacttgggaggctgaacggggaggatcgcttgagcctgggaggttgaggctgcagtgagctgtgatggcaccactgcactccagcctgggtgacaagaaataataataatattaataaatctgatataggctgggcgtggtggctcatgcctgtaatcctagcactttgggaggtcaaggtgggcagatcacctgaggtcaggagttcgagaccagcttggccaacatggcgaaaccccgtctctacaaaaaacacaaaaataagccaggctacaaaaaacacaaaaataagccgggcgtggtgggaagcgcctgtaatcccagctgcctgagaggctgaggcaggagaattgctggaacccgagaggcagaggctgcagtgagccaagatcacgccactgcacttcagcctgggcaacagagcaacactgtctcaaaaaaaaaaatctgatatgtaaaaactgctcttccctgtcaaagactttagctaattcttcttttcttttcatctgaagtctatcggattgtggctggcaaattggagcccttaaccccagaggagcttttaattttaaaaaagttggcacaggctgggcacggtggctcatgcctgtaatcccagcactttgggaggatgaggcgggtggatcatgaggtcaggatatctagaccatcctggctaacacggtgaaaccccgtctctactaaaaaaaatacaaaagaattagctggtcgtagtggtgggtgcctgtagtcccagccactcgggaggctgaggcaggagaatggcgtgaacccgggaggcagagcttgcagcgagccgagatcagaccactgcacttcagcctgggcgacagggtgagactccgtctcaaaaaaataaaaaaataaataaaagttggcacagaggccaggtgcagtggctcacacctgtaatattagcatgttgggaggccgagacaggcagattgcctgagttcaggagttcaggaccagcctgggcaagatggtgaaactccatctctactaaaataaaaa

SEQ ID NO: 69706 - DNA, 1154 bp, Homo sapiens
gcagtggcgcagtcctagctcagcgtggtcttaaactcctgggctcaagagatcctatcacctcagcctcctgagtagctaggactatagatgcacgccaccacacctggctaattttttttatttttgtagagatggggggtctccctgtgtttcccaggctggtcttgaactggccttaagcaatcctcctgcctcagcctcctgcgattttccttctcctagttagctggctcccttgaagttgcagtggtagaggagagcaacagaccaccacaggttttgcaagtgatatacttacagttgaagaagaaccattaagactgaggccgtgattccttatttgattcttggtagtggaaaaaaaattaccctcttgctcactcactctaggccccagagtgtttctcagatagatcatcttctcactgcttcttaactcccccaaaattcaggttggcttttgtccttggaagttaagtggtagtggttaaggtatagtggaagaattggagaacataggagagtttttgaagatggctgttttactaggctgcattgagaactggtgtgcctgtgcgtgtgtgtgtgtgtgtgtgtgtgtgtgtgtgtgtgtgtgtaaacgctcttttccctctgcttagtgtgtgggtggtttagggaaggcttgctttatgcttctgcattgctactgcattcggactgcagaaacttccaagtatactaggacattcaaccctattttcaaatggctttgttcagtgccttttaattaatctggtcacattctatagccacctgtacatgggagagcaggaagggagagggtaatttggaaaataactgtaccataatatttggaaataacagcatgacctctcttgattaagccccctgtgagtcagagaaactgtttctctgatggtactttggaatcctttgtttaaatgctttctctgtcaattcagtttacttaccctgggtctttctcaatgggaaatatcaaaatctgaccaagttgaggtaagggacttacagaggtacctctgtatccccttgcagccccagtgggactaggggaaggtatctggtttaccagtggtgatgggaggcttcaggactgaaggtatgttcgtatctcttcaggaaccttc

SEQ ID NO: 69707 - DNA, 1079 bp, Homo sapiens
gtagtgttttttaagatggatttctgaggtatggtcaagactgcagggggatacttgcttcttctatgaagggtccatacctgactgagtttgagccaattagctaacaacctgggtcatgttgaaaccatacattctgaatggatcactggagaagaccttgggtatagtcctaacctgcttcctatatgcaggaaaagctgtttgcctcagatagcaacttctaggagaatagataaataaaaataagcccccagataatttgaggcaaaagtgaaagtttgagaaagtcaactcttactgagctcttattattggtataagtgctttgtaaagtatattgttatttaaacctcatagcacttctatgagttgtaggcattggtgcctttgttttacaaatgaggaaaccaaaccatgaagaactatatgaaattacttgtatgtgaccattgagaaaagtacaaaagtggcagttatctgatgtggttcaacctagtaactttctcagggtcacacatgtagaaaatggctcagcttggattccaacccatatctgtctgacttaaagtccatgctttttaaaaaattttgagacataggccgaacgtggtggctcacacctgtaatcccagcactttgggaggccaaggtgggcggatcacttgaggtcaggagttcgcgaccaggctggccaacatggcgaaatcccatctctactaaaaatacaggccaggcatggtggctcacacctgtaatcccagcactttgggaggccgaggcaggcggatcacgaagtcaggagattgagaccatcctggctaacacagtgaaaccccatgtctactaaaaatgcaaaaaattagctgggcgtggtgcgggcacctgtagtcccagctactcgggaggttgaggcaggagaatggcatgaacctgggaggcggaggttgcagtgagccgagatcataccactgcattccagcctgggcaacagagcgagactccgtctcaaacaaacaaacaacaacaacaacaaaaattagctgggcgtggtggtgggcgcctgtaatcccagctac

SEQ ID NO: 69708 - DNA, 1050 bp, Homo sapiens
gcccaggctggtctcaactcctgagctcaagcaatcggcctgctgcagcctccgaaagtgctgggatagagtcagagtctagacagggtctagacgttacaggtgtgacccactgtgcccagccaattaaagtccatgctttttacactaactctgaagccttcctctgacctcagctattgcttggttagtaatttctctacctaagacatcaggtaacacatatacagttggtgaagacattgtagaggactgtgacagggaagttctgtttaaacttttggctaaaagatgttgaattgtggaatcatgtagcagaatttatttctgtgagaaatcacagatccttttcctgttgtgctctcacttccactttatgtttttggtcctttgtgaaagcctgtgtcttttgatgtttaatgaattaggaggttttgtttttaggtagcagctttcagggccttgaaccttatccttctgcctcctctgtttcccaacagctgatgcttatggctgttctgaactgtctcttcgactcattgagccagatgctgaggtgagcaggacattcttttttttcccctcaagttatgatggaaagagcagggcattgttgatttctttttgggagataaagtaaccattcttcaggcccagggattgtaggggattggcaaaggctccagggagttgatttagttttagaagttgggttttgccgggctcagtggctcacgttcgtaatcccagtactttgggaggccaaggcgggcggatcatgaggtcaggagattgagaccatcctggttaacatggggaaaccctgtctccactaaaaatacaaaaaattagccgggcatggtagcgggcgcctgtagtcccaggtgcttgggaggctgaggcaggcgaatggcatgaacctgggaggcggagcttgcagtgagccgagatcgcgccactgcactccagccttggcgacagagtgagactctgtctcaaaaaaaaaaaaaaaagttgggtttattaattcacagtaattcatgctactgg

SEQ ID NO: 69709 - DNA, 1088 bp, Homo sapiens
gcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaactgcctttgtgtgatgtttctgtttctcttcctctctttttggcagctactcctgttcctccagccccccgtcattccccatcttataatatttcttccctcctacctcagagactcctagcagtgcccccccatccctaatttacggggctgtttgcctccttggcatctctccgtcccctcgcctggaaattggcgccaggggtggggtggggatggtattttctcagtgggagtcccagggaactgagttcttcccccatcacccccaaagccagctgcctgctcccgcctcagccattagtaacccagagacgcgcacctgcgtgggggctcttctccagcccttgctcacttcctgcacctcccactcctgctctgaaacggcgctgagcgggttatttatcggagccagcgctgctccagaaggtcaggacggtggtgtaaa

SEQ ID NO: 69710 - DNA, 1350 bp, Homo sapiens
ggctccaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacaggtgggtctaaggcccttcccaggaattctgggacgctccacccgctaagtggggaaggggagcaaggagcttgagtaaaggcccttcttcagagttttccccagggggccagatgggagggggccggtgcttggagcttgattatactccctcgctgttgcccctttccgggagctcacagccccctatccactggcccccgcagcacatctccagccggcggcaccgagacggcgtggccgggaagcccaacccactactgagccgtcacaagaagtctaggggcgccggggagctggcggtgaggcctggatgctgggaattcagcagtgggagggcgcgggcggggaggagagagggacgcgggctttgcccagggagaggtggggtttgcaggaccgccgggtgacttctcttcctccgcctttcgcccgcttcagggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagc

SEQ ID NO: 69711 - DNA, 1048 bp, Homo sapiens
cagcactacccaaatggagagtggatgaggccaccatctatttcacagggatacgaaagcccatttcctgacattaaccccacccagccagtgaaactactggtgagaggaaaggagagtccagaggacagggctttccagactcttactactttcccccacttcttgttctctcaccagtgtctcattggaaaccctaaagacctgtcacagagatgggctcggctgaggagataaggaccccaagtccccagcaactatttttcacttgatccctccacccagaagataaggttttgtcctaattcagtcccattcttatgagagagcccagccatcccccaatcttcagtctcagctgcattccaggctttcctctccctagctgcctagaggccaaaagggaggagaactgttgagggaggcagttttcacacctctgagcccctggttttcatcccctgatagcagaaagcctcagagaaactcccgtcctctcccttactcatgtgaactcttggcaggagactgcaaagacgtctgctgacccagggtggggacagggatggttcctaatcccgcccagccccacagctctgccctagaaaccctgatgatcagggagaaaaggttcagaagatccctgggctgcctcgggccagcccagctgcttaggtccccccatttagtccccatgattcactagagctcctactctctcctgagttcttttactccctctagaagttgctgcccttaagaggtccagagagtgtgtgtgttagggcgaccagggatccagagttgggaggctgggaacatctgtctcctgggactagaggctgggcttggtgatagtcttaccccagagtggaggcccaaagggctcagaggcttcagctgaaggccctaggatctagggtgctttgggacttcatgtcagaggcctctggtggattggcttcactgtaggagataagtcaaggtgacacagttgtatgttcatggtatgatggaccaaggcaggaatccaggttcagataccaga

SEQ ID NO: 69712 - DNA, 1667 bp, Homo sapiens
tgatcatgccactgcactccaggctggtcaacagagtgagaccctgtctcaaaaacaaacaaacaaacagaagcagccactactaagcaatcagacttggcatttgagttcaaacctatctgccatttctggcttaactggggaattttaaaggcactggtaaaagataccccccatacaaaatcacccccaagtttggtcctcctgggtccattgcacaacttagaggggtagtcctagcctgaattcagaggccacttttgcaggatgtagaggttggaggcactagagtcctccttattacttcttggaataagagctgtggagaaatggcagccatagtacctaaactctccctcttttcccctttatcagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaatctgtgatctcatgttactctttccaaacccatcctggaaccaagcgacttggtggaaagcagatgcctatttctctcatggcttctttccactaggagccagaagtatgaccccccagaaactgtgaaactagttctaggctcccttcttaggtgaaagaggtgatggaaggaga

SEQ ID NO: 69713 - DNA, 1061 bp, Homo sapiens
ctctgtcaaaaaaaaaaaaaaatggatatgatatgaaagcccgaaagtaagagacaatattgtacattttaggaacttcaatttttaagttcagaatgctgttagttcaaaataagaggtggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgggctctgcagatccaatgacaagtgggggccaagtatagggtagaaagaacttctgagctttcattgacttcacccaacttgctccccaggtggccacagctgtgcaatggaccaaggcagaaggcagctatggcgtcccactgtggatcatcatcctagccatcctgtttggcctcctgctcctaggtctactcatctacatcctctacaaggtcagccacatcctgcttgtgacttggccaccctctcatcaggctctgcccttgacctggcacagtcccaagtatctacctctagaccagttcaccagccatgtgcccccacctctgtcctggctacatgcatcccatcctaacccttcctataagatcccccccttcattctatagcccctagcttagaaagggtcctcttgactcaagatgataagtttgcctatacttgcaaaatcattggaacccaaagatgacaaatacgtggcatttgtgctgtcaatttctccaaaaatccatggcagccatcactaacctagaaatggctactgatcatctcctagaagtggcttcagaatctctctcaagaggcagccatggccaggtgtggtggctcacacctgtaatcccaacattttgggaggccagggtgggaagacagcttgagcccaggaattcaagaccagcctgggtaacacactaggaccttgtctctacaaa

SEQ ID NO: 69714 - DNA, 1062 bp, Homo sapiens
gtgctcttccctcctcagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggaggtgagatcctgaacactggcatggggaagaggagcagattcagaggaccaaggctgaggggttggggaaggttgctgggggcctgcaagaggcaatgaggatgtgcctatagctagggttgagggtcacaaggcccaaagttacctcaaaatcctctggaggaaaaaggactttcatccactgtgtttctttctgcctgaactatcccttctttgtttcccggcatacccctagggcccagttatgtgccacctcctctaggaagccttcttcaaaccttttcctctgggcccgaatgcctgttttatagttcatttactcattaacatctaattaaataagtgactgtactgaacactgttaggcccaggaaatattgcaccaaacagaactgacaaggtctccacgttcatggaacttacattctagtgaagggtgatagacatagaaaagaaaaagagaaggagaaaaattaacagggattgaaaggtgatgaagtgaagagttaataagctgtagggacactatttaaattggatcatagaaaaacctcttgaagacgtcacagctgaactgaggcctgaaagataaggttgaacctgtctataagactcagggatgagcattccaaaccaagggaacatccagtgcaaaaacaggaacacagacctaattatttacttaagcatctcctccagtgtgatctccaagaaccaagttttcctcatttccatattttaaccctgagctcagtgccttgcgcataggaggtggacagttggatgaatcaataaagagatagatgaaagaataggttgaagctgctctggaacccaggtgcaagctgacttagaagctgtaatgagatgggaaaggggcccaacactttctttt

SEQ ID NO: 69715 - DNA, 2573 bp, Homo sapiens
ggagtgggcaggggcaccaagtctgccttaaaaaggggaaaatggtggtgtcctagtctgggtctggctgggagataggtagaggataggatgtctgttccagttggattcaccagctttcttcttggtctctctccagcatcaaccttagcttctgcctcaatgcttctggaaaacacgttgctgactccattggtgagggagactgcctggatctctcaggccctaggacagagaatgaagggactggggacctggggacatttcttctctctgaaaagatgaggaaagacaggcagtttccctttatatgtccctggcttcaggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcagggtatggcccagagggcggggtgtggactggccagggagggtggccacacagaactgagggcacctcctgaagggaaaaagactgggggactccagtgaagggcttgggactcttgtaggggctgagaaagggagaccttctgtcagaggagctgggaagcaggctgccagggcctctgaaacaatgaggatggtcggaattgggccctaagcagacaaagggagatgagagaggctgaggagcagggccactaagtctccagagtcccctgactccgtgaactctctcctctggccccagaacgagtcagaatttcgagacaaactctcgccgattcacatcgctctcaacttctccttggacccccaagccccagtggacagccacggcctcaggccagccctacattatcagagcaagagccggatagaggacaaggtgaggacagggcagggagaagggacctgggaagacagaggcctgggtattgggggggcagggccatggaaagagaagagcctacagcccaggaatgggtctaaacttcccctctcaaggctgccctgctccccaggctcagatcttgctggactgtggagaagacaacatctgtgtgcctgacctgcagctggaagtgtttgggtaagtagggctgacggtaagctagggagctccaggtgcacctggcacctgaaaaaatcagctagggacatactagctgtgtcgccttgggaagttgctgagctgctctgagctttaactcctttgtctgtatagtgggaatagtagcatttatttctcagactttttggaaagattaaatgaaataatctacataaaaaatctagcctagtgcctgccatagagttagaactcagtaagcagtgtctattgttactttattattactctttttttttttttgagacggagtcatgcccttgtcacccaggctggagtgcagtggcgcaatctcggctcactgcaacctccgcctcccaggttcaagcgattctctgcctcagcgtcccaagtagctgggattacaggtgcctgccaccatgccgggctaatttttttattattatttttagtagagacagggtttcatcatcttggccaggcttgtcttgaactcctgacctcgtgatccacccgcctcagcctcccaaagtgctgggattacaggtgtgagccaccacacccggcctcgtattactactcttataatggtcctttgtcctggtttgaggattaattcaccaatgtcccttaccctctgtgtcccttccagggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccaggggtgagatgagactctcgagtgggatttgggaggatacccctctagaggggacaccaaaacctgaccagtgcccaccccatctccagaacttctccagcctgagctgtgactactttgccgtgaaccagagccgcctgctggtgtgtgacctgggcaaccccatgaaggcaggagccagtgtaagtttgggatgaaagaggatgggacagagggagagcagacctgagggcggtaaccagccagccgagagcacagctgtgaggtgcggagggagggtgaaatacacagtctaactgccctcttttcctctttttctgtccccagctgtggggtggccttcggtttacagtccctcatctccgggacactaagaaaaccatccagtttgacttccagatcctcaggtagggagtgagtgtgtctaggctggggctgagctggggacggaagggagggctgggcgccattctcactggctgcactccagcacctcagtcttgcctccatcccacagcaagaatctcaacaactcgcaaagcgacgtggtttcctttcggctctccgtggaggctcaggcccaggtcaccctgaacgggtcagtgccaggcaaaatggggtctttctgagaggggacacagacttctagg

SEQ ID NO: 69716 - DNA, 1050 bp, Homo sapiens
ctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatggtgagtaccatgggctcagagagtgaaagaggaggcaggggcccaagtcagaagggatttggggagagggcatctgtcagctaagatacccagacctccacgacttcccgaggggttaaaatcccactgtctgggtcttgggatttgaagattagaatatagggactgacagatgggaaaaaataggatcctaggtcctggggtctggtagtagagattagagcccatggattcctggcctgctgactagtgtgtgttctgtgtcttccagatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctggtgagttgtgcctgaggccccttttcaccttaaaattccctggtcactgacccctactctctcttctgcacctttccttaagttcctgggtgcagttctggctaattccaacagagggcgctgtcttctcacttcaacctccctgagcgttgaaaccaggaggggttaggaagaaaggatcctgatctggggcttgctgtaagaggtgatttcttgacttcttacagatctgattgtggggtcctttggtgtggacaaggctgtggtatacaggtatgagctccaaagggagatgaggggacaacctgggtggactggaactggaaatttctcaacagagctgaggttgggaaaatcaatgcagaggacacacattctggcgcttgggcat

SEQ ID NO: 69717 - DNA, 1063 bp, Homo sapiens
cgattgttatcccagtatacagagaagaagaaggctcagagaggttcagcaggaagcagagtatgaataaagagcagaatgattctgccagagtaagtgccagaacttgaatgccagtctgcctccagagcccatgttctgatccacctttttgagcccttgcaaactgccatgcacggttctttgtgattaggcaggggaggagaggaagtgaggggtcaggctgggtcttacatagccgtaagtgaggttccctttgggcacaccagcaacaaagtctgcaaagagaagagaaagttgtgacctaagggtggggaaagggaagcagataatggtaagtggccaagttcatgggctctctggccctgtgcctctaaccatccccctcccttggccccagcctggggacacactcaccttctgtgtcatcaccactgaattcaccaacagccacagagtatcctgggggacagggtgggtggatgttaggattcctgctttgaggacccctctgctctggcctatccaccaatcccttccccacccctactgggccttcatagtcagcaggcacatgacaagtatggcaggggtgctggggatgcctgagtaggagaggggaggcgagggggtgagtggggacaggagcacttgaggttctccctctgccatcccttccccacttgcttgctcacctaggtagctgtcatcatagatggaactggcctggcgagtctgcagctgcccctgaaccaggttgatcaggtactcggggtaataagattctgcaatctgctcctgagtggcagacaggatctggcctggagagagtatgaagagggagtagatggagaggaagtggcagagggggcttgggactctgggggctgactgggtagtatttcagaagtctggttcaagaaagggaagcatggggagggtggtggcatgtaagcttcaggaaaggaagaggagaattgggagtagggtgggaggctatgtgccaggggacttaaagaatggcagaaacaggcagggcgcggcggctcatgcctataatccc

SEQ ID NO: 69718 - DNA, 1056 bp, Homo sapiens
gcctcagcctccctagtaggtgggactacaagcgcccgccaccacgcccggataatttttttgtatttttagtagagacggagtttcaccatgttagccaggatggtctcgatctcctgacctcgtgatctgcccgtctcggcctcccaaagtgctgggattacaggcgtgagccaccgcacctggcgcttttctcattttttattaaccaaaaacatctatagctgccaatcagagtttctgaccagcatgagataaccaggttcccacataagttgatataattccagccaaaagcaaatacacttgaggttttaattagcctaggccaccttatctggtaaatgcatgatttccgttaggctttctgaaatattgaaaatagcacacggaccctccattgttaccttcttagacccctaaaagtgcccaactgctgcaggatttaggaagcaggaaaaagatgtgggaaaataaggacaaactagcttgcatgccatccatggcaccagtcacctcacttggcgtgttggcaggggaggcactatttattggattgactttaggttgctgggatggaagggccactgcctgtccaggaataagccatgggtagtgtgccgggaggaaaggaggcctaggtctgtgtcccttgcctgcatgccaggtatcctgaaccatcgcacagccggaatggatatgcccctggcttgtgggctttacaagctttgtaaactctctgtcttgcaaccctgctaaactccaggctacttcctcaggccaccccaggagtgtcaggctcagctcctctccaagagcagtgggtgttggagaaattggcagcaggaatagggtcccttggccttagccctgtgctccaggaaactttgagagaacctcttcttcacccagaggaagagggagagggtattgcccaagtccacagttagtgcctgaaccagaactcttggctcctggtccagtgctcctttcactgcttcctgtacctctgctgttctggtctagttcaggttggtggccctttctgctttctag

SEQ ID NO: 69719 - DNA, 1449 bp, Homo sapiens
accagcagttcatgttggttgaatttataagatgggaaataatacacctaagttttgcagaagcaagtaaaaattgatcaagtgtcctgcctaagtgacacagtagcaagaatttaattgaagaatataaacacaagcaacataaataataataaacgtgcctactaacaatcaaacacagatggtacaacacaatttatggaaaaaaacagatgtaaagaagtgctttttccaatcaagagggattggctgttccacgtgtctgcacagcgatacaaatgtgctcgttttggggcccaataaaaataataaggcattctgaacaacatggtatgttcataaaaaaggaaaatcttccttctgtcttaagcaaatgacttgagatttagacattgtgaagaaaaagatgtagaggcagctcacctttatcccagtcttcatcgcaaggagggcactgccaagtgctctcagccagagtctcttgtctaaggctcctggtttggttgactgcaagacaataaagattggatataagagggggatattgccaagttattgtgttcaaaggggctagtagcttaaaaggttgcaagggtagcctgttgggtctttatttctgaaaaatggatagtataaaagctaaaagagggatcttatctctttgctgacagaagaaagaaaagcagaaacaaaaatgtttaccatatttatggcaataaaagatttatttttagatgaattattagtaaaatgaaccaggctgttcaggagagaaaacagtatgacatgtacaatctgacaacctattgctgccatgatacaaatctcaaaggtggaaaagtattgttcttctaaaacactgaaagccaaaaatcaagctgacaatctagcataatacaaatctgaaggagctaccctccagtactgaaatattttagatactaagtcttaccaacatcttgctcaatacaacttctgtcatcacagcttgagatatgatgactaatttcagctcgaggaacctggtggcgagcattgaagggacaagtagccaatttgcttgcaacatcaggatgattctgtggaaccaaaattaagggatctgtcagttctctggatctactaaagtcaacagggagtagctaagccttattctacaaatgcctcccctaaaattcctcaataaacttctggcttaactataacaagtaaactcagagtaaaaaactaagagggaattatttattgtttttatagacaattacttcaaaatcatcaaaacataagtctttttgttatgattgtagagactgacaacacagatattgttagctaaacaatgaatttaggattgggtattggaacgacatctttcccccatttatttctcagagtcacatgattcaggcagcacagcccgtaatgagagagctctctggatgtctttga

SEQ ID NO: 69720 - DNA, 1024 bp, Homo sapiens
aataatttttcttgggctaacttctagctgttcaagctctaaaatttctaaacaaaataatcagaaaaagtgagttatagcactcaatcattgttaggctcatgaatacatcaaatttagaagataggcaggatttctcattgttagccaaaattagtctgttttacaaagggtgagaagactctagagatgctgtttataaagggttctttgtcactagttaatgggaagaaaaccaaaacaagaaaaaatttatcctaaggaatgaacaaatgcctttctataaatgttggtatttaagagaggtagattcccaaaacaattctggcaatcaattaaaacatgataaaattatttgatatttataaaatatggccttttaaaagaactcaggagggtgttagagggcaaattatgaccctacctttctgcacttgataagatgataaggaaacctgcaagccctgatttgatggtttttgtcataggggcattgcaatagcttctcagggtccagggagtcggctgaaagacagaagtgtttcagtaggtaaaacgataataggcccttgtaaaactacagcattccaggcacactggattttttcaagagactctgtaataatagaacaatatagtctaaagaaaacttggattaaaaaaaaagggtgactacacttttaaaatatttctgaatcttagtaagttcagcagaaccagaaatctcagggtgaagtctcagtttcatattgaactgaacatattgtttttgttgctggttactcttattataaaacaaaaagttaaataaaatgtcatcctcttttccttttctaaaagtgctaattcagggttattcctattctctagctagtctatccagagcctcccaaccagtatgctgcagttgaaatggatttctagtgtgctaatacactgatttgggggcccacaactagttcaagtcatcccctaccccccatttccacaggcaagttgggggtagtaatagcaagtaatagta

SEQ ID NO: 69721 - DNA, 1054 bp, Homo sapiens
tgtggtggcgggcgcctgtaatcccagctacttgggaggctgaggcaggagaattgcttgaacccgggaggcggaggctgcagtgagccgagattgcaccactgcactccagcctgggcggcagagtgagactccgtctcaggaaaaaaaaaaaaaaaaaaaaaaaaatggcgcctgagggaatgggactgatggaactggttagaggtggggagctgcctagaaagaagccttgtttgtggaagttgtctagatagaaaggtaatttagattttgagggaagagaagaggaattataaaggagatacgcagtgcagccacaaaacaatcaccaaggacaggaattttgtgtctggctgttcttgtttagaatgtgttgtaaaatcccaaaattcaaaaggcactaactatctgagaatgcttggtaggatgatggttgttgctgcctgatgaaagcgagttttagagttggggagagagctcaatgaagagttggagaggacaagaaggccggaaggttacaacttgttaagggaaaaccaaacgtagtgtgaggctttgttctggggaaaaaaagtgtaagctgcagttcttgtccccagagtgcttagaaaaacgactcccaaagtggatgaaaggtttaatagcagtacaaaaaatgccaaaaaaagtggtagagactgtaaattcctgtaaggaaaaaaattaatggggcctgaaatgacctgggaaggcattatagagaaaagggacttgtagcctttgaaggttagacaaaaaaaggaaggtgttgacactacaagtagatctggtggtaatatttttcaaaaccaagaagtaaaagatatgacaaaacattctgtgctgttcaagatgtaggaggcagtctgggtgattagtctgggcagtgaaatattgggatttctacagcatttcagtggtgtagagcccaaataggacttgagaggactaccctgacaaaaactgaatgtagctttagtaaaaaggatcagtggggcattttctttttcttcttttttttttttgagatgga

SEQ ID NO: 69722 - DNA, 1011 bp, Homo sapiens
tgggcaacatggcaagaccctgtctctacaaaaaaaaaaaaattagccaggcatggtggcatgctcctgtagttctagctactcgggaggctgaggtggaaggatggcttgagcccaggaggcagaggttgcagtgagctgagattgcgctgctgcactccagcctggtgtgacagagcaagaccctgtctcaaaataaataaataaataaataaataaaaaaaataaaaaaagagctccaggtatccagggagaaatagtggtaagagataaagaagcagaggcagacatagagatgcagagatagagacaaacacagatatcaagaaggacagaagactgcttcagagttggaagggaccttaaagctcatctattccactgtggaatacctctagatgtgtgctgcccaacatgggagccaccattctgggtggctattgagcacctcaaatgtggcaagtatgaactgagatgtgtacataaaatacatgatggatttcaaagacttagaaaaaagaatgtaagatattcatatatatatatatatatttttttgttttgagacagagtttactcttgttgcccaggctgaagggcaatggtgtgatcttggctcactgcaacctctgcctctggggttcaagcaattcttctgcctcagcctcctgagtagctggattacaggcatgtgccactacgcccagctaatttttgtatttttagtagagatggggtttctccatgttggtcaggctggtctcgaactcctgacctcaggtgatctgcctgccttggcctcccaaagtcctggggattacaggcgtgagctaccgcgcccagccgatatctcattaatatattttataaggctgggcgtgatggttcatgcctgtaatcccagcactttgggaagttgaggcagcctgattgcttgagcccaggaattcgagaccagcctgggcaacatgatgaaaccctgtctctacaaaaaataagaattagctgggc

SEQ ID NO: 69723 - DNA, 1017 bp, Homo sapiens
acacctctgtgggccccacttactctactgcggttctcaactgtctcaaggtaatctctgggtttttgggaaagaggagaaagttaggggatggaatagccactgggacttctagaccctgtttatggcattatttttgccttccttttttttttttgaaatggagtctcgctcttgtcactcaggctggagtgcagtggcgtgatctcgtctcactgcaacctctgcctccctgcaagcgattctcctgcctcagcctcctgagtagctgggattacaggtgcccaccaccatgcccagctaatttttgtagttttagtagagatggggtttcaccatgttggccaggctggtctcgaactcttgacctcaagtgttctgcccacctcggtctcccaaagtattgggattacagacgtgagccactgcgcccggcctgccttcccttttaactgttgttcccacatttatcaaaactgcttttgcccagtataggagcaaactcctgccttcctgtctctcccatactgagagatatatgggaagaaagaggcacactttaccatttctttgctttcctatttaccaagactttgtactcatgggaagtccttcttgaagtctaacttcaacccttgctgctgctggaaagccacataatctattgtttctccatagaacctggatctctggtgctttgatgtcttttccttgaaccaggcagcagatgaccatgccctgaggaccattgtttttgagttgctgactcggcataacctcatcagccgcttcaaggttgggcagcatcctacctctacctccaggcaggattctccactcctctcatgcctgttctaaaagcctcccaacaaacagattccatagatcccctcactcagtctcaacatcagggaagtctccccatgcccacgcccagcctagcctttctttcacttgctgcagtcttagttccagacttcattaattgatttctagggggagattctcggtctgcaa

SEQ ID NO: 69724 - DNA, 1042 bp, Homo sapiens
gagggtggctggggtagccagatatcttggttcaggaaggcagtggtagggagggatttggactcacagagaggaccgactcacagccatggtggggtggtggggaggcagactgcttcaagcttgggagtccctctgccgtcagggacagaaggatgggatcagaagggtgtgacctgtacctatgctccccttcaccatatttttgtttcttccattagctgtctttctgccttctggctaatcttgttttaattttccttctaccaggagggaagatgtggagagggaggggtgaaatgagggggagagggacagggacttggggaatatctagtagaggaaaagaggaagatgaagttccctgaaccttctcctggtcttccatgtcctgcactcccagggctaaggtggttctggagtgggctggggcttacctcttgcggcttttgggggttctgcttctagctttcagtggcgccagccctctctggatgtggaagtgggagaccccaaccctgatgtggtcagctttcgttccacctgggtcaagcgcattcaggagaataagcagaaatggaaggaacgggcagcaagtggtgggtaccatggcagagggcaggggtgagaacttgtgtgggtggatcatggagcactaggaggtccatttttcttaagcccctggggaaaccctttgccggactccttgatttgggagtggagctgatcagaccagttagatcacaggaaagactggctgagtggcctggaatgttctaagaatgggggccgtagagatgatagagacagtcagatattccacaacccaagggtccctgtgcacactgtggtccctgtaaatggtgcccctgtagatttggctaatttggtggccctggctgggaaatctcttcctgtgtgagggggtggtagggtggtgttgagggttctgagttttagcaaggctggagaggctcttcccaagtggggatgggttgaatgtagttcagcttgaaggcaggttgatggatgagaatccctt

SEQ ID NO: 69725 - DNA, 1044 bp, Homo sapiens
ctgggaatggggtggagaggacatcctcttcaccccagaattgcgctgcttcagccccatctccagcctgatcctctgaatcttccttccctccctttctgatacagtgactggggcaaaaggagccattgtgaccaggggctgcgggaggcctttcctgggaccttccttgggactggtctgggcccctggggcttgtcgcctgccctgagtccggagccctttgcctccttcctctcccctggggctgggaggctccatccgaccaatgtctgtaaagtgctttgaggatctccccagcaaagcaccttcagaatgtatcgacaccagctgggttagggtcaagggtgcctggggagggtgagtaatcctgcattgctaaaagagagggtctgtcccctcctctccacgtcccagaactggcccagctgcaggcactaagaagctcctcccctgagacaagtgaggggtagtcggtgaaaggcagatggacaaggggctcagggctgctgccttcctgtcctctggagagaacccagccaggcgcggtgccccttcctctcctcaggctcctccttgcccccaccttgccccaggaaaggccaaagtccaggtgactgccctccttctttcttgtaaataccaaccatgcatttgtacagtgggccctgttcatgcgaaatccacatccatggtctcctagacctgctaccctggtacttccaccctaccccaccccgagaagggcagagacgcatgtgactcacccctgcccttggtttcccagacccctgctatagccagagaacaataaagaagggagaccaggcctgactgtgtgtgttcactgggtacaagttgaccaagcatcttcacatacatacactctttccagcatgataaaatctgggtgaggcgttctccctcatatatatatatatatatatttaggtatgtatctgggcaagctgaggcccaggaggaggccccgagggctcatagtagctgcatggcagaagtgggacctgacgcttctcaggctct

SEQ ID NO: 69726 - DNA, 1053 bp, Homo sapiens
ggctagattgcagaatattctttgcttttggaaagatggagcagttctaggaaagggagggagaccacctggctcctaagccccccaggaattggggtggtcaactgagtgctggttgctgcgacaacagccttccagatttctccagcaactgagatgctgccacccccacccccagaggcagtgtcagctgtgagggggagggaccgcctccaccagctcttcacagcccccagagggggaggggaaggttagaagcagctcagggagcagctgagattctggtcaccagcatccccatcgaggtctggggagaaaacaagttctcagagaatggtagagagcttgacaggagtatggaagcgagggggacaggctaagaagctaggctggggttcaggatgccggggtctccagcttgcctccagctataccttccagaccctgcacagaataaattgactgtcctctatcactgttccctcctatgcagggcttagttctggctgaccctggggtgggggaatgattggaaagagaaagagacatggatacttcagaggaggaaaaaaagcaaaaagactacagatcctgcctttggggatctccaggtctgaggcaaagatgcagacgcaaattgaccacagagccaaggacgggactagatgcagagggatggaggcagcggaagcacaggagaggagcttcggggaggaggtctggggcagccatgagggccaagagcctgggggcagatgtgagggacagatcaggaggagcatggctgcagaatcccctcccctgagaagtcagctctatggggatccctggtttcctgtccttatcaccctctcctttccctgttcccttcagagatagatgaagaccggatccccaacccacatctcaaggtgagctggcccatcccactaagcccagcccaaaaaacccccacattcattaggggattattccttaaaaccctgccgcccatctctaggatctttttgactcccgcttccctgtacctctaccccccaaatgtgcatgagt

SEQ ID NO: 69727 - DNA, 1075 bp, Homo sapiens
cactctgatgttatctcaacccactgatcgccactccaccctccttgtctctttcctactaccaccaccacaccctgcccctccaggatggaaagaagtagaggagtcttctagttgaaggatggcccccaccccatatacatgaagcagatggtccccagcccatgtgtatcaggaatgaccagagacgactcacagttaatgtctgtgcggctcatccatgtgcacacttacacacatacacaaaggactggtactgcggggaccttgcaatgtcaccaaaaacagatgccactgaattctcctgggaaaatgatgccctacccccacatacccccattctttgcatcctgtttcttctttggaaagagttcccccctcaggcttaaacagcccatcttaccatagccagtaccccccacttttctgggcatagagaggggcagtgttcacctctgtcatccccccacggccagtggtgatgattctaaataatggacatgcaaagataagggtttgatcattcagtgtcctcatcctactcctctcagcccaggataattctagcccttttcccagccccatttgccttccctccccactgctaacctagagggtcatcctctaacccccatccttccacttgcttccaagcctctaaagcctccagagaaagggggaaaactacacctcccaggagtccttgaactgacttcaacaacaatcaactttattggcagcgtgacaaaagaacaacagtggggggaaagggggctcagaggcagggcagtcagtcagctttatatgttaatttcttagactaggacctggagcctaggataagatttttcagctacgctttgggccctgaccagggtcctgcctagggctcctccttgtattgatattatatctaccatgacaaggattcccccaaccccatttcttgacaaatcagaaaggcaatgtatccaaggacagagaggacattagggagtgaggggcacaggccagaggagatgcacgttcagatcctcctctgtgctgtcctcccaggctggggggcgcttgaaaa

SEQ ID NO: 69728 - DNA, 1026 bp, Homo sapiens
agggtttcactatgttggccaggttggtctcaaactcctgacctcgtgatccgcccacctcagcctcccaaagtgctgggattacaggtgtgagccaccacgcccggccttgcctctcgtctttaaacaataaggttcaaagttccgtgggagcacaaaggagacatgatgaggacaacgggagtagggcctgagtttttttttgtttttttttttttaagcgttttgctcttgttgcctaggctggagtgcaatggcgagatctcagctcactgcaacccctgcctctcaggttcatgtgattctcctgcctcagcctcccgattagctgggcttacaggcacgtgccaccactcccagctaatttttttgtatttttagtagagatggagttataccatgttggccaggctggttttgaactcctgacctcaggtgatccacccgacccggcctcccaaagtgctgggattacaggcatgagccaccacacacggcccaaggcctgagttcttagcaggagtataaggcgcctaagcttagtctaccttctaaggaagcctgcgtttgtcaccatcactcagcaaataacctgaatgtctcctgtctctcagccttaatttttcaggcagcatcatgggacacatacttttagttttgagacaaggccttgctctcacccagggtggagtgcagtggtgcagtcacggcccactgaacttcaaactcctaggctcaagcagctcaagcgatatccgcctcagcctcctgagtagctgagaccacaggcgcgtgccagcatgcctggctagtatttttttacagatggggtcttgctgtggtgaccagacttgtctccaactcccggcctcaagcgatgcttccgcctgggcctcccaaagtgttgggattataggtgtgagccactgcatactggaacacatactttatacttgaatttttttttatccccttccctcctgctccttacctatacttggatttctacatctgtgccagggcagt

SEQ ID NO: 69729 - DNA, 1026 bp, Homo sapiens; identical to SEQ ID NO: 69728

SEQ ID NO: 69730 - DNA, 4891 bp, Homo sapiens
gctctccagccgccctggagcaactttgcttcgaagttccctgggcccgggcagggtgtggcgggggtgctggctgcactttttttttttttggtgggcggggaggtcagagcccaggggaaaggggctggggcgggggtcggggttgggctgaagaccgtttctccaggctgggtgttgggtggggaaagggtgtttgacgcccggagactggcgggccgagggtcggcgtcaggctcaagcccctgccggcgcccttggatctgtcctgggccccagaggcggcggggcggggtccgggcttcgcggccgtcgcccccacccctctcctgcgggtaaagagggggctgggagacgtggatccgaccgcgggtttccgggtgggaggggccgggaatcggggccgtgaagggaagccctcgagggccggccgggagcccggaaaccgaggtcccccttcggccagttttaatccccccgccctcccctctgccccaggcccggcagccatggcggtggaaggaggaatgaaatgtgtgaagttcttgctctacgtcctcctgctggccttttgcgtgagtggcgaggggtcctggggggcgcgccggcagggtgcggggagacctggctccacagtggtgagggctgagggaatgagaattaaggcagctggagaccagatgtggaaagaaagccagggaaagacagcgcagccactccctcctccagttttcctggacacctgaggcttgtttccaccgagaatggccatcctgggtgtgcagcaacccctacccccatccctcctggcccttcctgtctggtgacccaaccacttgtgatatggggcagtggggcaaccagccaaccgcctgatgctatcgccatggggcttcccttcgctctcccttctcccctctctccctccccaaccctctcatccctgtccagcccctctccccctttccctcctcccagcgcttgggggtgaggaagggctctgcccacttcaatttgctcctgccctgggctcctggcttgagaggctactgtttgtctagggagggacacatcactcttgctcccttttcctcttcccttctcctggcctaactggccagaggaaccttagtcacagctgatgcgcgcgtgggatgtgcactggaggatagtgagggggcagttctgggagagaattgagctgggagccctggaggcctgtagaaagcattattctaggtcagaaatacgtgtcttgaggtcaaggctttctgggaggtttttgaatttggtcatgtccctgattaaagagccgggaggggatcaggggaggtaggggcaggcaaggatgggtcatccccctaccccacagccaaagaaattccctagaggtgtgagaatctctcttccggatggggtcaagtctgtgtcctaggtgtaccccctgccctccaccatggagggccactgtgttgtggatatggcctaatcctcacctgattttctcttaggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacggtgagttgggggcgggaccaacatgggcggtctgggactgccagagcagcttggttcgggctcaggaaggtgggtgaggtgggtgggtgaggaagacctttgtgagtgtccagggaccggctgtgccaaaacgggcccctgtaatgcatagactccaaacttgacttctgtcctttgctcctgcagtttgccatctttctgtctcttatcatgttggtggaggtggccgcagccattgctggctatgtgtttagagataaggtaagcagggaataatgggaagggcctgcctcagccgggtctgggaccctggtgcttgaattctgactgcaacagtgctcctccgtactctcaggtgatgtcagagtttaataacaacttccggcagcagatggagaattacccgaaaaacaaccacactgcttcgatcctggacaggatgcaggcagatgtgagtggggttgctgggagcaggggtggtgggaatagagaattctcatctccaaggctgggtgtggtgactcacgcctgtaatctcagcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaattctcatctccatattgaaggtgaaggttcacttaacaaccttcttctccatatttcttccctcccccagtttaagtgctgtggggctgctaactacacagattgggagaaaatcccttccatgtcgaagaaccgagtccccgactcctgctgcattaatgttactgtgggctgtgggattaatttcaacgagaaggcgatccataaggaggtagggaggagactgtgtatgggacttgggaaacctgggaaatgttttagaatgcaagagacccaggatggaggtggacagggtcagggatggggaggggatctggaaatgctaagggtggggtgaaaggtacaggggcagggaagagactgatggaccaagggagggggttggggtgggaagtttctgatggtgcttttgtcctttgtgcctgccaccttcagggctgtgtggagaagattgggggctggctgaggaaaaatgtgctggtggtagctgcagcagcccttggaattgcttttgtcgaggtaagagataaccctgagcaggggctgggactctgtccagggtgcctggagggaaggggctgaggggaggagggtgctgaacaggaggtactggcctgggagtgtgtgtttggagtctcttgcatgggtctgaggtagctagcccttctgactcctctccacccctgtccccatctttccttctaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttggggggtgtttgggaaaggaggactttgcgaaggtgttggttgggcaggcagtgggagaagtgaggatccagagactgtggtgctttctgccccctagtcttatgctgccaggctcactatgaacattcatgaagccatctgctgcataagtcaaagcagctccccagaaaggtcccacctgcgagagcccagcccccatctgccttggacatcttcctggccttctgtgcaccgctaagggcccagcacctcccttcctggccaatcctcaagggatccagctcctttcgaagtatgataagttgccttgacacctgtgtggtcagtgtccttagcaggagaatttatgtgaatattgccttttcttccatggaagccacccagcctggcccagaaccctcatcacctgctcttctcccccaagaaatatgaagaccattcccagtacagacactgaattgcaaccttactccccttcagaaaataagggaaatgtattaaagtgccctttgatggccactccccgacgtgcagctgtagatgtgaggcagttccctggcgccccactgtgggtgctagctgttttgcagggactgaacaggccagagaccgtgagcatgtcggtttggagtagttggcacttaaatggggtcagccttccactgggcacatttctgcccaccttctttttattttttaaacaatacacttttgttagtgcttattttgtggcaggcaccaggcagtaccagggtgggggcagaaataaatcaaagtccttgtccttgaaaaacaatctcttgctggaaggctggattcagtagactgcttgggcaggcttgggaaggacccaggtgagcacagcatccaccaggctggctggcaggtaggaggcaggcagccagagcagcttggcatcccaacctgggctgtagcgggttcgggggtgtcgagcagtcagggcatgctccaggcatcggctcaccttggttaggtccgggtcacagatcaggttcatgatgcgctgttgcattttcaggtctgcagccccataggtggttgcaatcagtttcccttcctcactccagcccatcttaggtactgtcttctggggccctgggcttgtcaccctcagtcccctcctcagtgtggggagtgggcaggttccacatggcctgggcactcttgtaacatcctgttcaccctcaaccctgccctgggtgccccacccacctcctagcaggcttatgcaggactggcctttctggtacttgtttcccttcatgtgcccctgtgtgggcctggctactcacacttggtgaggaaggcccccccatagtgggcctgtgtggcaggaggcagccgtgcccagcaggcctgcagggttttctccagactctcca

SEQ ID NO: 69731 - DNA, 1035 bp, Homo sapiens
agcttagtagagaatgcgaaaatagtagtagcttctcaataaatgttggtttgtttgtttcctattttcacattctctagttaatgctcagcactcatgtgaagcaagaattattattatctgtatcacactgagaagtttggtgagtaaggttagatagtggttagtaaggaatcaggcagtgattaaacccacttcaattatagccaaagaacagaatttagatgccaggaagaactttcaggcacttgcctgtataatttaagattgggagtttagggagttcattcaccatgtatttattgagtgctgtctagcactatgggaggcactgaagctacaatggtgagcaaaacagacacagtatgaataacaacagtgtccactctcatggagattagtacctaatggcaagaaaatagacaattcttatgctgaaatttgtaaagtatgctatttgggatgttgcttgtcactccccatctcactagtagcttccctatcccagctacttctgatctctgaattctcaccccccaaaccctactccattgcaccatcactgaagctccagccagtaaaataactggactaccagggccctgggacctcagagaataatcaagaaaaaaaaaagctatagagactttgggtatcatatcctgaatatatgaagttcattaagcactttctcctcatctcccttagaaggtcctctttctcccagggtgggggtggggaagagctgacaggacaccctaagtccatcctgattttgcagaactcaagacatggggaggatacttaaaggcctagacttcctaaccctgcttatatggctctggaagctcattcctgattcttcctatctagagtcaggatagacatattctgtccaatggagacatgttgtaggacactcccaactgacttaggaaaggcagtgaagaggagctggaatggaggcagaggcagatatttattgagaatcatctattagacccaagaaggatcaatttaaggtccagagcaagg

SEQ ID NO: 69732 - DNA, 1051 bp, Homo sapiens
ctagctctccttcaactcaccatctctaattcttactcttctggcaacctgatccctgtcagccccttggcccaacgcctcaacagccagtttttttgttctcacagctcttccattaactgacacctttaccttcaaatccagttttcagctgttgtctgatttggatccttgagaagtaatagttgccaccccactcctcacctcctcctctagaatcagctgctgaccccagagaagtaatgctggtccccaacctccttcacattccttgtctaccttttccaatgtaaccctatctcctcagggccaggttacacatatccaccacctcaggccccctgctcaccagcccctcggctcccggccccagggaggtgacagccaggtctgtgccactgggatcaaaggcgttgatctcgatgccccagttgctctgtggctggcggaaccagctgtgtagcacttgcttgaagtcgatgctctgccaatggcctgagcgtgagtgcagctcaatcttcagtgagcggatacggatgtgacgccggcctccgccccctccccctgcggtcccttccccagttaggggttttagtcgcaagatctgcaggtagactgtggctgggcggggtacaggccgtaggtacacccacagctgggccttcagtacctttgtgaacatcaccttggggctgaagtgaaaatggcagcagagagggctgccatctgtctgtactgctgggtccgctgataagagagaagggcacagcatcagcaaagggtgtttgtgtaggggatcagtagtcctgggtggcactggcaattttggacttctcagcctgattttccagttcttctttacccttctcccatgcctatcttataccatgtctccggtacctaaaacagcacttcctctttaggatgatggccctataaggccttactgatctgtgtccatttcctaatccatttgccctaatatataggttcctgtctaccagataacctgcaaaattattcatccaccaccatccttactgtccaactt

SEQ ID NO: 69733 - DNA, 1005 bp, Homo sapiens
atttgaccttggagggaggtatctgttcttcacttctctgttcctttccttccaccaaggaaatgtgagtggtgttgatggccgggtgtgtcttgtccttcaggattggggcagaaggaaggatgaagaacagggccagagaggcttggggttagcatagctgctatatgggtgaaggcaagctgaagagcctaacagccctgcccattcctctactgaaagatcttgtttcactttctcactataagaataggaataagatgttaaagctcaccaacatcaccttctcaagggtggtcacatacctttgccccttccaccaactggccaagggggagagtcatgctcttgggaagaatgagccatccagttttgctcaccagcttgggctttactttagttcagtactgtttttatcagacccgtaactgctggctctacttagagtgacagttttgctgaagattcttacccccacctctcctgacatcctctaagctcttgcctggagccaagaggcctggtggtgaagtaaggatagggtgtggatcaggagattctcaactccttggcttctaggcactgtccagctgggaggcagaggggaacttgtactctgaagcctgtgactcctcttaagcctcacatctcttcaccactactctggtgccctggttatctgtcccacagcgagaggtattttatgtccataaagtgcccgtggtaagtgctcagaattcatctcttggctgtggcgggtgctgtcatttctcattccattgaggggaagaaactgaggcacagtgagtccagaggagaatgggtcagggttgtgggaggaatgaatgggcctagctagtgacttgaaatggcaaccagtctctgcctgcttcctagccttccaagcccgggagtctccatccttcccatcctctgttctaactggccttgtcagatgcttttccccactgtactttcccctccctgctgccaggtactgttaga

SEQ ID NO: 69734 - DNA, 1162 bp, Homo sapiens
tgcgatctcagctcactgcaacctccgccacctgggttcaagcgattcttctgcctcagccttccatgtagctgggattacaggcgcacgccaccacgcccggctaattttgggtattttagtagagatgaggtttcacaatgttggccagcatggtctcgaactccggaccttgcatgatccgcccgcctcggccccccaaagtgctgggattacagatgtaagccactgcgcccagccagctttccttatttttgaaaaatgtgagtcaggcaatattcttttgccattcccaactcatattcctggggaattgtgctctaggtacatgggaaaaatttttacagtgaactgaaagaatatttgagatgctattttagccactcttgtgtaacaaggcaagttcgttggctatgttggtttagatttttgtcaaacttcgttgaggaaacctaggaacagggactgcaggagaataggacactagctggatcatctcaagagaacctttagatcttccatactagctggatcatctcaagagaacctttagatcttccattctgtggaggctgggagaggggtcttgttgtctttgggactgttttggctcaagcttttcagagaggggttgttctaggtacccccagtttcctgtcctctttccatccttccttggcctgcatgtcccaaaccttataccaccatgcccttagtgttttctgtcttgctccaggaccccatcttcttagtcattgaacacgaggtttcctgtctcagatcctcttcacctccggttctccaaggtgtaaatgtggcacttgattagggagaagagctcagcactgaattctaaactctttgaccgcttttattttttttttcaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaataatgatatgttca

SEQ ID NO: 69735 - DNA, 1053 bp, Homo sapiens
tgtaacttgagagattatagattcactaatggtttcttcctgaatatggttttaaaaagagaaaaatacatgagggaatagagcagatgctgattatgaagtggaacagtggatcttttggaagttttcttcgtctctttatcctctataaccttccagaaagatattcagccttacttgccaggattctcttcttgaagcctaattattctcctcactcatcttacttcccctagatctttgaacagtgttttccaatttgtgaggatttttttttttttcttattaacctctttcatcccatttcagcagctgttcctatgttggtcagaagtctctaacctccaagccagatgaagtcctccccttcctatctcattatagtcattctccacatactctttgagcatgaatagttcaggatgcctttttcccaattcagttttaaaatagtaattccgtttggagatggaacagacattgaggcttgtaattgtttacctgagatcttagtacccttccttcctctccccgtttccctactatagttgatccagcatccagatgtggttaactgattccaattcctgaagctgtgacattctctgcatacctggaagctcttaatgagggagtctataaaagctgtggggagaactagcttcctcagctgtaaatctgtacttttttatggttctctaggattattctttttttccactctcactctaaactgcccagccccccaccccacctcttaagaactgctgaagatagaggctagaagcttctgtgaggatgagggctataggaaggaaggtgtgaataagggcaggacttcttggtgttgagctgagttctcttgctgtgtctgatatgaggagtgagggaggaacttaagggaggataacttttttgctgttctcttatatgagggcctctggcaatgccacttatttctgattattggaatccccccaaaatttaacctccccttctcttgccatatctagacttttcttgtttttcccttccaaagggatttaaaattac

SEQ ID NO: 69736 - DNA, 1019 bp, Homo sapiens
ccttaatttaaaatttctagttataggctgggcgtggtggctcatgcctgtaatcacagcactttgggagactgaggcaggcggatcatgaggtcaggagatcgagaccatcctggctaacacggtgtaaacccgtctctactaaaaatacggaaaaaaaaaaaaaaaacctagctgggcgtggtggtgggcgcctgtaagtcccagctactcgggagactgaggcaggagaatggcctgaacccaggaggcggagcttgcagtgagctgagatcacgccactgcactccagcctgggcgacagagcgagactccatctcaaaaaaaaaaaaaaaattctagttataacctgatgactctttcctctctcttttttcttctgaggacattgagtattttaaaataaattccattatgtttatagaggagtacgttcttaagggaccagcagcaaccctgtaactaactacacttcatcttgctttctaaattcctatctctgtttctgtgtgtttgcttttcatctctggatttcatgtttctctctcacttcaatacctctggcctctctcttctaatagaaacacagatactcctctccttacaatgggggctatgtcctgataaaaacccgtcttaagtcaaaagtgcatttaatacacctaaccttctgaacatcatagcttagctagttgaccttaaaaatcccagaacacttatattagtctgcagttgggcaaaatcatctaacacaaagcctattttgtaataaagtgttgattatctcatgtaacttattgaataccgaaagtgaacagagtggttgtatggatacgtcaagtatagtttctactgagcatgcatcgttcgccgttgtaaagttgaaaaatcttaaggcaaagcatcataagttggagaccatttgtatgttcaaaatcacttgctaaaggtaggccacacatttggctccaaactttatggcagccagtagaaagggaaagcacagttgcactgtttat

SEQ ID NO: 69737 - DNA, 1605 bp, Homo sapiens
gagatgcaattcctggtgttctctaattgtcgtgtaactttaaagttcctagcaccctaccagccctagaaagttgatactgatctcacacttgaaagagattattgagagtaggttaaggtggttatattggggaggtgtgttatgtgtatatgtgtggatagtgttggagtgtctctaccatattatttgctaaggcggtgtacttgctgctagtctggtctctcaccttcatctacttaagctctgtgcattgatttttgggaccaccctatgttctgtcgtctggttggcataaaggctcgggaataaacagtttcagaaactggggcaggggaggtgacagctgtgtttttaagcatccaagtgtttctgagagaataaccatcagttgctgtcattcatcctgagagtatgaaattggaagctcgcttaccctggagtgtttcataacctttacctctgggaagtcaaggccgtgtcatcattaatctaccatcgcctgaaagcccccaggctctgcttttcatcctgccatcagtcacgtggcactgagattcaggctccctcttttcctttttgccatgctaccttacattcctttggaaatcagactggcctgagaactattaacatcttagtatggtaactcatttacaaaggggggcagttatttgttatttttgtgaaatatgacatcttagctctctgtcagcctctcttccatcactctagggaaaagacttttgagggggaaaataatagcagtacctgagctcccctgaaatgcttctttctgcttctaaggatttttctgactggactctttagattggaatttctgcttctcacacatggtataaggagggatgataagtgagtgagcttgttacacttgaccaggaacagtgcctggcttggttaattcttttggtcgcagagaataacgatgtttcttatttgaatccagtgaaagtactcatgctttgtgttcttgggaattactgagttcaaattcctaatgatgcttgggttacactttgctttgtttctcctagtttctttttatatgatccggagtggcactggtaataagattgaagaaggtgggccgggcacagtggctcacacctgcaatcccagcactttgggaggccggggcaggcggatcacctgaggtcaggagttcgagaccagcctggctaacatggtgaaaccccgtttctactaaaaatacaaacaaacaaacaaacaaacaaaaaacagccaggcgtggtggcatgcgcctgtaatcccagctacttgggaggctgaggcaggagaatcacttgaacccgggaaggagaggttgcagtgagccgagatcacatcattgcacactccagcttgggcaacaagagcgaaactctgttaaaaaaaaaaaaaaaaaagattgaagaaggtgaatgctttcaacacacaacccatgggatgctaattacatcaaattggaccccttttggcagagtaaacagccatggcacacaagcaaggagcagtattctttactgtatttaggataaaattagtaagttttgaaaaatgttctcatgactttatatcttg

SEQ ID NO: 69738 - DNA, 1016 bp, Homo sapiens
gaactatgatgaaagattctctctgcttttctatttgaattgtaggagagcaataagacaggtgtgctacctagagtcctctgtgatttcttcacatctctctttttacccctcacatctctgcagctgaaatagtttttgtaggaagcataaactttggaatacccttagcatttataggagataattggagcaggatgggagtcttacttggacttgatgagaaattttaaaaagttgtttggtctatattttttcaaagctacttgaaattggccccaaataatggttgcatgtaagggttacaggggaccctttaaaaaatacagctctgtaggccttcccttttgagatacagattaattaggttgggttgtggcctgaaatctgcatttttaaatactttagatgaaaataatctgttttcctagtgctcactctaaatttctgaatggtcaggtaactgtcctcccttctctgtatgttttggctaagacagcattcacgtctcctgaaaagtttcagcttcccaggctgggcatggtggctcacgcctgtaatcccagcactttgggaggccgaggcgggcagatcacctgagattggaagttagagaccagcctggccaacatggagaaaccctgtctctactgaaaaatacaaaattagccgggcgtggtgttgcgtgcctgtaatcccagctactcgggaggctgaggcaggagaatcacttgaacccgggaggtgaaggttgtggtgagctgagatcatgccattgcactccatcctgggcagaaagagcaaaactctgtctcaaaaaaaaaaaaaaaaaaagtttcagcttccctctactgacttcttgacatttctgccaggctctgcatcacttatcctcaaaagcagcagctccttggcttttaaaggagggagatggggacttttaatagaaacttgatttctgggggtgtcaagtgtgacaccttcatttcctctgcctgccttgctttgtcctacaa

SEQ ID NO: 69739 - DNA, 1068 bp, Homo sapiens
gagtgagactcttttttttttttttttttttttttttaaagatacctacctctgactgactttcttaaaccataaattgacttttttttctcccttttgtctatttttacttagagaatgcagaagagggctgaacgattcaatgtacctgtgagcttggagagtaagaaagctgctcgggcagctaggtgagtgtccccagccttttgggcctctgataggggtgttgtaaagatgaagatgtgtgatcctagcttttaggtataattgttgattttaagtagaatagaggcttgctgaaggatatgaacacttttttgaccctattcagaacatgtctactgatttggttatagtagctataaattgagctttattgagaagggtttttgtaacagttaaagccaggaactgactactactaattctgataaggcttccttttagcttaatttctgaacctctttcatggggttgttagaattagctaatgattgcaaggcttgagatcacaagcaagaagtgtcatatgtatacttgacacggagacagacaaaccaggagtgtgaacagcttcctaaaatttagtttgtttttccttcttcaggtttgggatttcttcagttccaacaaaaggtaagagtacagagatacttctgagaaagttacctttttattctttcttttctggtataacaggttttatttctccaaaataaggtaaatttgctagctgtagaaactctttaagagattgtaacattcatctcctgctttaggtaaaattatacttaggccttcctgggcaattaagagagatactgaatgttatgagaggataggaagtgccaacatttgtctgtcttttcttgaacatcttcaaagaagtttctctagtactttgcttacttattctggggtctcaactgcataaaattattgcatactatctagtgttatactggctattataagtgataaaagggaaaagaatatcttctaccttaacagttttacttctaggaacgtataaggaaatagtcttgaatgtgcataaagacttagcct

SEQ ID NO: 69740 - DNA, 1043 bp, Homo sapiens
cagtccagggatttccaataaaagggtggaagagagtaagttcttattccagaattgcttcctctgaaaatgtcattaaaccattactacctttcagggcatcaaatgggaaaagtgttcaggatattggaacaaaagctgcccatgtctctaaatgagggaccttaatgagactggttatgacccacagttttatgggagttgtttggtggagggttaatgcccttccatttatcgtgggtacttccgaactttgtctcccgcccctgtggtcccccctcttttgtttcctcttaaacctttgaccactagcttaccatgttttcctaattcaaactccccttagacttttttcttcctaccttctttggcatttttatttgtttcactttgactgttccagctagagctacattccccatgggagaaataagggatttttaaaagaaggaaaccagaccttgtagagtacttattaattgttgtgatgaacattgggaggtggtacttaaaggaggattggagggttactcattagttcaaaagtaaattaaaggctgggctcggtggctgatgcctgtaatcccagtactttgggaggccgaggtgggtggatcacttgaggccaggagttcgtgactagcctggccaacatggtgaaaccctatctctactaaaaatacaaaaattagctcggcgtggtggcaggtgcctgtaattccagctactcaggaggttgaggcaggagaatctcttgaacccaggaggtggaggttgcagtgagctgagatcgtgccattgcactccagcctgggcgacaagagcaaaactccgtctcagaaaaataaaagtaaattgaaaagttcctaaaagcaaatgagatggtttctggtgtcctttgagtgtttcccttcagcccagtatatttaaccagacttctttccttatttctttattatactttagctaaagaagcttagtttgttatttgaactctttcctctcaatagatgacagttaaaggaaccaaagctctagtggac

SEQ ID NO: 69741 - DNA, 1001 bp, Homo sapiens
aggatgtacatttaacatcttgatagatttttgtcaaatatccctttatttatttatttttgagacagggactcactccgttgtccaggctggagtgcagtggcacaatcttggctcactgcaacctccgtttcccggctcaagcagtcctccagcttcagcctcctgagtagctggaactacaggcacgagccactacacccagctctttttttgtattttttgtagagatggggtttcgccgtgtttgccaggctggtctcaaactcttgagctcaaagcgatccacctgccttggcctcccaaagtgctgggattacaggtgtgagccagtaatcacctgcctatcaaatactactttccagcctatcaaatactactttctaaagccatttagttatctttccatcataagatgtttataattagatatagtgccttgaaaaaatgactttgtgagatagctttaaaatagaaatgttatggggatttctggaacaagaaagaagatcaagtgaataccatgataattggcttctgtgggttaaaaaatagaggttcgaaagtttgaagttcattattcatagaatatttaaaatgtgcattctgttcagggggctttaattctattaatgaattttgaaacaaggaaattgaagtgggtggggtgatcgtttttgatttttagaggatagttgtggttagactgaagtatgtacaaaaagattctgggtctctgtatttcagggaatgttgtttatgtgattgggtaggagagaaatttctcagtgaagagtggaaatttcccatgcatcccagaattcgatgtttatttattgcgcttgagtttagttgcctaagggaattgtaatagaatggaaggaaacttcccgtctggggttccctttctgccatgatgtgcactgcattgactgtgcttcagaatggtaatggggaggaagtcattacactggggttgatggagagtactactttcttga

SEQ ID NO: 69742 - DNA, 1027 bp, Homo sapiens
gctggctgccacagtagtcttaagaaaaaaacctttttcccccctcagaatatttagaaataactagagatttgtgacagttagtaggtatacaaatagatgaggttttttattaaagtgtgatgtttattcttcagcatctgttaggcagttcctcttgtatattgaatatcgttagaggaaaatggatcatctttgtggacctagagccttggtagaattaagggcagtaatttgggatggaacttcattttctttttttcttttccttgtgggaactaccattttattcactggtgttcatcctgttaactaaggaaaagttttatttttttcccctcagcttgccgaactaaagcaagaatgtcttgctcgtggtttggagaccaagggaataaagcaagatcttatccacagactccaggcatatcttgaagaacatggtgagtactttgtggaggcggagtgatgtgagtgaggggattttcaggctttgacactgaaaagatttcttttttttttttcaggtcattagcaatgtaagctcttaattaacggcatcaagaaaactctctcttttttttttttgagatggagtcttgctctgttgcccaggctggagtgcagtgacgcagtttcagctcattgcaacctctgtctcccggcttcaaccaattctcctgtctcagcctcccaagcagctgggactacaggcgagcaccaccatgcctggctgatttttgtatttttagtagagacggggtttcaccatattggttgggctggtctagaattcctgacctcaggtgagccacccgcctcagcctcccaaagtgctgggattacagttgtgagccaccgcgcccagccatcttgtacaacctacatcttaggttgtacaagtcctctatctaatttttatttacgtattcccttttatttctattcctcatttcactttctccccaacccatttaggcacccgttctaatgtgtttgaatgtatttttttggtgtttttcctggt

SEQ ID NO: 69743 - DNA, 1047 bp, Homo sapiens
aaggaactattgcagaggagaggagaaagtgatagtagtgtcagagtgttgagaatagtgagacatttgtattgaaaagtgaagtgaggaaatatattggtagttgaagatagtttggaaaggaaaataggtaaactataaaggtaaatcagagtgatattgaaaagggctttctaagttatgtaaggacttctggcctttgtcatgtaagaagtagggctgggagcctttggaagtttgaaaggaggagcttgatgtgatcagcttgtattctcttggcggatgggatttgtagggggagcgatttcaccacttagatatttattataggagtcattcccctgcttaaaacctttaaattatatccctgcccgtctctccagcatagttactaactcttcaactactgtggccttattttatttaatttcttcagaatgcttcatcaattgccaacacttagcatttgttatgtggcaaagcactgtttgaagccatttacatacactaactgatttaattctcataataaccctgtaaggtaaatacctgtattatcctcatttgaaaataagaaaaaccatagctcagagagagtaactgagtaacttgccttaggttgcacagctaaaatgttgtatattaaatccaagcaggctgggtgcagtggctcacgcttgtaatcccagtactttgggaggccgaggcaggcggatcacctgaggtcgagagttcgagaccagcctgaccaacatggagaaaccccgtcactattaaaaatacaaaattagctgggcgtgatggcacatgcctgtaatcccagctactcggggggctgaggcaggagaatcacttgaaccgcgtaggtggaggttgcggtgagccgatatggcaccattgcactccagcctgggcaacaaaagtgaaactccgtctcaaaaaaaaaaaaaaaaaaaaaattccaggcagcctgtgtccaaaattcatgttctaatcattgcacactgcttctccctcttacctcaacctagaaccttcacatatgct

SEQ ID NO: 69744 - DNA, 2315 bp, Homo sapiens
cagtccagaagccgtgggcaagttgttgtcgtgccccacgcttgagagaagtaatggggatgcagactgtttacatgccacggaggtgagagagagggtggacaagccccagagaacaaagtggggaccagagtgagctttactctgtcatcccttcttagtggttctttgatgattccatgactttcgcctggaattctgggtgtacgtgacctcttcatggttattaacttcttcagcaaagtcagatactcctatttcccttgctccctgaagtgagtgccccaagcctacacatacaccttcatgttacagttgacgtgtaaagatcagagcaataatgactatgtctctgaaatgtagtgaggactcttcttgtcttttaaagttttccccaagtcttcagtttttattttctgcgtgatgggtaagttcttcattcccaatagagttcaggggattggggctatctgagagacaactgggagatagctcaagaggggttgagaaaaaactgagctggactcctgcctgatcccccattacggctaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggtgagcactaaaccacgcccttgtacccaccccagggtttcccaaccaaaagcaaaataaaatcaccaattgtttggggatttatgtgttccttttgggatcttaacataattctttgactgaaaaactactttctgcccctcacactgccaccttccctgttcccaggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctgtgagtctatgggggaaatgagatatgctgggttagaaagagctccaagagccaggtagaaaggcccatagggaagctgttaaaaagcagacttctcatctaaaaccctttgaagatattatggtatactagttctaagcctacagagagcagtaaaatgtagattacagtcaatactgtaatcaagcattccttgctgcctccttggtagtaaggaaatgaagggactgagaaaagataagtgccaaataaaaccaaatgattttacactgccaaaagaagtaaataaaggcagaactgatattaatcttcaaaaacactgtagggagtggaagcaaagaggactgtaacagtcatacagactgaaatagcttgagccgtcatttgccatgtcattaacaattaacagatactgacttacagtctccagttaagggtgctatctcctgaaccccaaagtaaatgctgttgatatagctggaatagttttagataatctagaactatatacagtaaaactggtcatttaaaatagaagagaaagagcagggcactgtggtgcatgcctggagtcccagctacttgggaggctatggcagaaggattgtttgagcccaggagtttgaggttgtactgcacgtatcacacttatgaatagccactgcactccaacctgggaaacatggtgagaactgtctcttaaaaaaaaaaaagaatatggatagagaaggtcaacctcactcaccctatttttttctctccccagctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatag

SEQ ID NO: 69745 - DNA, 1027 bp, Homo sapiens
cctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataa

SEQ ID NO: 69746 - DNA, 1028 bp, Homo sapiens
tgtaatcccagcactttgggagggtgaggtgggcagatcacaaggtcaggagatcgagaccatcctggctaacatggtgaaaccctgtctctactaaaaatacaaaaaaattagccgggtgtggtggcgggcgcctgtagtcccagctactcgggaggctgaggcaggagaatggtgtaaacctgggaggcagagcttgcagtgagccgagatcgcgccactgtactccagcctgggcgacagaacaagacaccgtctcaaaaaaaaaaaaaaaaaaagagggtgtgcagatgggagttgtcatgcaccttatgcttgagggaaatggtttaatacaagcatgcaatcaaattgcattagaagtagatattaggttgatattagataacagattgttactgctatttctgtacaaataaaactattatgaatataagtaaggtgtgtaaattggaggcctacttacactggagtgtatggagctggactggtaaaacatcacagtgtgcaaattacctcaatggctgcatgacaccaaagaggaatgggcaactaaagtttccattaatgattaaaggtacagtaaaccaccacacctgtaacttaccaaaggactgaattaatttggtgggaaatgtatgccccttagtaggtagcttggtatattcttttttttttttttttttttttgagacagggtctcactccagttccccaggctggagtacagtggcaggatctcagctcactgcagccttgatcccccaggcttaggtggcttccacctcagcttcctgagtagctggaactacaggcgtgcatcaccacacctggctaattttttgtatttttagtagaaatggggttttgttatgttggctagcctgatctcgaactcctggactcaagcaatttgcctgcctcggcctcccagagtgctgggattacaggcgtgagccactgcgcttggcttctgctgtattcttagagtgggtaacaattgtttactctcattgttactaattcta

SEQ ID NO: 69747 - DNA, 1094 bp, Homo sapiens
agggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaata

SEQ ID NO: 69748 - DNA, 1079 bp, Homo sapiens
gggtgctcttgaccgacagccgcacccccggcgtctaggacctccgagcagggatgcatctggaggtctagggaagcacttccaccccctcctctcctcaatcctggcaggatggtgagtagttaacatcccctccccaacccccgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcagcatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcac

SEQ ID NO: 69749 - DNA, 1026 bp, Homo sapiens
ctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactg

SEQ ID NO: 69750 - DNA, 1037 bp, Homo sapiens
cctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagagaggactgaacagctcttcctctagctgtctggctgtataactcttacagtagtctgtataataagggcatctctattagatctttaggggacagaggatttgtcaagatggttagctctttgttttggggtgcagagaaagaaaagagcagcaacagcagaggctggactccctggttcagt

SEQ ID NO: 69751 - DNA, 1242 bp, Homo sapiens
tttctcctccccgtggtttttgtgtctttttagcctcttgttcatttactgcctttcatgttcccatgctattgccttggttttttaacaaaattcttcctctgtgcctatcctgtcttacctacaaatagaatcttcttgagggcaaggatggtttcttgtacggtgtattggcactcggtaaataaataatgagagagggattgagtgttggtatgagaaaaggagcctaatggttgcatttggatgaatgggtgctgagagatggtatgtacatttatacattcttgtctcatcttgtaaaatgtttgaaaataagagtaattttcaacttgatttttcttattttaggcaagtatatcgcgtcaacacagcgacctgacgggacctggcgcaagcagcggagggtgaaagaaggatatgtgccccaggaggaggtcccagtgtacgtggttaggctttgcgtaggggttttctgatggggtccctacagaaggatagaatatccttatgcctacaagttcagggaggactctcctaagccccaaggaaatggaaggaggggcaactatctgagaaaggagagaaagagtctgggattcagggatgagtgagggttacagatcactagtcctatacttttgacctctgttcattagaacctccagagctttaggttctagggacttcgctgcatctttcctgcagagcagaggaaagttggggagggaccataaagagagaaaggtggtcaggcccagtggcctacatctgtaatctgagcactttgggaggcctaggcaggtggattacttgaggtcaggagttcaagaacagcctccccaaagtggtgaaaccccgtctgtactaaaaatacaaaattacaaaatacaaacatcagccaggcgtggtggcacgagcctgtaatcccagctactcaggaggctgaggcaggagaatctcttgaacccgggaagtgggaggttgcagtgagctgagattgcgccagtgcacttcagccctggcgacagagcgagactctgtctcaaaaacaaacaggcaggcgcagtggctctctgtaatcccaagcactttgggaggccaagatcggtggatcacctgaggtcaggagttgaagaccagcctgaccaacatggtgaaaccccatctctactaaaaatacacagttagccaggcgtggtggcaggcgcctgtaatcccagctacccgggaggctgaggc

SEQ ID NO: 69752 - DNA, 2299 bp, Homo sapiens
tggtatctgatgacaacccaggttgctgctacttctccccaacctcacaatttaaagtggtactacctctttccttctgttctctacccagtagctccttcatgaattaccaacttttaatgtgtgttttgaaaatactacttatccagtatacttctctttactcttaatcattttctttaccctgactccgtgaaaatccaggtatcacatcttaccttaccttgtcactaaaagctgttttctgttttccgtgactatgtggaagagaaaaaggaataaactgcttttttgttttcctttactatgtccagatcattgatctaccactgtcactctaatcctcatggaaggtattgccatgcaattatagcagtttctgtaaaactttagtgtcatcatttactgcccacagggacccagacctattgcatcatatttttttctctcctttttttcttgctatcattttcagtgtctccagcaccattggaatattctgatttcatagttcctcagcatgagacggtcgactttcctttgtattttcaaaccagttgcacatcagaatcactacaacctggatctcatctaggacaccgctttttcttcagctgctccccatcactttagcctccttaccagtcacctatttcactatcttaaacccacaggatcagctttttgtcctcaagttctctggttcttgaccttcccatttcattgaatctgtcagtaccttatggcctttggtgctgcccagctagacctctgtgaccagccactttgataatatcctcttgctttctttattcattttgattttctatactaagcaggcacttctgttgtctctaatgatgggtatgattagagatgttttcttggcttccgcttctaggccacagcatgttgctagagaaaaagtacagagctatcagattcaatataacttaacttctgccaagatcatggcttctaattatttttttctttttaaaaaaattttttgctgggcatggcggctcacgcctataatcccagcactttgggaggccgaggtgggtggatcaactgaggtcaggggttcaagaccagcctgaccaatatggtgaaaccccgtctctactaaaactactaaaattagctgagtgtggtggcatggtggcgtgggcctgtcatctcagctactcgggaggttgagacaggagaatcgcttgaacccaggaggcagaggttgcagtgagctgagttcgcaccactgcactccagcctgggcgacagagcgagactctgtctcaaaaataaataataaataaatatttaaatttattttttatgttcttccatagctgtttccccaaccttttccagatctgtgtgaccatcccttttaattctccttcttttggcagaagacttcatttttatttcactgaaaactcaaggcctatcatttttgtttcctttttcttcacagccagattttgtttgtttctttctttttttaaaaatgaagcgatgcagacttgctatgttgcccaggctggttttgaactcctggccttaagtgatcttcccacctcagtctgccaaaatgttgggattacaggtgtgagcatgcacctggccccagatttctcgaatatgaagaaatctcctgatatttctgtttccttgctgcctatttgttcttaactctttgcagtcattatttctagcactaccctctctcgagttgcctatgcctttttctaattgtttcgtgaatatcttcactcttggatatactgttatacctcaaatccaacctgaccaaaaccagtatcagtttttccatcactatttctgttaaaggcaccattattctagccaacccaaggtaaacttttgtatcgtttctttttttttttttctttgagacagagtctcactctgtcgcccaggctggagtgcagtagcgcgatctcggctcactgcaacctccgcctccctggttcaagtgattcttctgcctcagcctcctgagtagctgggattacaggcacatgtcaccacgcttggctaatttttgtattgttagtagagacagggtttcatcatattggtcaggttggcctcgaactcctgacctcgtgatctgccagccttggcctcccaaagtgctgggattacaggcatgagtcaccacgcctagccatttctttttttaatattctaaatatacttgattttttagaacacttttagatttatagaaaaattgagaagatgctacagagatttcccatatacccta

SEQ ID NO: 69753 - DNA, 1056 bp, Homo sapiens
ggcttgctacgatcgggactccacttccggtggggaggggggcgggaccccagcccgctcacgccggaagtggtttgcgttttcaagatggcgactccctatgttactgacgagaccggcggtgagtgcgggaggcgcggagccgcttctctccgggctctcggggcaggggttcggacttggaaaggggtctgtgccccgcccatcccggggcccctcctttgccccgccccccggaccgccttccccattcattctctcctacggggtgtctcctgcgcccccttctggtctcgtgtttggggtctctgcttccggtcacccaaaccctggggtccttcagtgctggtccctgcttcaggaccctcacgggcccttagcttttctccagcagttggaccactcatatctcttttaggttcttcaggcttgggggcttctacactctcatttccctccagttcctgccctccttcttttcccctcccccatctcagctatacttggtttctgccctaccccagtcccgttttcattatttttctcgaagctttatttgctgaagacctcctcgtttctacatagtaccttttcctctcccgtatcttcatttgttgggtcactgaggtttagaggtgtgaagggaagaggaccctaatacaactttcagcttgagttttctccctgatggagccacccttcgctaccttctcccgtgatggtgatagaaattgaggggtctaaggtgggaaaaggcaaacaggaaagtatctagtggcttttctccgaagccctttgacaagtgaataaaacccactattccttctggctagagaagaatttgcagcctggctggccgagatgctgaagtgtctgctgtgtatgtaaggtgtatgtgttggaaacggagaatcacagcttttatcatggttttgtcccttcctaatggcctcatctttaggaaaatatgcatagtagtaatagctactcaatgatgatcaaataatatatgtaaaagcaatttataaaatactgtgcaagtgcaaagtgtttctg

SEQ ID NO: 69754 - DNA, 1048 bp, Homo sapiens
agtgattttgcccagctgcaaaaatacatggaatgtgagtcttcctgtcaggccttcagttctggagaccctgccccagagaatccctcctcctcctcattacaccccctgccccccagcttcctcagtggctttgagcagtgtgctgctcagatgtgcccatgactggaaatgggaggagtgggagatggggagatgtcagaaaaagatccggatctaccacagtctaactgggctgcattgtgcaaggtctcggctctctacccaccttcgctatacctggactgcttgctccagctctcagagaagaggagtaaagagtggtactgttttggaggatctgaaatatttttccctctgtatttctgtgtttcttcttggaatttcttcatctcatttgaatcttttttcctgctggatttctctggcaagagaactcagctggactaataatgctgttctcttactctctctacaccctagactccaccaaaaaggtcagtgatgtcctaaagctcttcgaggatggcgagatggctaaatatgtccaaggagatgtgagtggcagctgggaaatcttcttcttgatcaactcttcccatctttgtttttgatccccaacttccaggaattattctgggcctgcccctcactatcccctctagagataccctagtgtccattgtcactctgactattgctttaggataaaacaagggattctattaactcaggacttaatcaaagaaaccatactcctgcctcagatgcttctcagctctgcatttattatccctgtccccgctactcccaattcttcagccccagctctgaccttgcagactccccaggataatgctcactctcattataggccattgggtacgagggattccagcaattcctgaaaatctatctcgaagtggataatgttcccagacacctaagcctggcactgtttcaatcctttgagactggtcactgcttaaatgagacaaatgtgacaaaaggtatggtcaagcaggtaggactgggctaagcctctggc

SEQ ID NO: 69755 - DNA, 1041 bp, Homo sapiens
gctgggattacaggcatgagccaccgtgcctggcctggggtgaactgagttttctacctgcaagaagggcagatcccccaggcctggggtggcatggtcctcaggcaggaaagcttacggggtgagggaggaatggacagaggttaccacagaaataagagagggtaaaccctggaggtgaggagaaggggaggaagctaggatcaaggctaagcagactgggatatgggtgtgttcccttctttggagaagcacagacaagctacctttgtccattgctaaccagtttaccccttctcccaatatcaggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctgatgctggtttttctgttgcttcttgggagaatctacgtcatttaaggagtgaaggtataaaagaaggaagtgtaccacttacttagcagatcccaaaggggaaacacaagtcattttattcagatgaggcactttcaatgtatgtgttttggggtgtgtgtatgtgtgtgcgcatggggaacagtgaggtggtgcaggataataaatactgtgagggtgaaggaacactcccccaagctggcaggagtatgtggcagcaatgtacagagcctcgggagtagagtccagggacagggaggtgggttcaaggctggcttggaggccaagggtgtcccccttagctcaagaagccaaagaaattggtggagcgggggggtgggcccatgagcatgggcatctggttcttgtgggtgatcttgatctggaagggaagggagcacattcagaggcaggacctgatactttggggctgtggcttcagagattta

SEQ ID NO: 69756 - DNA, 1299 bp, Homo sapiens
tgtacagtgtgggcatttctctctctcacacacctccatttcctcaaactttccttctctaggctgctggatgtcattcacacagaaaataaactctacctggtttttgaatttctgcaccaagatctcaagaaattcatggatgcctctgctctcactggcattcctcttcccctcatcaaggtaatgcttctcatcagctcctctcatcatgggcatgtcttgggggactggtggcaggcaattcagggtgatattttatgattttggcctccttctgagccctcatctcctatacacacacactccccttctttttgtgtctccttccctgctcattatattcattaaccctagggttggactgaacaatcaaagttgaaactctagtgagtcaacctagcaactcaggtgggaggtcagatgaaactcagataaacgggatttgagagcacttggtaaattcctccaaaaagcccttccatttggtggaagacctagctagtgagtccctattgtctattttagggctggattcttcactcccagagctactttcaatctattaacaaacattttttcaatgcacaggatgtagaaaagggatggaaaattgagtaagacttggtccttatcctctctgggctgacagtccattgggagaaatagcttgtaaatatgtaactataatccaacataataaaggctttagtagagttttaggggcacagagcaaacccagtctgctcactgtaatggagaaacacagtcctctctttctcctttgtcagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgagtccctttatgtcttttttctctgagcttcccaagaggtgttaactagggtattcacaaagttactaaaaatatctggctaacagtttcttactaggtagaaataatctcttgacatcctaaagagtcttagggtatgcatggaattcatactgtgttgctaactgggcccacacctgtaataccaatactttgggaggctgaggtgggaggatcacttgagcccaggagttcgagaccatcatgggcaacatagcgagaccccatctctacaaatctacaaaaagaaaaaatttagaaataaaattatgaccaatttgtctcaagtttttcc

SEQ ID NO: 69757 - DNA, 1828 bp, Homo sapiens
aattctgccttgggtagaaggagttctggtttcctgatttctgggaacacctgctgcccatttagtccactatcacatcattgaagtcaacatgcatctctccctctagcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttatagttcatctctttcctcctcttatttactgaaagaatggtgggagacagaatatgaatgtgtgtatgtgatcattgatttcagaccccttttcctaatctctctgtgcatggctgcccaccccaccccattttggctagtgctgacggtgaacaaagtggttattatcatccctatttatggctggggaaactgaagcctatatacttcctacttcactttctccacacaccagcaaacctcctttcccccagccaacataccacacacacaccacaccacacacacatcacatacacacaccacacacacatcatatacacacatataccacacacaccacgtatacatataccaaatacacacacaccacatacacaccatatatgcacacacaccccatacatacacacacccatgcacatacatagcggcaggaagagggctcccggggaat

SEQ ID NO: 69758 - DNA, 1821 bp, Homo sapiens
tattggctggagccccgccccagggcgaggaggagaaggaggggcaggagggtttggttgagctgcagctgtttgtctgttcgacacaggcttggggccgacgggggagacggagccccaggtaccgagctgatggagcccaaagggcaggggcggaagcgcccgggagatgagagcagcctggcctgagagcggaggcgggtctggtcctaagcgaggggttagagtggcccaccggagaggggagaagggggccgggccccggcaggcctaatgggggtcgctgaggaggggactgggcggcctgggaccccgaagttggtgagtcgggaaggcggctgggctgtggcggcggccaggccgagggccgggggctggaggcctggagcttgagtgagggcaggggcaggcctcattaagcagcgctgaagagggaggagctggggaaaggaacagggcagcgggtgaggtaagcccatttgccgggaggtgaggagggtcagacctgtcgcccgagccccgggggtgactggggctgggtccctgcagagaggttcattggaagggcctgagaagggttcttagttgggtaagaagcgttcttttcagggaaagtgcctattgtaaaaagaactgagggtgctatggtgttgagctgagagagatttgggttcagtgagggagaactggggaaaatgaagaaggctgtattaatctagaagactaaggtagttgaagtaatggaagcagggcctggtatcagttatgggaacttctgggaatgctgaagggtgggctgggggctctgggtcttgggagtacacactcttttgttccctttagtgtttagatgtggtaatttgaagctttttaaaactcccagggtagggatgaagatcaaagtaatttttttttttccatgactgttggctgctccaaactcagcccctacactttctgttggcctcatagctggtctatactgcagtctgtttcttaacttactgtttcatgtcctatgaaagagctaagaagttggattgggggcatgttttgtccacttctttcccacttaataatgtggtctatagcaaataccatgtctcctagaactgagaatctatttcatatctatttcattatctacatgggaaaggggcttagagatcctcagccatcaggagatcttctgatcatagttggtgaaacttttgtgggacttagacttgacttgggtatttcccaggcaggtaatggagttaacaggtccgaaactatgcggtgatatcactgaggaagagatttggggaagagtgagaaattccatttcaaaagcttggcatcaccccttgttctttgtctacttcaaaagcccagatttctgtgctgttagaaagttgggtcaaactatgaagtatctggggaagatggtgagtagagaaaaagatacagaggtgcagtagcccacgcctgtaatcccagcactttgggaggctgagacaggaggatcacttgagcccgggagttcgagggtgcagtgagccatgatcttcccactgcactccagcctgggcaacagaatgagaccctgtctccaaaaaaaaaaaagacaaagattgccaaagcagaggagtggagtaccctcctccccacatatttttaatggtctgctagccttcttagtccctcatagattggagcctattggattttcccttactgtacttcctccttttctgcgtctctaccaatatattttatcactacatttcttttttttttttttttttttttgagacggagtctcactgcaacctccac

SEQ ID NO: 69759 - DNA, 1029 bp, Homo sapiens
tgtccttgttggctggacatggtggcttacgcctataatcccaacactttaggatgccaaggcgggaggatcatgaggtcaagagattgagaccatcctggccaacatggtgaaaccccgtctctactaaaattacaaaaattagttgggcgtggtggtgcgcgcctgtagtcccagctactcgggaggctgaggcaggagaatcgcttgaacccaggaggcggaggttgcagtgagccgagatcgagccactgcactctagcctcggcgacagagcaaaactccgcctcaaaaaaaaaagaaaaaagactgtccttgcttatatttagaggagttagtttggggcagggggtaagggggcagaaaacgggttcttgaaatagcaaataagagtacaaattatgcttccaagtgctaagaagacagataatgaattatcagagacctgtggtttcactgagggaagaccacctagaagaggtgaattttgagactcattttaaaaggtgatggatatggattggcagtcattccagcctactcattctcttcatgttttcctaggaaacctttgcccgagcaaagacatgggtgaaggaactacagcgacaggccagtcctagcatcgttattgccctggcagggaacaaagctgacctggccaacaaacgtatggtggagtatgaagtaaggtggcccgtggagttcctctctaacacttcctctgttcctgggacctctttttttccaaaccagccctctctgaaaacgtcaacagaggacattcattgtctcattccccagttctacaccaagttaaatacagcaacactgtgaccctaatgacagccaggagattttcaaaggagtcaggagaaaactccagagcagagggttagggaggtaccagctgtgggggtaccagtgtgaaaacaggaaggagggagcaattaaatttgtggtaagggactattcaagtgtcacaacccaaaagcccccaactaacttaccctctcccctataattaag

SEQ ID NO: 69760 - DNA, 1073 bp, Homo sapiens
ttggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattccc

SEQ ID NO: 69761 - DNA, 1001 bp, Homo sapiens
aagcacttggggcaggggggaagggggggaggggggagcctcttggcttcgcactacaattcccaccaagcatctgtccctctctggcctctaataacgagtgcgccttgtggtccagcgtctggcaactttcacgcctagcgtcgcgtataccggaaaactgcatcgtccagaattgcttccgagtcggcgcggcgcaaggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctctctccggtccgtgcctccaagatggtgagtcttcttgcgtggtgagggtgggggttcgggtgcagactctgggattgtggggaagtgagagcctggagcacggctgaggggtggaccgagtgtacatttcatttgctctgggggtcggcgggatttgcggagaaacaggagatccgagcggcgccttcctggaggctgccggtgcggcttgtggccggaaagggactgaggctgggtgagttgcgccgttttcctaacagttttcccatcctgtcgcagacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatggtaagtgggtcaccggcgcgaactgtgtgaggatcccagtatcttaaagccttcgcccaacttcgcccttttggaggctctgttctttgga

SEQ ID NO: 69762 - DNA, 1998 bp, Homo sapiens
tgttactggtagaagagaattctcttgtttgccgttttgattcttttctgggcagagggtgactttgtgatagagtgcacagcctttactctgaggtaaaggtttgcctgtttcggttatgagattgcaaaaactagaaacttggtaaatttgacaattcttgtgctattgattatttgaatatttgtgaaaatatacaggtgaggaagaatgtcttcaacgtttcgagaatggaggccgtctagtttggtgtgcaaggatgatgtttggagcaataagaacgtcgctttgtttttttccttttatagaaagagcaaggttcagggtaggcattagggcgggtgtaggtgtagaaggaactggattattggtttattgcatttagaatgtcagtctggtccttgcggtgtcaagatgaactcacgtgggatgttaattcacttgtaaaactgagggttatacatatgtgctcaggtattgggctgaacaggtgctttgggggtgcttttatgtgcccgacaggcatttaaataggtttagttttaattgacgtaaacatgtaaggtgctcttcattcatgtaacaaaaaagcaaggtaggtatataataccagtataactctattttctattccttagcctatgtgcttcccaagctgtatgtgaagctacattactgtgtgagttgtgcaattcacagcaaagtagtcaggaatcgatctcgtgaagcccgcaaggaccgaacacccccaccccgatttagacctgcggtgagtattttaaaaggagaatggaagccaggggagtgatggttaaaatttcatcctggagggtcagggtgtcctatacctgtaacctcaacactttgggaggctgggacaagaagattgctagaaaccagcagttcaagaccccatctcttcaaaaaatattgagaaggaagccaagcatgatagtgtgaacctatagtctggctgctcgagaggctgaggcaggaggatcacttgagcccaggagtttgaggttgcagtgagctatgattataccacttgcgctccagccagggcaaaagtgagaccttgtctcttaaaaaaaaaaaaaagttgcttcctcctgtggtgcagggggtatcaaattaaggtctgtgcctcaggttaagctgtaaggcaggtgagacccacacctgaacatgcttagagacactgcaaagcagtgttagaatcagaattggtttttaggatgcagagtagtgttctccctccacctctatcagcttcccatgcatttgtagcctgaatacatcagtttgtgagaggatggtggtcaagttctttgggggaagggagtcttggatccatgggttttaatttactcttttgtttctttgtctttcagggtgctgccccacgtcccccaccaaagcccatgtaaggagctgagttcttaaagactgaagacaggctattctctggagaaaaataaaatggaaattgtacttaatattgcatgttaagtgtatctgtgccagataaggtggggattttgtgtgttagaccaagtgtgaagtgacacacattattttcatggggaagaaagcttattcatgtaatttaatttttttcttttttttttttttttttttgagacggagtctttgtcgcccaagctgaattgcagtggcgtgatctcagctcactgcaacctccgtctcccgggttcaagtgattctcctgcctcagcttcttgagtagctgggattacaggtgtctgccaccatgcctggttaatttttgtatttttggtagagatggggtttcactatgttgtccaggctggtcttgaacttctgacctcagttaatccaccagccttggcctcccaaagtgctgggattacaggcttgagccacctcgcctagctatttatgtaaattaaactttaattgtggtcgtatggttggcctcacaattcgcatagctgtgtgaaatggagattaggc

SEQ ID NO: 69763 - DNA, 1073 bp, Homo sapiens
cggtctctgtggctcgggttcctgggctgggtggatgaattatggggtttcgagtctgggagaaactgaggtggcctggacgtgaggcaaaaaacaccctccccctcaaaaacacacagagagaaatattcacattctgagagaaaatccaccaagtgaaccaaccggctaggggagttgagtgatttggttaatgggcgaggccaactttcagggggcagggctttggagagctttccactccctcattcattacccttccctggatctgggggctttcggaatctcgacctccccttggcctatctcctgcagaaaaattagggtgagccccatcctcgatctgctccgccaagttgcgggaccgcggggcgtggcacgctcggggcaggcggtccgaggctccgcaatccctactccagcctcgcgcgggagggggcgcggccgtgactcacccccttccctctgcgttcctccctccctctctctctctctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcaggtaagtggcgcgagagcaccggcgggctcggcacctgggagccggaacccagtgcgcgcagcctcggagggtatgggcacggtctcaggcggcgcggggttgtgggtgctgcccccggtttgccaggaccacctgggagaggggcggtcaggctcgggttatcggcgtggtccggccgagggcggcattccgggaccctcacgccacccttctccagagcgtcgccgaccctctaattggtctccccagaagaggctgaggccgaaacagtagttcacacttctgaggggccctgcaggg

SEQ ID NO: 69764 - DNA, 1050 bp, Homo sapiens
tgggactaggactaaggttggcatttgccccagtccctccccttcagctgcccagtgggtggtgtggaggcgtggccgcgccccttgttgacaggtccacttgagcccagccctgctctccaagggcagggagggacacagccctggctttttgcttcccgggattgaggtgcctgtgtactgacatcataccccgttgattaaaacaagcctttcttagccctgatggccccttgtgttgccttccttcccaaccaggtcccccctgtcatgaggtttgcaaggggcgatgctggggtcctggatcagaagactgccagacatgtgggtttgaaattccctccaaaaacttcactcatacgctttcatatcccttcctccccaagcctgggtcaacactgtgggggaggcatgagcagtggcctcagaattcagtcctaggagccctaacagccatgctttctctccttccatagtgaccaagaccatctgtgctcctcagtgtaatggtcactgctttgggcccaaccccaaccagtgctgccatgatgagtgtgccgggggctgctcaggccctcaggacacagactgctttgtatgtaccctttccattgcctgggttctgaaattgggatgtggcctttgaggaggaggtaggggtacacacgtaacataaatctgatgagcctccttttttcccaggcctgccggcacttcaatgacagtggagcctgtgtacctcgctgtccacagcctcttgtctacaacaagctaactttccagctggaacccaatccccacaccaagtatcagtatggaggagtttgtgtagccagctgtccccgtaagtgtctgaggggaaggaacaatgatcaacaatagtagatccaagattttagacaaaattgtggaagggaaaaagaatccagttggtgataaatagggagattggtgaatggttatgatcatctaaccactccagtgagtgacccttacgtccagtcctcccatgacttcagctatcacccttacttctgctccttgtagcaa

SEQ ID NO: 69765 - DNA, 1582 bp, Homo sapiens
ccacatgactttgaagaagttacttatcttctctgtgcctcggtttatgcatctatacagaggaaataacatttgtccttccaggatggctgtaagggtaaagggggatgatgtatgtgaaagtgctttggaaagcacagagcactgtataaaaggtactcaaggtggtaatagtactaccaactctccctagctgtccccttccccactttgtgctcctccatcaaagggaaaacccaacccctttgattcctgatctcatgagcacaaataacttcctcagttctcagggtctgtacctcaatatgcctataatccattccaggactaacggtgcttcctcttcctgccctttcagctgtgctgcttttggcattcacctatgaggagcgggttggagtgggacatgggaatggcctttcctgagtaactccttcccatttgctcctcagagcatagagcctctggaccccagtgagaaggctaacaaagtcttggccagaatcttcaaagagacagagctaaggaagcttaaagtgcttggctcgggtgtctttggaactgtgcacaaagtgagtgacccataggaattctggagaggtggggaaggcatctagggcaaaggggtgaaagatttttgcataggattgacctagggagaatgaccttatgccaactcctgccccaaacttcccagggagtgtggatccctgagggtgaatcaatcaagattccagtctgcattaaagtcattgaggacaagagtggacggcagagttttcaagctgtgacagatgtaagtgaaggaaattctgtatgccgctaggagagaggacaatattagatacaatcatgtagaagcagggtcctgtgcttctcagcagctactatgttagccagaatgttgggggtgggggggcctgggctggctgtgcacatgctgagtgtatgtgaacctgttggtttcctagataataccttttgtgtctcttagcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaaggtgagagaagcctggaggaattctgtgataagaactgcttgtctgggggccagccaggaaaaagtgagaaggttgaagttctgagaggtgaggtccccaacccccgggctgcagactggtaccagtccatggcctgttaggaaccaggccacagagcatgtgagcggcaggcaagcgagtgaagcttcatctgtatttacagtcagtccccatcacttgcattaccgcccgagttccgcctcctgtcagatcaggggcagcattagattctcttaggagcttgacttctattgtgaactgtgcatgtgaaggatctaggttgtgcactccttatgagaatctaactaatgcctgatgatctgaggtggaaaaatttcatcccaaaaccaaccctccccttcc

SEQ ID NO: 69766 - DNA, 1032 bp, Homo sapiens
atcatgctcggcctgactgcagccattttctgacttccctctgtactcctcttatggctctattccttttttttttatggagtctcgctctgttgcccatactggagtgcagtagcgtgaccttggctcaccgtgacctccacgttccaggtttaagttcttctgtctcagcctcccagatagctgggactttaggcgtgcaccaccacgcccagctaatttttttttgtctttttagtagagatggggtttcactatgttggccaggctggtctcaaagtcccgacctcaggtgatccacccgccttggcctcccaaagtgctgggattataggtgtgagccaccgcgcccggccatggaatgtattctcttttatgtctctacctcctacatcttatctccaggttggatgattgatgagaacattcgcccaacctttaaagaactagccaatgagttcaccaggatggcccgagacccaccacggtatctggtcataaaggtgagtagggagtaggaggtgctaaggaaatttagaaaaaggaggagttggctggaaccaggattccccctaacaatcacctatcgatatagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtggggtaagacaacttctaattacccaacactttgcaccctgagccctcacaaaccctacagatacccagattaactactcaaaggcccccatggtgaatgtagatttctcccttcatcttaaccttttccttattttttcatcctagagccagagccttttaagtccatcatctggatacatgcccatgaaccagggtaatcttggggagtcttgccaggtaagttctgttgctgagaggctgggttt

SEQ ID NO: 69767 - DNA, 1090 bp, Homo sapiens
gggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagc

SEQ ID NO: 69768 - DNA, 1422 bp, Homo sapiens
ccggctgggcgggtttcgccagccgacccagggatccgaagaagggcgcacccagcctccccgacctaggtgtagacactgcccacccgctgcggctccactctactccacccctgcccgctcgactttaaacctatttccccgccgtagctccgcccctctcccctcagcccgcccctctctgttactggctctcgctcagcgttctcggtggaagtggtttttccgggagagaccacgcttcccctcaagctccccaacggctccgccttcccgccggagcctgacccttcccagagtgcccggcgattccggcgtgcgaggcccttggagggcaaggccccagggcctggcttaggagcgcgagaggcaggctgggaattgtagttcgaaggccctcgagagcggctagagtctggcggccgagaggactagttgtcccagcgtgccctgcgcctcagcccgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagtgagtgcggcctcgggggtcggggaatcaaggctgatagggaaaggtaacaggctggcccggaaggggctggagcggaggggtcatgcggactgagctactgaggggcccgcaccggtccgctgggcacggcgtggtgggaagacccggtgtcgcgcctgggacctgagcgggcaggcccaggctgaagtctatggaggtgcgggtcggcgaccaggatgagcgcagagaggggaccctggcaggctccgacccgaggccgtttgttaggaggcaagacgtgttttctcttgttcctatccttcattcccgattattgcttcctctgattctggcagcggcgaggccacctcgaaaaggaagcgcccagctattggcgacagaagtgcccctctgtttttgtagcgtctccggggcgtcaggagccaagccggcacgtgttgctgggtcccattgcggatggctggcccccttcttactccgctagtgtccctgacaccagcttccccaccaccagcttccccaccacgtgctttgctggagcctttccttctttacttcagctcttaccctggtgggggcccccttctaccttgggccagctaaggagaccgttggagagcactcctggagcttctaatgcaagtcttggagatatatatggcttttcttgaagttactcattactaccacctt

SEQ ID NO: 69769 - DNA, 1138 bp, Homo sapiens
gtattccttgggtggtaactagacaatgaatacatacaaggctgacatgatgggattctgtcctcaggggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtaaaaaaaaaaaatccctcactaattttccgtttgacccttatttggtcctatatgtttttatttttttcactgtaatgacgcagtccccaccccagctctggctgaggtatttggaaatttggaatggcaagtgggatacaagcagtttcctacctaatccaaactgatgaaacttaagcaagaccctgaaaaaatccttctacatttctgaagggcactagggctcccgggagacagcaaggcagtaggctgatgattctttctttacaggtattgcttttcccaccagcatttcggtaaataactgtgtatgtcacttctcccctttgaagagcgaccaggattatattctcaaggaaggtgacttggtaaaaatgtaaggttaaaccgttttaaagcatttttctttttttaaagcatttacaaaatgccagttcctaatgcagtactctgatcttgcctttcagtgaccttggggtccatgtggatggcttcatcgctaatgtagctcacacttttgtggttgatgtagctcaggtaggtggcctgcttttgatctctgtttagccttggggtagagggaatgcactgccatttgcttcttatccccacccccaatcaccacgtaagttgagagagtctctagagaagcaaaaggagaaaggtttttgttgttgttgttgtttttaccctcctgttcattggctggtcttcgcatatgggctcacagatattaaccagatagccagctgagttaacagactttccaggaagatactgattgcatgtccttatctacaggggacccaagtaacagggaggaaagcagatgttattaaggcagctcacctttgtgctgaagctgccctacgcctggtcaaacctggaaatcaggtaagctattttatccaattccaaagctcgtttgaaccaaagatg

SEQ ID NO: 69770 - DNA, 3231 bp, Homo sapiens
ttggggagcatctgtataaagtatttttagattgtagggataatcaagctatgaaatgaaaaaccagtgaatgacaatcattggggcttgatggaggatattagaacgctcagttctgccaggtgcaatggctcatgcctgtaatcccagcactttgggaggctgaggtgggcagatcacgaggtcaggagatcgagaccatcctggccaacatggtgaaaccccgtctcttctaaaaatacaaaaattagctgggcgtggtgttgcgtgcctgtaatcccagctactcaggaggctgaggcaggagaatagcttgaacccgggaggcagagattgcagtgagccaagatcacgccactgcactccagcctggtgacaaagccagactccatctcaaaaaaaaaaaaaaaaacgctcagttcttttatgcttcttattctcattgtagagaacttattagctcctgatatctcacctttcatttgatgttgtacttctagaacacacaagtgacagaagcctggaacaaagttgcccactcatttaactgcacgccaatagaaggtgagaacagataacagggttgagggtctaagaatgagtggctttgccaggtgcggtggctcacgcctgtaatcccagaactttgggaggctgaggtgggcggatcacctgaggtcaggagtttgagactagcctggccaacatggtgaaaccccgtctctactaaaaatataaaaattagctgggcgtggtggtgggtgcctgtaatcccagctacttgggaggctaaggcgagataatcgcttgaacccgggaggaggaggttgcagtgagccaagattgcgccactgcactccagtctgggcaataagagcgaaactccatctcctccatctcaaaaaaaaaaaaaaaaagaatgagtggctttgcagaattgaggcttttgctcccttgaagatctatcctggctataacccagtctaagccagaaatctcagagccctgtgtttccataaccaggtagttgtctcactgcctaccacttcaaactactgaagtgggtggatttggaaaccttttgggatactggatagcttgttccataggttgtgtactatctacaggtatgctgtcacaccagttgaagcagcatgtcatcgatggagaaaaaaccattatccagaatcccacagaccagcagaagtaggtgccaaccctacttattaccttctaccacacaagactagtcatcaggtttttttctatactcccaactgaatcttgtccgccctctactccatgttttcaggagtgacctgttgctcttaatattccctttctctaggccgggcgcggtggctcacgcctgtaatcccagcactttgggaggctgaggcgggtggatcacctgaggtcacgagttcagaaccagcctaaccaacatggcgaaaccctgtctctactaaaaactacaaaaatgagccaggcctggtggtttgtgcctatagtcccagctacttgggaggctgaggcaggagagttgcttggacccgggaggtggaggttgcagtgagctgagattgtgccactgcactccagcctgggtgacagaatgagactctgtgtcaaaaaaaaaaaaaaattcctttctctctattccttttaggaaggaccatgaaaaagctgaatttgaggtacatgaagtatatgctgtggatgttctcgtcagctcaggagagggcaaggtgaggagagtaccagagttggcaaagaggggtgactgagagtgttcaccagaccaaatgttacttaaattactctttcaggccaaggatgcaggacagagaaccactatttacaaacgagacccctctaaacagtatggactgaaaatgaaaacttcacgtgccttcttcagtgaggtggaaaggcgttttgatgccatgccgtttactttaaggtactaagcaatgatagtacttggaaccagtctgactcacagaccatacacccaggaacactttttcctctcccttcctgcctagacttgtagcgtgcatgtgctcactccctccctctctctccccatctccttctcattgaaggtaatgtaaaagagcaatcctaagcatgatttctgcctgagggtaggagctattttaaaatatgagcaaaatggtaagacttgatggggagttaaagatacctctgaatatcatcttccctgccagagcatttgaagatgagaagaaggctcggatgggtgtggtggagtgcgccaaacatgaactgctgcaaccatttaatgttctctatgagaaggagggtgagttccaaaaagagcttcactttggattccctgattataagatatccttcctgtaagttcagaagagctaagtatgacaaaggaactttttatcaaaacacatcttcatttttgccataggtgaatttgttgcccagtttaaatttacagttctgctcatgcccaatggccccatgcggataaccagtggtcccttcgagcctgacctctacaagtctgagatggaggtccaggatgcagagctaaaggttagtatggaatagaaggtggtgagtatgtacatggtatcctgcttgggagtgagggctaaatgccagcaaagtcctgaaaagagctgcagtactgaaagtaaccctttatttttaatttcctccacatttctcaaaatttttttcccttcttcctgttttccaggccctcctccagagttctgcaagtcgaaaaacccagaaaaagaaaaaaaagaaggtgtgttattaacgatcattcctctctggcagggtgaacctgatccctctttctcccactgtgttaagttgtagtgaaatacggatttttatacagatgctcctcaacttatatgatagaactttgtcccagtaaacccatcataaattgaaaatactgtaagtcaaaatggattttaaaatatatatatatatattttaagagacagagtctcaaactcctggccttgaacagtccttccacctcagcctcccaaactgttgggattacaggcatgagctgccatgcccagccttgctttggccgggcacagtggctcatgcctgtaatcccagcactttgggaggctaaggcggatggatcacctgaggtcaggagtttgagatcagcctgaccaacacagagagaaaccccgtctctactaaaaatac

SEQ ID NO: 69771 - DNA, 1754 bp, Homo sapiens
aagatcagcccgggcaacatggtgaaacctcatctctacaaaaaatacaaaaaagttgtacatggtggcatatgcctatagtcccagctacctgggaggctgaggtgagaggatcacctgagcccagggaagtggtaccactgcactccagcctggaaaacagagtgagactgtctcagaaaaaaaaatacttttatctctggtcccagacatccccaagtagttagaaactgacaggtcttctccctctccttttcttgcatataggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgtttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataatgatgtgctttgtatgctgctcttgtttgatggaggtggggagaatgtcagttgaagtggtattggaactgttcctccacagtgccatgctctaccttcccaaaacgaggaatgtcttgacttgcagaagacacaaatcttagaatctttgatgatatagtaatctgctggagttgggtggtgtaattttctaagtagaaacagtcctcactgctaagatttgtttggggctaggacacaatgtctactgcaaaaacagtactgcaagtgtttatcttgaattcaagaagccaggaagaatggtacactagttttcagggccagactaaggtcagatgggtaattagtttatcttactacatgtcaggaattgctaaactagagatactacaagtgaacaga

SEQ ID NO: 69772 - DNA, 1999 bp, Homo sapiens
tgcgagggaaggtggcggtcactattttttccccgtctgcacctctaggtccaatattggaaataggtgctgacgtttaaataacacagcgtcctcatactaaatctgggggggaactggtaactcgaaaaccaaatactcggtcttccgaaagaactaactcaacctacccttctacaagagggtccgaaaaccactgttacgcccattgggtagccccgcccttggggggggcaaagggcgtgaaagcggaagtgacgacacccggcgctccattaaatagccgtagacggaacttcgcctttctctcggccttagcgccatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaaggtgagcggttcctggtagtaagcttgggaggtaggagttggcgagtagtagcgaggagacgaaggcaagtccgccatacctcctgaactactgggtttcaagggtgcccaagagctggtgggagagagaaggtagtttgtgagagagctagcggttaagtgctatgggtagagagggtgggcttagaaaagggtggaattctgatcttatgttgggagggtgtccaagttactgatgtagttgttacgaccaatctttcatacttcttggttaagaatctgtccggttctaaagagtgcatttcatatccttgctaagcctactaataagcttcatcccttttttttttttttttttttaattatctgctgcttgtgatcggttgctagtggaggaagaagcgaatgcgcaggtacgttgagactttgccagcccaggaggagggaagttccttggacaaaacttaggagaaacatttggtttggaaatcttaaaagatctttaggagaaaaacgtttgagtgttttctccctggagccaggatttaacagaacagagaacgatagaaccgtagtgcttgttcattttaccacctcattctttatgtggacgtttgatttaatgtgggagggaaaggcaactctggtttgaggtgtattccattcctgtgtctgcttttcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcatcttgtctattatgttttttatggttccatcgggtgggggttttctgtcattagagtttgccctgtcactacctgtgctatggagggtatcaaagctataaaggcaacagcccgggttacgtggtgtggtttgcatctcgctggagttggatgggatatggtacgtctctggaggcaggttttaggtttcgcgggttattaggggccaatgctggtaccgcccctttccaggagggctgccttggcgactaccgcttagaccatgtcgtgcctttgggttgggttgccatagtgacacgcaaagcgtgctgggaacgccctgcggcatgtcgcacgcgtacttcatacaccatagagtatggttccgggtctgctggctagagcgtcacttcttccgcaggaagcggaagagcgatcgggtaggcggctctttgtcgaagctagaggaccggcaggcggcagcagcaactacggcggcggcggcaggtgaggga

SEQ ID NO: 69773 - DNA, 1268 bp, Homo sapiens
tcagggctggttttccaacccctcctcccagtccctccgaattagttttactcttcttactggcaacttctcccttggacaggtgaagttcagtttgaaccctgaggaaatcctcacgttctcgaagctttgccgttttgtcagatttcttgtgacaaccaccccatagtcctccactcttactccttcttccacccaagtctctgtttttttcctgctcagaacccagcagtgatgtggaggtggagacccacaggagccccggacttcacctgagctacctcaggtatcaattctgggagagtggggtggggaggagcatcataactaattatctgctgctggtgcgacttgcaacgtgagccaggcttggatagatggcatttgtacttcacctggtcattcccctttactaaaagtttgtatcttcttttaccacttctttccttgattgcttctattattctgggactacctctctttagaggaggaggaccctcttacagattctcttgtaactctggcctctggtttggttagttcattttagggagatctgaaggcaaagtcacagtagtggggtgggggtaggtcaaggccaaaggaattaggaaagattcccttattctcaaagggaacaatatgaagttttcctatttcagcagcagggggagcctgaacaccgcataggaaaggcttgggaggtcagacacgtggtagcagggactccaggtcttactgggggtggagagaggggagggctagaaccagggcagtggactgacattccaaagctctcttgggaaataggagacttaaaaagcttttatggagtctataaataaagaggatctttctgggttgaggaatggtgtggttggatgtcagtgggatcttcacataggggagtaggaagggggtggggaatggggaaaggtcacttgttcctgtgaaattaactccttcccacttgaccttatcacaaatggtttgtcctaggaaatctagaagtggagactctaacttagaactcctatcctgaaatagaaggggcttacctctctgccgttgacagtgatgatggctgggagggaatactaaaatatgacaggttttgagactcccctcaagctggtgacaccagtctcttcacccaggatttcttggcttctagagatttgatgtgtacagagcccttacctgaggaaaaggaaagggggttaaggaagttttgttaccagtgtcccatcttctacagccctagtagc

SEQ ID NO: 69774 - DNA, 1068 bp, Homo sapiens
aggcaagcgttgccgatatcgccacccagacatgagcgaggtgtccaacttgggggtgagcaaaaacgagttcatcttctgccatgacttccagaacaaggagtgtagccgcccaaattgccgtttcatccatggctccaaggaggatgaggatggctataagaagacaggagagcttcccccacggctgaggcagaaagtagcagctggccttggcctttcaccggctgacctaccaaatggcaaggaggaggtccctatctgccgtgactttctcaagggtgactgtcagagaggagccaagtgcaagttccgtcacctgcaacgggattttgagtttgatgctcggggtggaggaggcactggtgggggctcaacaggctcagtcctcccaggacgacgtcatgatctctatgatatctatgaccttcctgacaggggctttgaggaccatgagccaggcccaaaacgccggcgaggtggatgctgcccccctgatggccctcattttgagtcatatgaatatagtttggctccaccgcgaggggtggagtgcagactgctagaggaggagaatgccatgctcaggaagcgggtagaggagttaaagaagcaggtcagcaacctgctggccaccaatgaggtactactggaacaaaatgctcagttccgcaatcaggccaaggtcataaccctgagctccactgcaccagcgactgagcagactctggcccccactgtgggcactgttgccacttttaaccatggcattgcccagactcacactactctcagcagccaggctctacagcctcgtccagtgtcccagcaagaactggtggcccctgctggagctccagctgctcccccaactaatgctgcacctcctgctgctccaccacccccacccccacacttgaccccagagatcacgccactgtcagctgccctggctcaaacaattgcccagggaatggcacctccacctgtctccatggctcctgtggctgtatctgtggctcctgtggcccctgtggctgtatcgatggcccaacccttggcaggaat

SEQ ID NO: 69775 - DNA, 1164 bp, Homo sapiens
gacatcagcccccaaactctgtgaggaatgaacctttggggcatcctcgcccctcgcccaccctgagtgtgaggagtcacacacactccctctcctctgtggcacaccaccagcatcttagtaggaaaccagaggcgagggtgtgctgcacgtcactgtctctgccttccccacctccaggtcagcttcccagacgtggaaaaggctgaatggctcaataaggtgaggattgatttgatttttagtcttcatgaggggagaatgggaatttgtttcttcttgccagacccatcctcaaccctcagtgctctccgtggggaggattctgaaggaacttgccttgagagggaagactggactctcctctgaccatctctctttcctcccagattgtggcccaggtctggcccttcctgggccagtatatggagaagcttctggctgaaactgtggctccggctgttaggggatctaacccccatctgcaaacatttacatttacacgagtggaactgggtgaaaaggtatgtgtggaggagggaaagtgaggaggtaggctagggagggtgagtggcccggagtagactcaggtacttctccctatccctgccctctctcaggaatttctctctccctagccattgcgcatcattggagtcaaggttcacccaggtcagagaaaagagcagatcctgctggacttgaacatcaggtaataccactcaccactcttactgcttccccttcaatgtgtcctgttcagtccaggctacttcactccccctccccgcaacttcagccaaggactaactctcttggttctcttcttcaccaatccccagctatgtaggtgatgtgcagattgatgtggaagtgaagaaatatttttgcaaagcaggagtcaagggcatgcaggtaggccagatgtcaggggccacataatagggaatgtttgtcctgcgtttcatgggatatggggaagtgtgaggttggaaagaccaaggctgagaaagtctgggaggacagaagagggacttttctggggaaaggctttgattttctcttcttgcctcagctacatggcgttttgcgggtgatactggagccactcattggggaccttcccttcgtgggggctgtgtcaatgttcttcatccgacgccc

SEQ ID NO: 69776 - DNA, 1066 bp, Homo sapiens
gccctcacctctgccctgccatcctgccctcttaccttccccagcagctcacgctctcttgacatgaaggaggaattagacttgacagagacatccagctttcgtctctgggcctcatccagggggagttcccactcaaacctggggtaggactggatgttaggggccaggagtcctttccaagcctgccatctctccacctgaatgcccactgactgaccgttcattaaattcaggactcagggtcctcttcttctgtgaggtcctcctcttggtgcctcggttcttgtctggcagtagcaacagtgacacatagggatcaggaggatcacgtccattctgtcgaagggacctacaacaggaggatgtaggtgatatggtaacctgagggaagggatggaggcgatctggaggacaggagggatggggtctcaccggcaaccatgaacaatgctgaccagctttcgttcttcactgtagtaccacagagtcagtttcacctggcccagaggcccggctggagcctcaaggggactgtggagaaatatcagtaggtctggggaaagctagagcctagtgaacctgtaatactttttatttctgactgcgtcccaccttcctgtcccagccctttacctgtcaacatgtgttaggcgctgccggagctctggggctgaggaggtgatgtgagggggtccccccgagagctctggttcttcactcagcgatgaggagctgtggctgtagctgtggctatgagcttccactcccgagtgctgggacaccaggatctaggggcaagaaagctgtgagctgggcagagttctctcagttccctcactctaaggacacggccctctgttcccaccctcctgggtgtccctcacctgtgaaggccctcccctcctccctctcatcctgcccaccatctcctgtcactcacccctagctgtgctctcagtagcacctgcccctgaccactgctgagtgtaaaccagcggtccaagcagagctggtcagccacgaggagctctgagaggggcagggataatgagcccagcacgcc

SEQ ID NO: 69777 - DNA, 1069 bp, Homo sapiens
acaggtaaagggctgggacaggaaggtgggacgcagtcagaaataaaaagtattacaggttcactaggctctagctttccccagacctactgatatttctccacagtccccttgaggctccagccgggcctctgggccaggtgaaactgactctgtggtactacagtgaagaacgaaagctggtcagcattgttcatggttgccggtgagaccccatccctcctgtcctccagatcgcctccatcccttccctcaggttaccatatcacctacatcctcctgttgtaggtcccttcgacagaatggacgtgatcctcctgatccctatgtgtcactgttgctactgccagacaagaaccgaggcaccaagaggaggacctcacagaagaagaggaccctgagtcctgaatttaatgaacggtcagtcagtgggcattcaggtggagagatggcaggcttggaaaggactcctggcccctaacatccagtcctaccccaggtttgagtgggaactccccctggatgaggcccagagacgaaagctggatgtctctgtcaagtctaattcctccttcatgtcaagagagcgtgagctgctggggaaggtaagagggcaggatggcagggcagaggtgagggctggaagctgctggcaccaaggttatagtccctgtgaggaaggaagtaccccacgtgatcctttagaggtgactcacctctgcaatggtttgggacgagtatgtgatgaaggaacatggtctttggagatttcaaaacagcatcatcagaatgagatcctgtctcaaaaaataaaagaaataacatctttcccctatcatcttccaacacaggtgcagctggacctagctgagacagacctttcccagggtgtagcccggtggtgagtgtctgcgtgggtgggggatggtctggatatttcagtgggagaaattccaatcacaggaaaggaaaaaaagatacaatctgagcagagaaccattgattctatcaagtagagaagcccttggatcgtgtctcatttataaatatgatgacacaagagtcatct

SEQ ID NO: 69778 - DNA, 1017 bp, Homo sapiens
taagactggatgcttccaaatgggggactaagggaaagccccaatctcattccagggctcactgattccctaccttctagataccccctaatcccctaggctgtatcccaccctcaaaccaccccctccaattctatcttcactttccagagactcaccaccactttggagagatcgactggaggctcctgggttttctgaggggcctgggggacagctggctcagctttggtcttggctggaggagcccctgctgctgctggcttagcagcaggtttggagatggagggccctgctggtttcttcacgggaacatccttcttgggaggcatgatgtccggtggccaaaggacagtgtgcggatgggggcacccatctctgtttaaatagccagggagtctgggatgtcaaggggcgggggcaggggcagggagccagttggctgtggcaaagatgaggtagaggagagatataaccgcctgccctcactcccctggcctcctatggttcaggactcctgccccaaggtcttcttccctctgtccccttatccccaaaggctgaccagaaaagaacaatgtttcctttaggggtaggggaggaagccagagactgcccagaatgaggtagttaacctccagggtgaggataggatgcttgccagtggcactgagatgggggtggtgaggcaaagcaggtgatccagcagctttagtcttcttgaagggtggggtgaggggtagcagccagggaggcttgtgtgaactggaacaagttaaagtgtggtctgggagcaatgacaaaaacaagaagcccatctgcccagcccctccactcccttctgaccatggctttgtaaagagcaggggtagttaaccttagagtctaatgatccctaatacttgtagttcctgagcccccacccagccaagaactggaactattcacagtataaaggaagaatagtcataaaaacaggagtatgacatccctcattgtctcctgtgcccagtgttg

SEQ ID NO: 69779 - DNA, 1026 bp, Homo sapiens
ttatactttagagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatggtgaggggacccttgggaacaatttgggtttttagttttcaaaagttggatgttggtaacaaaaagaatgaggtggatctcaggacttcaaaaactgtcaaacacagaagcaggaaaatatcctaaatgctgaataggatgaaagcattgtggtagggttgggagctgggtcctatgtaatactacaatgacctctcctttacctctctccaacctccagagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggtgaggcaggcaagggggaccagaactcctttagagtggagagggggatggggtgggccagaaagactggacagataagcagagctagcaggaggcttactgtcctgcaggttgtcggcaggagactgagaaggtcagagctatgggggtagaatctgaaggactcgctcttccagaggctaaagtgccatccggagggcagaggaaaagggatgaggcgggaaacctgaattttcattttggaagagacgtgtgggttgtgtgttctggtacaagtctcgtaacctcctgggattgtttccttgtgggtcaatactttcagcagtactagggtgaaatggaaagcaagaggcatccatgaccaggggaggattcccttgaggactgaggctatgggagaagaagaggtaccactctaaagagcgtggcctggccaggtatggtggctcacgcctgtaatcccagcattttgggaga

SEQ ID NO: 69780 - DNA, 1580 bp, Homo sapiens
ttcagactgctatttttttcatggttgggggagcagcgggagacggggagggtgctaggaggagagggcgggaaaagagggctctctcctcttccaatcctctgatcttcctgctgttgggaggtgcagattcattgtgccccagcccacgtccccccacgacccccgcccccccacctccccccacgaccccccccacctccgagcgggttctgtgcccaggtggcgctggagaaaggaacagcggaccccgcccaagtcattactaatgtagcaatcgtctgcataaacccaggccacggttcctattggctgagtcctctgagggtgacgtcatcgggacgtactaagactagggttgggccgagagtcggagccattactgcaggaaaaggtcccggagagctgagcagtcaagatggtggggcccaggtcttgggagacgggcaggattggggacgagaggcaggaagagacgggtggggggcgaggagaaggcaggggtaggaggcaaagggaatctgaggacccgaaaggttggaggtggggttggaaagactggggccctgcggggaagcgagtctgcagcctgaaacaggagtttgtgggtcagagtttgtgggtcagagtttgtggggctgggatagaaactcgggggattggcgttcagatgctgaccacttccctcttctctgagcagtgtgacttcaccgaagaccagaccgcaggtaggttatctctgatccctaccgaggtcacccttagggagagggacaccctccccccagcacctatcctctaatcttaatctgtcatctctttagcacccccatgagattaccccctggattattttctcttcttctggatcctccattttcttttctcactttcttcctccctccccttccactctagatctgatcccaagcactgggtgagttttaggtggtgtgggtatgtgaaaaaacttggtcacttaatgcctgctgtgtgtggggtctcgggagggtgtataaagctgcctgctttcctttgtcctttaatcagctacttctgcctcttttctcctcttgtgataactgtccccgccctcccagcttgcagttgtgaagattgtagagcagtgacctgatattctgtgcagatggggacaagacaggggagtttgctaaggatatgactgtagctataccctctggaagttctctttatactggaggggtgcgaagtggcaggttgggatgaccctagtcccaggctgctgctcccacttccttataaggacaggactgagactgggcggtggcgaattcctgccctgagaagtgtagtagcagcagtggagattggcaggcctgccgcaggcagaggggttgtgtaaatggatgttaccaggctgccagaaggggaggaagcctctatatagaacacttgagttgggaggaagagaaatagagccctcttaagtagactttggtgtacagtttggtgcagatatctcgtttcctcagcatgatcaaagttgaatgggcagcagagctctgaggtagggtttggattaaccctcaaatcctgtg

SEQ ID NO: 69781 - DNA, 1939 bp, Homo sapiens
cagggcacctatgaggattatgtcgaaggacttcgggtgtttgacaaggaaggaaatggcaccgtcatgggtgctgaaatccggcatgttcttgtcacactgggtaaggttctgtgtccttgtccttgagctgagatggcaccctgaggtacctcacttgtcacccaattccaaaaatgctttctttccccctgcaggtgagaagatgacagaggaagaagtagagatgctggtggcagggcatgaggacagcaatggttgtatcaactatgaaggtaagaggtgaactgcgctttctcagagaaagcagccatatggggcaggtcaagtatagtgtctggggctttccctatccctggacttgggctccaaaaagagccaggaggcaaggtgcagggccctgcccagcccagcccaggagtgggaggtcagggcggtataacaggaaaggaagggggtagtattgtagagggtgggaaggaatgagaagtgaaataatggaatgtctgtccccactgcctgacccctcaccccatgtctttgtcttgtcttcaccatgaatgtctcttccttcctgcagcgtttgtgaggcatatcctgtcggggtgacgggcccatggggcgggtacggctcctcccagcctctcctctagttgatctccccagtgtttcttttttccccaacctgtgctctttatcccctgcccttaccctactaccatctgacttcctcctggcatgtttctgcatggagctgactagggaggggagggattcctcaaagaggaagacaacctgggggtacagtacctccttacctctagaatgggccctgaggttttacttatgcggccctgggtgctggtgtctgggaactctcaccagcctgtataccagtcttgctttagggtgaccttctggccctggagcatgggtagctggcatagaggggtatgggttgcctgccccattctgctgctatagctgaacagtcctttccccttccctcgctgggcagcttggaggtaccctaacccaaaactctgtcctctcctcccgccagtggctgacagtagctgtaggtgtagtggagaacttttctgcctctgctgtgttcttgctgcttaggtttgggtgggggactaacagctgctgggaggggagctaggggcatggagaactggtcagactcaaggtggctcctctgcaaactgaccccagggttggttgctgtgggcatgttcccgcttatgctacctttgcagtctggtagtcccctggcccttggcgtacccctccacagccctgttccctggctcatcccacctttcctttccacagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggccctcggttcggttctttctttcctgaacagggtaaaggggaagaaggtgagatggtgatgatttctgccctgaggcagagtccaaggtcaatcaatggtgcaggggttgaggaaagctgggggaggccctgtactagccatctgggcttcatttaaaaactactggccccattcatccatcttacacaagctacctcttgggagattaggaaagccatagatcccagtaggactaaggctggccatccctgttccattccatatcaggctgtcttctcctacccttccagctccttaaatctggcccccgccctcccaagctcccaataaggccttttgtggggaagcctgtggagtgtttattggagctaaagccaggccattattagcactgcctaagcctgtccgt

SEQ ID NO: 69782 - DNA, 1124 bp, Homo sapiens
gtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccagcttctcccctgtgacgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaattaatttgctttcagttccatcttgtgggtgcattctgtgttcttacctgtggctgtcaggcagggggattgtgatgg

SEQ ID NO: 69783 - DNA, 1014 bp, Homo sapiens
ggcaagttcaaagctttgtagctgaagtgagcttgggccaggttaaagtcattgcaataagaaaccatgtgggcactcaggagacataaaggtcatgggaatttgcacgaagtcgggtggggaggacagagggagcacaagcacaagatgtagattttgggaaccttctgattgagaggcaggctctttcagaagaagacaaagcaggggttgaggcatttgcctttgggatctgctgaaaattggataacaatactcaattggcactggcagctggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggtaagtgttatgttccagaacttttgttggctagaggaatccaggtgaatgtcccagttctcctcaaaggggatacaagatgagtgtggagatgaggttagcctcaatttctacagatgggcccatctctcttaggcccctaaatcagcaggagtccttccccaaactcgagagctttggaattttattcacttactctagtgtcagaaaaggggaagatagtgccaaggaatggctagattatccttgtttgtaaaagtgagttattctttgggaggccgaaatgggtggatcacgaggtcaggagattgagaccatcctggccaacatgttgaaaccccgtctctagtaaaaataca

SEQ ID NO: 69784 - DNA, 1041 bp, Homo sapiens
tggatcacctgaggttgtaagtttgagaccagcctggccaacatggtgaaaccccatctctactaaaaacacagaaattagccggcgtggtggcgcatgtctgtaatcccaggtactggggaggcaaaggcacgagaattgcttgaacccaggaggtagaggttacagtgagctgagatcatgccactgtactccagcctgggcaacagagtgagactgtcccaaaaaaaaaaaaagaaaaaagaaaaaagacacggtggctcacgcctataatcccagcacaaaaaagtcaagccctttcaccatgggttgtgaccacagcaaatttgttcttatacctgccagcatccaccctacctttcttctgtattgtcttcagttgggtcctcccactgatgtgctgtctcgcccctccttccctagcacttggctgctgttgaggaaaggaagatcaaatctttggtggccctgctggtggagacccagatgaaaaagttggagatcaaacttcggcactttgaggagctggagactatcatggaccgggagcgagaagcagtgagtagcaggagccctggaaccctgctgcgctgtgcctcagtttaaaatcggaggggcgtgtgtgtgtgtgtgtgtgtgtgtgtgtgtgtgtgtgtgtgtgtgtgtttcagtgaaagagagataagcaacagtggggaaagcctgagtgtgtgtgtgtgtgtgtgtgtttcagtgaaagataagcaacagtggggaaagcctgagacagacagggcttcaaagcagagcagggcaggaacagggcaggagtagggcagccagttagagacagttaagtggtctcacaagtgaagtctggggactgaagtcccacagaaggtcagctccatgaggcagggactctagttggttgttttgattgctgcatctccaggtccttgaacagtgcttggcccatagtagactcaaatagtgattgagtgaatgggcgtaacggatgatgagagagagggtaagagcctcagatccaggaggtgaact

SEQ ID NO: 69785 - DNA, 1334 bp, Homo sapiens
ttaacttcatatcctttcttagtgctacttcaagatcccccttggacctagcagagtacacaaataccagaacatagagaactttgaaaccagctgcccttagtaggatggggggagtcagccttcgagaaaagtggctaagtaagcggagttatgtctccaccactaccaccaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctaggtaatgggggtgggtggttccacctggccttcttagtttgcttttgaagggctagttactcagactgtgaatcctctcaagtttggctgccctgctggccttgtctgtgcgggcctcagctcaggcacctgtctaggctccatactagcttagatgaagacatgggcttgtgagtaagcttttgcagggattgccagaactgttccactgtgccgctcccagcctcattctttctgggtcttgcagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattggtaaggccaggcaggttcccagatttcttgcctttcacaagatccagagctacctggcctcctgtgccatttctgcctcaagttggcattagagcacaacatgaatgagaacattggtagggtttttattttccccatgagtttacctcaggggctctggagccctactagtcctctcatgaagattttgggtagaaaaatctttgcttgtagaaggggctgttagaaaagtcttgtgaaggccgggcgcagtggctcatgcctgtaatctcagcactttgggaggccgaggtgggtggatcacgaggtcgggagttcaagaccagcctggccaagatgctgaaaccctgtctctactaaatatacaaaaattagctgggcgtggtggcacgtgcctgtaatcccagctacttcagaggctgaggcaggagaatcacttaaacctgggtgccagaggttgcagtgagccaagatcaagccactgcactccag

SEQ ID NO: 69786 - DNA, 1263 bp, Homo sapiens
acccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctctaaattcttcagcattactccctttcttgagaaggtttcccctctgcttttgcctttctctcaccttaattccctttcttccttactttgttacctacccttatcttagtgctaacttctctttcaggaggatgtctgggagtagtgtgcacttcacagctgctttcccatgtaccctcctgcattcttccctcctatctcctgttctgtagcagccaaagctctctagtgatctgaactgtgtgcttcccagggtctgcctttatcctaaattccatgtcttccctgagtggtcctgagtttttgggataatttctacagaagatatgtatatatctttttcctttgtcccacaagcaactttgctttagaatctagaattcctttgcaggcagagaagtctctacctcccagtgtttcctagctaagaacgtaaatgtgaggagggaaatgtacttgcagaggtttcataattatttacttataaaaatagtcttcatagccgggcgcggtggctcacgcctgtaatcccagcactttgggaggccgaggtgggtggatcacaaggtcaggagttcgagaccatcctggctaacacagtgaaaccccgtctctactaaaaatacaaaaaattagccgggcgtggtggcaggcacctgtagtcccagctacttaggaggctgaggcaggagaatggcgtgaacccgggaggcagagcttgcagtgagca

SEQ ID NO: 69787 - DNA, 1075 bp, Homo sapiens
ctgggactataggcacgtgccaccaggcccagcttttttttttcgagatgtattgcccaggctagagtgcagtggtgtgatcttggctcactgcaacctccacctcctgggttcaagctattctcctgccttagcctcctgagtagctgtgattacaggcatgcgccaccacccctggctaatttttttatttttagtagagacagggtttcaccatgtcggtcaggctggtcttgaactcctgacctcatgatccgcctgcctcggcctcccaaagtgctgagattacaggcgtgagccactgcgcccggcctatgcccggctaatttttgtaatttttgtagagatggggttttgtcatgttgtctgggatggtctcaaactcctgaggtcaagcagtgtgcctgccttagcctcccaaagtgctgggattacaggcatgagccaccgtgcccagcaggaaacgtatcttaagcctgtcccctacaatgccttgcccgtagtagatctatactttgctgtgacccagtggacctcttgtcgtagaggctgctcaaaggcttgattggctttgtagagttatatcatatccaggctcttaggtcctgctaattcccttgcgccccttttgccttgttctctcttctaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtgggtgagatttgttcccttctgccccacatggataagggccatctcatttatgcccctgtctctggctgccctcctcactagctgaggaggtctctttggcatgttggcaaggagtattcttagcctccttggcttcctgctctaagatcttactt

SEQ ID NO: 69788 - DNA, 1995 bp, Homo sapiens
gtatgggcccccatcccgcctagtttgaaccctaccttttaagaaggagggataaggaacaaagcagccccttcccctctaattgtggtggctccagccttctgcagccttgacccaggttgggcaagggcggaggtgaggaatctttgaggaccaagcccagtggtctgggaatcgggaggtagagagggaagggtctgccttgggggctccctcctcccaacccaacccctagagaagcgaccaaatcccagagatggggtgaagctggggtggggagggtctgctctttgaattacttgaaggtactgactccaaggctgctgttgcccacttaggtgtgagggggacactgtcactgcatttgggagggcagagggtggcgggtaaccagaggatccaccttggccctcacccactcctgctaggccctttccctggggaatctggaagcctgactttgcccccagggaagttggggaccgccttccctcccttctccacctctcactctgggcaccctctccaattgcactaaagtagctgttgtgccagtctgccccccacaaggggggaggtctctgcttccagtcttcttcccccgctgcctccgctcccaccctggacaatctccttgtttcccttgtgttcctggatagctcagctttgtatgtgtgtttggggggtgggggtgggttctggcttgagtgggtttggcaggggtttgggaagggttaggggaggatggaggatgaagtctcctacccccttctccagctccaggccacagaagcctgggaagggagggtgcctactctcgctgctgtgtgtcttgcagatgtgccaaaatgggggtgggtgggaggggagggtgcctggcagagcagcccctggggtggctctctcaaagcaatatagttcccctgcgggggacagcaagacaggggagagggttggggtggggacctgggggttccccatgtacagctatgtatattcaggggtgttctccgtctggtacccgctgtgggcatctatgtgtgtgtgaacctccccttccccatgccctgcatgacctgtgatgctgcagacaccaccatcctgtgtgcaggtgtgtgttggggggcacggaggggcatgttccatgtcctgttgcaccctccaccctgtgacccatgtactcggttgtaggaagtaaagagaactgagcacaattcactggattctagtggaatctttctctaagcaattttcccattcctgcctctccctgccccggaaccacctgtggtgctagtgttgggatcgggggcgtttaacgctggtgggcagcaataaggggcagatgtgcccagatgcctgcatccccagggtgccgagggcagcaggaaaaagtggggacctcggtgcatttgccccacccctcccctccctgggctaaagcacaatgttctccccgcagattaatgaccctgcaccctccaggcccctactcacatcctcccccaaccggcttcgggtcctcccaccacactctggttttctatgctgttttggtgcaagtacaactgtcgtagtcatggctttgggatgggttctgtttattaaaatcctattgctcctactggccctgtgtcccgcctccattcctgtggttggggggaaggaagggcaacccgacccctttccactggccccatcagccctcagtggtcacgggcagtagccgctcctccagcagggttatggcaagcatgaggccgccccccagcagcagccccagcccctgcaggagcacatggggcgtaggcaggggctccggaggacgaagcagggctggtagctgaaagaaaaagaggatgtcaggattctggccttgcccctgacctctcaactccagaggaatggtgtcagaaagcatcagcagcccccacccaaacaccttagtcccttgtttctcagacttttgcgggcctatggtctgacgcccttcca

SEQ ID NO: 69789 - DNA, 2807 bp, Homo sapiens
tcacaccccagcactggcctgtgcccccaacaaagatgtggcagactgcctggccttgatcctttccaccatgaagcctttcccacccaaggacgccgtcagtcctttcagcttcagcctgctcaagaactgcagcattgcagccgccaagacggtgggtggctgcggcgccctgccccatggggcctcctgcccctacagccaggagcggcccggcgccattgggttagatggctgctactctgagtagccccctccagtgtccctcccccgccggtggcttgatatctaattctatttatttagaaaaagtctaaacatttagggcactttaaaggagaacacgactgggtggagggggcggaggggaaggaagccctggggagcagctgctcacccctttgccacaccatcttggcctggcaggggtctgggactgacagggagcaccccaggcccttggtacccccagggcgaccccttctgccaagtgtcccaaaatgattgctaaatgcctggctcccccactctttgactccatctcttggttccctctttctgctgccagctcccccgactcttccctggggactcctctctgtgtcccccttctcccctgcccctactgccaggcagatcccctcttcttccatacccatcactgcctccctgctcggccggtccctccatccccgcagcagtgagaagccttaatttctggtactgtgtgagcactctgggggtgtccccctccccccttcaggggcagctagaggatgaggggggaggatatttagcactggggcctggagctttttccccacttctgtaccctatcacccctaaagttcaaatgcaaaacacttgaagcagcaactactgtacctgggccccaatcctgcactctcccctggctcctcatatgcaaatcaagggctggttctgcccccacagcctgccccctccccattccctcccactcctagcctggcccctaaccacgcactttaaccttgcttctttcttttatcttcttttgggagggcagagcctgtggtcattcctgccctggctctccttcccttgaactttgaggcttgtcatgaatttttaagtaagcgttttatcctttaggggaagaaacaaattaatttcctgcccatttcaaaaccacagccctagtatgtccactgtgtttcaggcatgtgtttgcatgtatatggagggagggaccatgttcttcctcctgtgccgccaagcccatagtttatctgtgctccctatctgcctccaccttccgttatgtccaagagtacccactgccccagtcactcctgatctgaagccaaagatggtaggaggggcagggccgacaagggaccgtggctactcgggacccaggcttcccctccagtgtgaggaagaagctctgacctagagagagatgaataggtactggggcttggtccctgccttcccagcagggaggaaagatgggattgagctgggggctgcactgataagatttctaaagtcgcaccccaaaagccaaactgggctggagtgaagagggggcagttttctctctaaatgtagcattgaatttggccctggtccctttaagtgctctgtccacccatctcctagtgcagcctcctggacagttggacccactcctgcagcccagtgttcccttcctcacactcaatacctcagccaggggccaagacacagaacttgaatagaggtcatgccccctccgcccccacactgcatccttgcccagtttggctgccatcagtattgtcccctgagaactggacaggcttcgtttacacagtacagggtctcccctgaggggggatccttcagcctccctcccctactcaagtttgctttattcacagtcttacccatcttttagttgtataccctgaatgtcttgccacccttgtcaagggtgggctgaggggaggggggcgtcccagggaccccctccctccccaacggatacctttaaccatacctcatgctggtttccagaagcctggggtgttgtccaagtccttatcttttcatggtcccttttgatcccctgtctctctgtgttttgcttctcccaaccctcagttcctaaatcatttcaaggcttccaaatgaccattattgatgagaaggattgtgcagcttttagtttttatttttattttcaaagccaaagggccttgtgacgcccctcttgcccacctccctccacaccgtgtcctcccctatatgacaatcaatgtgacctctcttaagggctgcagcccccatccccaaccctgctggctctgcaaagcttgccttcccttcaattctctctcctgaaatcttcccattccaccccctccctctcatcttggtgctgggaattaggtggtggggggcaaggggagtgagaagatgggtcctccagagagaacttgccgggtgtgagtcgtgttctcctttcgtgatgtttggtgatggcgggaagcgtctgagtgtcagagccccgttgtcttgctagatgagatttctgggggctgtctgcgccctgctgccctcagcgcactgtcagcagtgctgggaggtggtggggagtcctctgtccctccatatgtggctgtgaggaagcctgggggacaagcagcctcctctccttatgccaaaggaaaccccacgccccaccctgggctccccagccctagtgttttttgaagcattttgaccattctcatggccactgcatatttattttaatgttaagattttttttaaacctc

SEQ ID NO: 69790 - DNA, 1305 bp, Homo sapiens
caagattgtgaacagccgagatgccaaaggacggtgagtgatggaagacttgggaagaatcccagttgcctctggcttcccctttctgcttgggcagtatactcttccctattttaatctaccctgatccctgccttacaggaccccccttcacgccgctgccttcgcggacaatgtctctgggctccggatgctgctgcagcatcaagctgaggtgaacgccactgaccacactggccgcactgcgctcatgacggcggctgagaacgggcagaccgctgctgtgggtgtgtaggggccacttgtggaagggaggagctcccctggggcatttgcaggatgggtcagccctgcctgtggaggctggctggggctggggttcagaaagcaagagggttgtctttggatgtctcgccatctgcagacgggatgcaaagtggagagccaggatggctactgctctggagggaggggtcagtccctctatcacatttctctcgtagaatttctgctgtatcgagggaaggcagaccttactgtgttggatgagaacaagaacacggccctccacttggcttgtagcaaggtacttacctgaagtgattgggggactgcataaggggcagagcttgatgaagagaggtaagtctcggttgcagaggggactggggcagaagtgaggattgtccagcctatccgactggttgggcagctgtttgtcctcctgttactctccccaactcctgccctgcaccctgccacatttctacttcacaagtctccactctctgttcccctccctcagggccatgagaaatgtgccctcatgatcctggcagaaacccaagaccttggccttatcaatgctaccaacagtgcgctgcagatgtgagtgcctggggaagggggctcctggctgggggaggccagtgggtgatgaaagagtggccgctgttcagaggctctctggagcccattgtatttgttcagcacccttgccaccctgtctggaggtggaagggcagcttagcatcaagctccttctttttccttttttccaaggccactccacattgctgcccggaatggtctagcttctgtggtacaggccctgctgagtcatggggccacagtgctggctgtggatgaagaaggtgggtggggtctggggccccatgcctctcttgggtttggggtcagggacattcttcaggaggtgacttcttaatcttgctatacatgggattttcttcccaagggaactcttcagagcagggagcccacaccagtactctggagtctcag

SEQ ID NO: 69791 - DNA, 1047 bp, Homo sapiens
agaactgtgccctcctgggctgggcctgtccctgcctcacagtctacccccggctccccagctgtctggagttcttactggataacggtgcagacccctccctgcgggacaggcagggctacacagctgtgcactatgcagccgcctatggcaacagacagaacctcgaactggtatgtgttggggcccggcctgcaggaggggaggcaggggcagggcacagggtttgtggattccaaaactaagggttcaatcaaatgtggtctttggatccagaggcttagtggggattactgcgagtcggggactggggtactatcttgggagttccagagtctcagcacctactttcctgtcctttgcagctcttagaaatgtcctttaactgcctggaggatgtggagagcaccattccagtcagccctttgcacttagctgtgagtcccacgtcttttttctgttgccttccttgtcctacctgttcccaggccctaacaaaggtgccagcacttgtgaagttatccttccttctgcctttttgtgggagaggggataagcacagtgcagggtaggaagccttaaggggcccaaggagcttgtcaaggactaagaccttgagcttcccagggaccccaagagcagagaaggggaagggaggagcagggaaggtcccgagctgtgtgcactggttgcctgcaccttgccaggcctacaacggtcactgtgaagccttgaagacgctggcggagacgctggtgaatctggacgtaagggaccacaagggccggaccgcactcttcctggccacggagcgcggctctactgagtgtgtggaggtgcttacagcccacggcgcctctgccctcatcaaggagcgcaagcgcaagtggacacccctgcacgctgctggttagtgcccactttaggctgctgccctacccttgccatgccagatccctcctggatgggaatggggctggaaagtggagtagggtgaggagaatggagacttcaagccctgattcatagcttcctatcctcagagat

SEQ ID NO: 69792 - DNA, 1023 bp, Homo sapiens
aagaccgagtctcactctgttgcccaggctggagtgcagtggcatgaacttggctcactgcaacctccacctcctgggttcaagcaattctgcctcagcctcctgagtagctgggactacaggagcacgctgccacgcctggctaattttttgtattttagtacagacggggtttcaccatgttgcccaggctggtcttgaactcccgagctcaggcgatccacctgccttggcctcccaaagtgctaggattgcaggcgtgagccaccacgcccagcctaatttttgtatttttagtagaaacagggtttcgccatgttggcgaggctggccacgaactcctgaccgcgggtgatctgcccacctcagcctcctaaagtgctggaattaaagatgtgagcaaccgagccaggcccctgtctccatttaaaataagtaaattaaataatttttttttaagatttatttttttaaaaaggacactaaaatccaagaggctcagctattaccttcagcaagttacttctctatgcctcaatttcatcacccacagtaaggataaaaatagtatctacttcatgggatctttatgaggattaaattatttaatatacatgaagtacttagaactgtgcttgacagtaagtgctactttattattattactactactacaactactactaaggtatgagaagactgccaagggagcacagaggaagaggcatcttccccagggaaggctgggaaaggcctcacagaggagagaagctgggactgagtttgagatgaacaggacttattcgggtgggctgggaggagaaagcatcctagggcaggggttggcgtgcctggaggtggggaaagcatgttggtcagcagaaggctgataactgaacatcatgctctaggttctctaggagagcattcagaggataaaggagggcattgaagccagaggggttcagggcagaccttgagaaggtaaagtgggtctggagctgccattgaagaatgggtagg

SEQ ID NO: 69793 - DNA, 1638 bp, Homo sapiens
acaagggcttcacgccactgcatgtggctgcagtctccaccaatggcgctctctgcttggagctactggttaataatggggctgacgtcaactaccaggtgcctgaagggataaggcttagaccagtggggagcgaaacttggatctaggggtcctgactgtatctggatagctctcttggggaattatccacttgcttcctagggtaatcagaccttgccagggactcaggaaagagtgggctaagaaggtgccatatgacccttttgtccttagagatatgtccttggaagggaggtagggcattctctgtgctttgcactggaaaaaaaaacaaaaacaaaaacccaccatgtttccacagagcaaagaagggaaaagtcctctgcacatggctgcaatccatggccgtttcacacgctcccagatcctcatccagaatggtatggacctgggagactttgtgctctcatcccctcctcccccaaggaactcatttctagaatctagggaggttcctaacttccttctcctgccctcttccagtaggataggcccttggaactctgaccaagggacctgtggaaatggccctgctctgccctgcccagtctcctaaggcctagaaacaggataaaatatgtagaatcctgggcctggcacctgatgcatacatagtaggcactcaaatcatggctagctcgcgaaagtggtcttaagcctgaggtctgcctgagcttgtgtgtgtgcatcccctcacaggcagcgagattgattgtgccgacaaatttgggaacacgccactgcatgtggctgctcgatatggacacgagctgctcatcagcaccctcatgaccaatggcgcagataccgcccggtgagtcagggccccgactccacttctgggctgcccagatctgcacagactgctcacatcaaccatggaggcacagataagcttgccaaagggcaccttggagaacctcctaccctgactctagggtggtggtaggtcacagaagaggtcttacttggtccctccttgacccaaggactgagtccctcaacttctctctaggcgtggcatccatgacatgttccccctgcacttagctgttctctttggattctctgactgttgtcgtaagcttctttcctcaggtatgtgctgatgggctggggattggcaggtgtataggagagcaaaggcctttccctccctgctgaacactctcagatgtgacctgtggctgttctgtgcctccaggtcagttgtacagcattgtgtcttcactcagcaatgagcatgtgctttcagctgggtttgacatcaatacacctgacaaccttggccgtacctgtcttcatgctgctgcttccggagggtgagttctctttctctctcccatgctttgagcagggagctgggcaaaggtctgggcccctcattcttgcctgcccagatctattccccctctcacaatgaaagcagtcacagcagaaagggcttgctagtcccatccttccttagccccaccctgggcctgtggcttccctttgaggctgtaactctcttaacacatctttcttttaggaatgttgaatgtcttaatttgctgttgagcagtggagctgact

SEQ ID NO: 69794 - DNA, 1107 bp, Homo sapiens
gcgcttcccacacacccctttttctcatccccctcaccccgcccccagccctgtccttagctgccctcgaccttttgcactcgtgactccctggccagagagagcctagcgggctgcagcaggtgctggggggaaagcttgtttggacgaccttcgtctgggatgcactcttcttctccttcacctacaaatgatagaggattacgaagaactatacggttggctcctctttcctttggccttaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtaagcattctctgccttgcatccttgcacctcccttttccctccaaataaccctgtccaggcaagaatgtcagggtatcatcggtgggcaagattcatccctagccatccccctccccagctacaatactgatcctcagtcctcccctgccactcttccgaccttaatttctcccttcttggttgctgtgcatgtgcttaagtgaaatgagactagggttggactatactttaagacaacagggcgtagctgggtgcggtggctcacgcctgtaatcccaggactttgggaggctgaggcgggccgatcgttttaggtcaggagttcgagaccagcctggccaacatggtgaaaccctgtctccactaaaaaaaaacacacacacaagaatcagcctggcacggtggcgggcgcctttaatcccagctatttgggaggctgaggcaggataatcgctggaacctgggaggcagaggttgcagtgagctgagattgccccactgcactccagcctgggcgacagagcaagactgtctcaaaaaacaaaacaaaaaacagggtgtatttttctggtgaccatttaaaaataatttttatgggtacctagtatgtgtaaattagcagcgtaacctttttagtatattttgagcataatagctaaattatcgagcacttgctacatgctagcagcttgacttagatgttttacataga

SEQ ID NO: 69795 - DNA, 2689 bp, Homo sapiens
gtcgaggctgccgtgagatgtgatcatgccactgcactccagcctgggtgacagagtgagatcctgtctcgaaaaataaaagaatttctactgagaatactatcttttttcctcactctttacaggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccaggtaagtcctcctttccctcttttccctctaatttgtaccaaaccctattgttatctgccatgcacaaagtcaattaactcctagtcagagcagggacttccctcacagagcattttgataaagttgactatgagagggttgggggttggggttgctctgttttcagaatcccaattgctatacttttctcagtgtcatttctatttaaggttgactgggctaagtccttggagaaaaatggaaaatttagcttttaaggtttctatcacctaggacttgtacatgccactgcctctgccttaaatgaaatatttttctcttctaccttacagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaatgcttgagcctattattaaataaggcctggaagaacctttattatgaggtaaggaatctggctagcaagatcctgaacttagtgggttataagtaatctgtatccatttatctttaggcaggtttggctttcttttaccttaaccagaggaaagcctccctgagaaatttccagaggagatttctgtccttcctcaaggttaggaagtccttgatgtttagcccctaaccttgctaattttgttgtaaggtaacatactcaagggctatagctgagattctcaattgcttatgtgactaatccaagaactggtctagcccactgagagaaaggaacaaactaccaaggacgaatgggctagtactgctacctcaggaccagagccactagagggctctggtacttcttggagtgcctgctctttatagcttccctgaaggaggtcccaaaaataacaagaggtggtcc

SEQ ID NO: 69796 - DNA, 1053 bp, Homo sapiens
ccgccttggcctcccaaagtgctaggattataggcgtgagccactgtgcctggccaagattaggatgtcttttacaagagtttaggtataactgactggctataggctggcatgagcccataactaggctagtaagtggcaaataagagaacagcaaagtttccataatctgccccttctttcttcccttggctctcccttcttacttccccacagtgaccatgagggtggcaatgtaagtgcccataccagccatttggtgggcagtgccctttccgacccttacctgtcctttgcagcagccatgaacgggctggcagggcctctccatggactggcaaatcaggtaagactattctttttattttcctgctacatgttttccttaccccatgctttgtttctgatcttggcattctcttctggcatatgtattaacattccctttttccccaaaccttacccataggaagtgcttgtctggctaacacagctgcagaaggaagttggcaaagatgtgtcagatgagaagttacgagactacatctggaacacactcaactcaggacgggtaagcagagatgcttaacgactaggaaagaaaccaagacacaagttctgcaatttggaagaattaagaaaagaatgaaagaggtccctaaattagagatttttttttcttcatttatctaccttgaagaatttagaaaagaatttctaggtgggcacaatggcatgcacctgtagtcccacctacttgggaggctgaggcaagaggattgcttgaggccaggagtttaaggctgcagtgtgctaagatcactcctgtgaatagccactacactccagccaggacaacacagcaagaccccattctctaaaaaacagttttaaataggttgagtgtggtggctcacgcttataatcttagcactttgggagtccagggtggatggatctcgtgagcccaggagtttgagaccagcctgagcaacacagaccctatcttttttttttttttttttttaaagacagtcttgctcttgttgccca

SEQ ID NO: 69797 - DNA, 1094 bp, Homo sapiens
gttggccaggctggtcttgaactcctgacctcaaatgatctgccagcctcagcctcccaaagtgctggcattataggcatgagctgccgtgtctggctgtaaaacctgctgtcttaacacattgaacgtcaagtcatggtgtagtgaaaaagatcatgattaaacatatcagagggccaggcatggtggctcacacctataatcccagcactttgggaggccaaggcaggcagatcacctgaggtcgggagtttctagactagcctaaccaacatggagaaaccccgtctctactaaaaatacaaaattagccgggtatggtggcacatgcctgtaatcccagctactcaggaggctgaggcaggagaatcacttgaacttgggaggcggaggttgcagtgagctaagattgcgccattgcactccagcctgggcaacaagagtgaaactctgtctcagaaaaccatatcagagttcaaacttgactttagcatttaacctaatactatgagccttagtttactcatctttaaaatggcagtcattatatactttgtagtagtaagcattgggaataatgttttagtgtacattagatagtattacaaatcacttagtgcctgggtcataatagttattcagtgaaatggttatgattgttattctctactttcaaacatactcaatatataacaacccatcatataactaaccatcaacccaaatagccccaattcatggaggacagacgatatccctgcctaattcttctttgctgataattcctttttttttctccatcttgctcctcttctgtcagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacaggtaagctagacccagcaaccacagccactaggtgcctcaattggtgggaaatttttttaaaagctcctttatgt

SEQ ID NO: 69798 - DNA, 1052 bp, Homo sapiens
agggtggggaagaacccctgcctgagggcttattttggctgctggtaactggacatatcccaacagaggaacaggtaaagcagaaggatattattagctcttctcattccccttcttcattgcctttctctaatctcagacacttaatgctgatccggcatttatagagatgcgtagtgaagggaaggaatcagcagagttctgctgtataaatggattgggttgacctctcttgggttttctttactcagatgttgctgtccttttttatttttctccttccttgtccttgctggtgttctgagcactgtctctttttccacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggaggtaggaaatttgggtggggtgatcggtgtgtgatggggattcaaaggacttgagtgtgaagggagggaaaaaatacagaatctttagaaaaattacctctgagttaatcagaaactaacttaacagattttcattggaggcttgttttttgtcagttgttggaattacaaagctaagtagagcatggtttctatcaccaggactgtttgtttggttaggctgacacacgtgcagaaaaaagaaattattaaaattccatagtcggccgggcacagtggctcatgcctataatcccagcacttggggaggccaaggcgggcagatcacgaggtcaggagttcaagactagtctggccaatatggtgaaaccccatctctactaaaaatacaaaaattagccaggcgtgatgccgggcgcctgtaatcccacctactcaggaggctgaggcagaagaatcacttgaacctgggaggtggaggtttcagtgagccgagatcgcaccactgcactccagcctgggcaacagagtgagactcc

SEQ ID NO: 69799 - DNA, 1040 bp, Homo sapiens
agtattatctgtgggtgactcagttttgtgacatcaaaaatgtcttttcacagatgatctgggtttggatttgggctaggaattgaagtagggctgcagttcacttctggacttttgaagtcaacatgcttaaccaaccctagctaaagggaactgtctcttgagccactgaaaattgcttctccaagctagtatgtttgaaactgagtaaatcaattcaaagatgtttctagattacttctagactttttcaagacacttaaatgcaaaggaaccaatggtttctttacattggacttataccactgtacaacatcacctgtataagtcctactcagaaattgggttcaacaaaaccgagttggttttgtcctgcaaaatatttagttaggttttaaagcccaaattttttaaaggtaagggctcatatctctgtgccctcactttgactatcagcctacccaaagtaacggtgattccttgatactagaatggcaggggaagccttatggggtgttagtggtgagatgactgcatttggtcttcccagtggcctttaggttggtagcaggtgaatgaatgcatggggaggcagcaagaatagtatggtaggtagcagcgatagagttggcattcctgacttaaaatccaaggggcagcagaagggaaaccagacttggtggatttcaataaagccacacaatgattctttctgccctgtgtcaatactttatgcaacagagtaggatgtgaaatttaaaaccgtaatgaggcaactgtagcaatagatctttcttagcatctgattatctttcagttctggcttcaactgtgcttcaactgcacaagttccttagttctctgttttgggttttttttggggggtggggctggagtgcagtggtgcgaacatggcttgctattactacagcctcaacctcatgggcccaagcaatccccccgagtagctgggaccacaggcacgcacagccacgcctggctaatttttttgtagtttttttggagacagtgttttgcca

SEQ ID NO: 69800 - DNA, 1093 bp, Homo sapiens
tgtcacctccatggccgtgaagccattaaccaaagacattcctcaagaaagcgcgccaaggcggtagaaggatcaggcaatgatcagtttccatgatcatattacggaattggctccaaggaccttcagaggtcgagtcctggagcgtctcctttagcattcgcctcagagataaccccaaaagtgttaaggtcaaagggaaaagccaagagggaagttaactgagttatcaggcacctatttagccacccgcacttccccgcccgccacccatccacccttaattagccctaatccgggcggtccaatcctccccgtcacaactgctgtcaagggctaaggtcccgccccgcttccataccggaccaatggccgggcccggggagagtcccttgagaggggcgggctcgggttccggccagtgggcggggcctccttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggtgagcagcgaggggagggagcacgccgtcccagggtggggctgaggcgaccgcaggccctccggcgccggggtctccctcccacacccgtgcgcaccctgcgcgccttaaagggccctgcgcttggctggccgccagccctgcgtgaagctacaggaccatgtgccgcgcttcccttctggctcctgggggtgaagtgcacgccgcccgccctcggcccgcagtccagaacgcgtgaggaggccgaccctgctgtcaccccgcatgtctgaaatgaaaggggaagggatgcgtggccctgaaatagcaaggagccgagacaggaacctctggtagagactagagatgtggtgttccactggagttacagtcagtttggtggagggagcgggagtgaagatatgtgctcactctggagcagtggctaatttcgtcctctgc

SEQ ID NO: 69801 - DNA, 1305 bp, Homo sapiens
ccgaccaacacagagaaaccccatctctactaaaaatacaaaagttagctgggtgtggtggtgcatgcctgtagtcccagctactcaggaggctgaggcaggagaatcacttgaacccaggaggcagaggttgcaataagccgagatggcgccaatgcactccagcctgggcaacaagagcaaaaccccatctcaaaaaacaaacaaacaaacaaaactaattaaaatcaattagggaaagctttttagaataggttgttggagctagatttggaaagaaaagtaaggatataaattactaatgtacagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcggtgagctatgggaatcggtagctggttcttggacattaaggggttgttggagaaccaattagaaagttaggctgatatccttgtcctcctctttggaagtgaaggcaagaggcctcttattgccctgtgtcacccatttctcccttgggttggcagtgtgagagcattgtggaggaatacgaggatgaactcattgaattcttttcccgagaggctgacaatgttaaagacaaactttgcagtaagcgaacaggtaagctgcccccactttatctcctgttctagtagctctgtggaacctgacattccctaactcacccatacacccccatcccagaaacctctggtattaggtcaagagctgtcttccatttcccttggcttagggacttggggtgttcctccacattttctgtcagctttcagaatttgtgtccccttgaccctgagatacaggtgagaggacagtggggatgttttatcatttataagcatatattctgcagaatggtggttggtgtgtgtttgtgtcagcttggtctgggaaattttcttgatactggcagatatcagtatgagaatggcatattcctttaaattgtttgccatttgcagatctttgtgaccatgccctgcacatatcgcatgatgagctatgaaccactggagcagcccacactggcttgatggatcacccccaggaggggaaaatggtggcaatgccttttatatattatgtttttactgaaatta

SEQ ID NO: 69802 - DNA, 1991 bp, Homo sapiens
tttcttcctctcagattcagacccgcaacatccgccatctgccagatattcttgtcatcaattgtgaggtgaacagctcaaaagaggctgatttctggagaatgcaggctgaggtaaggactcagactagaaacaaggcttccggaataatttttcattttatcccccttctgacctccatatatgattacattcctgaagaactggatgtttttcttctgtgttcaggttgccttcaagatggcagtaaagaaacacggtggggaaatctccaagaacaaggaatttgctttggctgattggtaggtgctgtcttgggagttgtcaaaggattgaattgcccagtggttcctcttatcaagacctctttcggaacaaatttccaattcttctgacctgataggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcaggttgttgaaaaaccgggaagaggaaagggaataagggagagaaggtggggcagaaggtaaaggagggcaggggaaggtgaaacttagcagagggaaaaggaagagaataaggcctagtatttacctgttaggggattttccatagtcactcagttcagtgttggggtcctagatgggctaggatggagataacccaccctggtcccccatcccccatacccccaactccctgtcctctgtccccattcccctcccttccccatccttaaacttagcttagcagcctgggtacccccctcacagtggggcccagccagggcagaggaggagcatggtgtctatgtgtatgacctgatggctactgtggtacacatcctggactcacgcacagggggcagcctggtggctcacatcaaagttggagagacctaccaccagcgcaaggaggtgagtgaggttgtagagggcaggaacactcctgggatggccacagtgagtcccagatctgtccttgagtctgagacagagtggtccagccatcaatttgtatcgccacaggctttctttgtatttccatagggcgttactcaccagcagtggtatctgttcaatgactttcttattgaacctattgataaggttagttgcaacatgttctgtttcttctttcatttccccttttcctagcatccttatctttagggctctatagaatgccaggcagattcaacagggagggaggaaggaatcctcaggaataaaaaccattagcacttaaaaatagcacctgaaaaaaaacaaaaactagcacctgagtcctggcctccgtctgaagtgggggaaaaggaaaagggtgatatacattagccataagtgctttttctcttctatagcatgaagctgtgcagtttgacatgaattggaaagtacctgcaatcctttattatgtcaaacggaatctcaattccagatacaacctgaacagtaagtgctacatagtagacccaagtgtgtggacagtttagattgggcttcagggtgagatctgggacattgcttgcaagtacttaggattggtaaccagtgttaatatttctggagatactaaagagattcctgctcatcagaccttaaatttagaagtgcgaaatccagcctgagcaacatagcaagatcccatctctttgaaaaaaaattttttttttttttttgagatgcagtcttgctctgtcacccaggctggagtgcaattgcgcaatctcggctcactgcaacctctgcctcctgggttcaagcgattctcctgcctcagcctcctgagtagctgggattacagacgcccaccaccacacccggctaatttttttgtatttttagtagagacagggtttcaccatgttggtcaggctggcctcgaactcctgacctcatgatctgccc

SEQ ID NO: 69803 - DNA, 1810 bp, Homo sapiens
gaaaggtgggatatcagttaagtagatagtaacagaggagaatatccaagatgagagaagagtgttagtaaagatctcaagaggcataaatgcaaaacacatatctgagggggactacatgagtataccagtctggccggagtagctgttggtattgggatgtagtgagcgattaaaattagaagtggccagattgcgaagctttgaacaccagtctataatagaggaagtaatacacagaaagcagcattctgcaagggttaatttggtagtggtgtgctggacagagtgaacatagggagaccagtgtggacgccatcacagttgtccatctgtgctgaagcagagtgatggcagtggaaatagaaaggaagcagcggatgctgagagtgctatgaatatagaaggttcaggacttggtggctgtttcaatgttgggataaatgagtgtgaagccaaagatgacaagacatccaacaaggttacctcttcctaaaatccctagataccctacagactcaaggagtcagacagtgaatttgacagcttcagccaggtcactgagtcaccagtaggacgagaagaggaaccacatctccacatggtttctaagaaataccgcaaggtgctgggggacatcagggcctgtgggatgtggggaaaggtaccctgggaaggaagtcatatgagaaaggattgaaggactcagtcaggaggccttcaactaccaccctggacccaggaggaaggctctaggaaaggctgtggctactggaaagatttggggactctgagaatatccttgtcttgctcagacaatttctaccttaggtgaccatcaaatattccaagctagggctggaggactttgacttcaaacactacaataagaccttgtttgctggattagagccccacattcccaacgcctactgtaactgcatgatccaggtaagggttgggtattcctgtaacttgaacgtgcctgctgcttttcttcttccctatggctctcgaccctgctctttccaggtctcctcagccgtgttctctttaccatggtctcctctacaattctttcttgcctctacaactttcaagtctcctctgagctccaccggtttggtggactcactgcttcggtggactcctgcttctgggacattttctccaccagctcacttaacctccatatttctcctcacccccaggccagtttcctacatcagttcttctgcttttccctccaggtgctctatttcctggagcctgtacgctgtctaattcaaaaccacctttgccagaaggagttctgtctggcatgtgagctgggcttcctgtttcacatgttggacctctctcgtggtgacccttgccaggtcagtacttggagacacttaaaatggaaggggaaggaaggtggacacaaaagacaaaataacccctttccaccaacacatttccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcaggtatgaaatcaggatagaaatagttaaagccatcatgacaggcccctctgtgatttaaaaggtctcctaacttcctcaatgtgcatatatcatcctctccactcttagcagcttttgctcatcgggggactctgttattgggca

SEQ ID NO: 69804 - DNA, 1079 bp, Homo sapiens
ttctcaccaagaacaacctcaagtatatggcccgtgggggcctcattatatttgattacctgtaagtggcttctcagctctggactaggaacgaggatgcctcatagggtgggaaggctaagggattggcagcttgtaaggcctgggccccttagcctttcctctccccaccaggctggatgagaatgaggatatgcacagtctcctactgactgacagcagcactctactcgttggtgggctgcagaatcacataatagagattgatcttaacactgtccaggagactcagaaggtacaagcttggggcaagaaagacctatgtggggtctgaggttgttgcgggggcagggtatgcttgggctggtaatgtgcctgagatgtgggtgtgacctttctgttcccttggtctgtgggaaaaatcattcttctcactggtttttcctgcttccctctccagtatgcagtagagacgcctggagtcaccatcatgagacagacaaatcgcttcttcttctgcggccacacgtctggcaaggtggccaagttccatttctcctcccactgcagggccctgtttcactagatacctgattgcgatctgctttcccttaactctggggtgtagttggattggaggtgagggatgagtggagtgaattcacttcctactcagtgatgttctactatgagattattttgcagcttgatgttttctatgataatgaagtctccctgaagccccttctggctctgggcttctctgtttgccttttctgtgctttaactttccctgtcctaaagccctagttcctttggtagggaccccactgggttaggtaggtggcaggtatttttcctgataacagaatttgcagataactgaattttttttttctaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtg

SEQ ID NO: 69805 - DNA, 1025 bp, Homo sapiens
ccctcctccgctaggccctctgtactctccaccaccccattatctaacctaatccttgacttccctttcttctcacttcggactgctcacttgccttgttcagccctgaatcatcaggtgaagggagcgagaattgcgggggttggagttaggtagagggatttaaggtgctttctcccagaattgggggtgaaaacgggtggattggacggtggggagaacgagaagtcagtttcctagaatcctctccaatagctacccaggattctctagaggaaaacaataatggccagttacccacaattggggcgggggcaggggaaggtgacggaaacggctagttacccagaattctctgggggaaccagaaaaatcggttatctagaattctcccacggcagcggtgaggagggggatagggcaagggtcagatgtgttcctgggatgcttacggggaatgggtcattaccaagatttctccatggcggatattttggagcgcgtggaattagaacgagtagggggagcgcaagcgctgtcagctccgcgggaaattccagtttccccagttctcccccacgcctagggctcaacctaaccactacggcgccaaggaccggggtccgaggcgcttcttccaatcaagaagggctcggggcatattttagccaatcagaagggctccgggcgcatctaagccaatcagaaggagccaggtacggcgaccccaggagagagcgtgtgacgcacgcgccggaaaaagaggttacggggcgccggtgggacaaacgcagccagacgccggacttgttgggtggcgttagaaagtaactctgtttttagtcttcttgaacaaaattacgtctaggtttgaaaaccaaacttttatgctttctataactttaggaactctaaaataagggacacacaaggcaaagcactaggagtcgctgttgggtattcccagcggggcttagtctacctcctcttcctgcggtgccctagtgagccactccgccacctct

SEQ ID NO: 69806 - DNA, 1044 bp, Homo sapiens
tgtcctctttcattgctttcttttctccctagttctgcttgcaaaggatccaccagggtctgattttttatgagaagctgctaggatcggatattttcacaggggagccttctctgctccctgatagccctgtgggccagcttcatgcctccctactgggcctcagccaactcctgcaggtatgaagtaggggcgtggaggatgggggcttgcaggtgtcagagacagagggttgggggttaagggtttagagtcttctctgactgtgtcctatgtcctttcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggctatatgagtctaatttctaggctcaattgggaaagagaaatcgatggaaaaataaggccaagagactacaatatgcatccctttcttctattctgaagggctatggtggagaatgatattttctcatgaccccctggtgtatagaataactgggatctctttagtattaattcctatatggctgagcaagcagaatgggattaccagattaggaagtgggatcatacctaagggtcacttgctccctgatccagtgtctccttccctgctttcttggccaagagtatatctgat

SEQ ID NO: 69807 - DNA, 1031 bp, Homo sapiens
ggatgctatggtgaaaagacaaagggctaagaaccccgaaggaggaggaaatactgtggacattggtggggagggtctagggcaataggtcattgagagtggttgaattggatcaatcctttctgtttacctattctagcccttttcccaggatcctacccagttggctgagatgatctttaacctccttctggaagaaaaaagaattttgatccaggctcagagggcccaattggtgaggacaattcagtggtaatgttggaaactcctgaagtagagaggaaccatggaaaggactcagggagttgtctcagaacaggatccccccgacatcctgtggtataatttcaggcctgaacttaaggcatgaaaggccagagttaaaacgtgctcagagcctcttttttcaggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcag

SEQ ID NO: 69808 - DNA, 1513 bp, Homo sapiens
gaggcgggatgatcacctgaggtcaggagttcaagatcagcctgggcaacatggcgaaaccccgtctctacaataaatacaaaaaattatcctggcggagttatgcacgcttgtagtcccaactacctgggaggctgaggcgggagaatcacctgagcctgggaggtcgaggctgcagcgagccgagatcgcgccgctgcattccagcctgggtgacagagcgagaccatgtctcaaaaaataaaaataaaaaaaaattgttttcattacctcagccctcctcttcctatcccaaggcgtcgaaattccggtcccaccccttcccatggagcccttggcgtctccaggctcctcaagctagtttcggttccggggctcacgcgcgggttctcgaaaatcagctgtttcagtcttgggctagtccactaattggactcctcccctcgtagaaagtgcctacttgaacttctccaccaatcgctgaagctgcaggtgtggtttcggctcagcttgtcccgccctgcggaggggcggagttgcggcggcgccagtgagctcgcagtctgggaagggcttgactgaatggcagccagtgtcggggtggcggctgggaatgggggccgctccggacttccgctgccaactacaagggggcgggtccgaggggggttagccgaagttgtaggcggggcgcgaggttctagtacccgagctcatactagggacgggaagtcgcgaccagagccattggagggcgcggggactgcaaccctaatcaggtacgggccctgagagggtgtgctggggtaggggtgggggtgagagtgagagttcctccgagggaagggcgactggccccaggggttaccccctggagagggtagcttcggtccccagattgaaataggagctgtcgcctgctcggtcctcgatcttcttctgtccagcctatctccctaaccctaatgcccctctcccaaaactgccctgcagcttccgagacccggaatctggcattgttatgttggttcggtatctgacgtttttccctctgctctgcattattttttatcttcaccaaaaaacgatgttcaaagatagataaatctaaaaacaaagatagataaatctattatccttgttttgttaaaaagtataagctactgaaagatgaaacgattgcctaaggtcacacacaaaattcagttcatttcagaaaagcttcttgagtgcaaaatatgtgcctaagaatgagagataatgagaaaaaattgtttcagcccttaacctcagtgtttgcaatccatttggggagaccaggttttttgttttgttttcatatttgaatctttgctgacttgctcctttaatatcagacacttaaatcctcaagaattgggacctcatcattaatttttttttggagatggaatctcactatgttgctcaagcttggtctcaaactcctgggctcaagccatcctctcgtcttgtgggcctcacaaagtgctgg

SEQ ID NO: 69809 - DNA, 1214 bp, Homo sapiens
cccgggttcaagcaattctcctgcctcagcctcctgagtagctgggactacagacgcccaccaccacgcctgggtgtatatatatatatatatatatatatatttttttttttttagtagagacagggtttcaccatattggccaggctggtctcgaactcctgaccttgtgatccgcccgccttggcctcccaaagtgctgggattacaggcgtgagccaccatgctcagccgctaatttaatttttaaaatgaagagaaatgagagtatcacaaacatctcatctttcctaattctgaatttccctggctcctatcatgagcttagagtgggaatgtggcagggacatacaggaaatgccaaagaacaggactgtaggcatagaggttgagtgtgtgacaaggggcacaaggtttgagcagccagtataaatgggcaaatatttgcagagattacatccttcactgatcataggggaaagcaaatatctcctttcctcatgggacacagaactaggcagaacaggatcaggaagcgatcaaacctaccaaggcagtctcacttctcaatgactggactgtgtggtaatttggggtccctatatatgggtggaaataaaacagaagtccctggtgacctgtaaatgggggagaccaagtgggagcaactggggtgcatttcctatttcctaggcctttacctaaaaagaacagaagcttggggccaggcgcggtggctcacatctggaagcctatcactttgggaggcggaggtggaaggatcacttgagcccaaagttcagaactaggctgggccagatggcaaaaccacgtctctacaaaaaatttaaaaattagctgggcatggtgtcacgcacctgtagtcccagctgcttgggaggctgaggcaggaggatccctcgagcccaggaattcaaggcagcagtgatttgtgatcccatcactgcactctagtctgggcaacagagcaagaccctgtctctaaaaagaaagtacaaaagcttggaagcaggtgatgtatgaggtgtccccctaactgagtcttgggctcaccatcgcccttagggaaatggtttgtatgtttcggatttctcccctttctagggtactctgctccagacatgcgtggcctcagactcatcatgataccagttgagctgctactttgctacctcctgctgcaccctgtggat

SEQ ID NO: 69810 - DNA, 1900 bp, Homo sapiens
agtgagactctgcctcaaaaagaaaaaaaaaaaaatcctgtgatactacagtacatttgttctttttcccattggattgtgagttatttgatagcaaggatcatacctgattcacctttacatccccaggatttatttatttatttatttattcaattgacaactatagccaggtgtagtggctcatgcctgtaatcccagcactttgggaggctgaggtgggaggatcgtttgagactggcctgggcaacacagcaagaccctgtctctacaaaaaattttaagtagttgggcatcatggtggcatgcacccctgtggtcctggctacttgagaggctgaggcaggaggatagcttgatcccaagagatcgagactacagtggaccatgattgtgccactgcacttcagcctgagtgacagaggcagaccccttctcatttaaaaaaaaaaaaaaaaaaagaacaaccaaaaaaacctataactgggaacctcctaatgtagcaggcactgtgctaggcactgggtatatattagatagtaagtattataataaatagagttcacaacccttgtggatcttcaccaatattgggtcatatatattcaatgaatatcatactctgggaaacaaaaagctggtcctttcccttttcaactttttggcccctgtaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagagggtaatagtgcgacagccatcttctgagtattaacgtgtcagccatgttggtctagagggcaggaaaggtgttctgagaatatgaggaccgagttcctaattttgtgtcatttatggtcattgcagaggaagacgctgttggtaaagagccgctgaaggcagcacccaagaaacgacaattgctggacagcgacgaggaacaggaagaagatgagggcaggaacagaggtagggaatttgatgggaccttctttttcttctctaatcctgaagacaaactctaccacgtccttaccccttaacatatttagatattctctctctctctcacccccatcgttcccacagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagatt

SEQ ID NO: 69811 - DNA, 1001 bp, Homo sapiens
ttccagagacctctgatttattttactcatctctttccctgttacccttgggtattcacatgcttgctttttatagatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttggtaacaatctgaccctagctctgctggcatgggctcacttcccttgaagtggtccttaggagcagtccacctggattcttcctgcctgaggctgttctgaccaggtccttccgagagagcaggcgcgggggggtgcggtggtcaggaacgaggagactccactaagttccttgtgttgccttcattttcattcccccaacccccaatgaattttagccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggtgaggactttggctgggagagatgtctcaggtggagggcttgggagtagggtcaaatgtaagtttccctcatttccttaggcttttctatcccgctcctatggctccagaactgcctgatccgagcagctgatgatcgggaagaggatggtgagtggacaggtgacacttttaggagaagagccctggaggctattggagacctacctggtcatgggatggagaaccagttcttcccttatatcttcaccatatgactattgaccctgtcttaggctgctcccaggccgttccattggtgccactcacagaggaaaatgaggaagccatggaaaacgaacagtttcagcagctgttgcgcaagctaggggttcggccccctgcctctgggcag

SEQ ID NO: 69812 - DNA, 1025 bp, Homo sapiens
ttgtaatagaaaagacactgatggggaaagccctctttagctctcttgacatcctaatacaattctttccccacagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccaggtaggtggttacagaaaccctgtcttttttgagaatagtgctcagggtatacaatctgggttttccactccctccgctcccatagctttatccatctctagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcggtaagaaccctgcctgctcatcctcttgggctttgggggaaggaggaggccatcactgcggtacagtgttctcagtcttcaaaagagagttgtctcatcaaggctctgggactgtataccaactgactcctggggcgttttgattggtttgttgggtttttttgtttctgaaaaacattaaaaaagcatagttaattgagaaaaaaataaagaaagcaaatcctcacttgacatcatcaataagtccttggtaattgcagctttgagtaaaatgacctacggcatgtttcttataacgttaagagaaaaaaaactggttttgttatacattgtttcacttaaagtggcagtatccaagaacctattgaagacattaagggcggacttaactttaattctagtagccaaagatatgcatcattaacattttgatgagtaaccatccagaggtttttttgctccgttacatgtaaaaatatcgtatataccttgttttacaaaaatgaaatactgtacatgctgatttatagtaatttttcacttctcagtatattatga

SEQ ID NO: 69813 - DNA, 1577 bp, Homo sapiens
attatgctatagcattttctggttataccttgaaagcattgtggtgaggtggaaagagccttaaattgcggccaggcatggtggcgcacacctgtaatccccgcgcttgaggaggccaaggtgggcagattacttgaggtcaggggttcaagaccagcctggccaacatggtgaaaccccgtctctactaaaaatacaaaaattagccaggcgtgttgatgcacacctgtaatcccagctactcagaaggctgagacagaatcgcttgaatccaggaggtggagattgcagtgagccaagatcatgtcactgcactccagactgggtgacacagtgagactctgtctcaacagcaacacaaagagagccttaaattgaactttagaaagtctggaatctagtcctgtattggttattattggaataagctcaagctggtcgtgtcggtctccagatccataaagttgggattgtgacagttgtccatgaacccaaagtggaatcagtgaaaagcctaggacaggctgggcacagtggctcatgcctgtaatcccagcactttgggaggccacagtgggtggatcatttgaggccaggagtttgagaccagcctgggcaacatgacaaaactccttctctactaaaaatacaaaaattagctgggtgtgatggcacgcacctgtagtcccagctatttgggaagctgaggcacgagaattgcttgaacccatgaggcagaggttgcagtaggccaagatcatgccactgcactccagtctgggccacagagcaagactctgtctcaacaaaaaacaaaaacaattcaccagcatggtggcacatacctgtagtcccagctgctcaggaggctgaagcacgaggatcactggaacttaggagtttgaggatgcagtgagctgtgattgagacattgcactccagtctgggtgagaccaagaccctatctctgaaaaataaaattattggttcacattaaaataaaaaaaaccctgggacaaaatgcaaactccaaggaatttgtatcctggaaacacagagactttgctttgtataaacagattttgggccaggcgcggtggctcatgcctgtaatcccagcactttgggaggctgaggcgggcagatcacttgaggtcaggagttcacgaccagcctggccaacatggtgaaaccctgtctctactaaaaatacaaaaattagccaggcatggtcatgcgcacctgtaatcccagcttcttgggaggctgaagtgggagaatcacttgaacccgggaggcggaggttgcagtgagccaagatcatgccattgcactccagcctgggcaacagagcaagactccgtctcaaaaaacaaacaaacaaacaaaaattagcctggcgtggtggcacacacctgtaatcccaggtacttgggaggctgaggcaggagaatcgcttgaacccaggtggcagaggttgcagtgagccgagatcacgccattgcactccagcctgggcaacaagagtgaaattctgtcttaaaaaaaaaaaaaaaaaagattttgtaccagaacct

SEQ ID NO: 69814 - DNA, 1005 bp, Homo sapiens
gttttttttggttgttttgttttgttttgtttttgagatggagtctggctctgtcgcccaggctggagtgcagtggtccgatctcggctcactgcaacctccgcctccccagttcaagcgattctcctgcctcagcctccccaggagctgggattacagctgcccgccaccacgcccggctaatttttgtatttttagtagagatggggtttcaccatgttggccaggccggtctcgaactcctgacctcaaatgatccgcccgcgtcggcctcccacagtgctgggattacgggtgtgagccaccacacccggccctactagtactttgtacaaagtaaaggtagatcatctgatgttaaatttaaaactcctctttgaccacccacagttagccttaaatccgtaggtgggtgtctgtggcctctcagtctggccctgaccctctcaatctcattttgtaaatctcttacgcacctgactcctggccacgtggaaagattgtggctgccctctttcatatctcagtacttagttcctgctgttccttctgcttggaagatcttgacactgctctgccaagcgaacttctctttgaagactgagcttaattgtccctctgaaaatcaatgtatccagcttcctatgccaagttagtcacttcttcctgtgtgtccctgaagttttttacccccctctattaccaggggcactgatacagctcaataaaagatcaataaaaggttactgagctcctaacatgtaccatgcactgtgcttagcgccaggcttacagagatgagtaggatggagagttcccgacccttaaggaactcaagtcctaaggaaaacacatgtaattgagtcttctgtggttacagtgaaagggtcatcaagaagtccttcctggcttccttcctcctctcactgcactcacaccatcttacatcctgatgcctccaaatctttagctccaaactcttctccctcatcttccagacttctc

SEQ ID NO: 69815 - DNA, 1112 bp, Homo sapiens
taaggagtggggttcagcagggaagttggataactaaagagaattctttagttcccagggattagaagcctttctcccattggctagtttgggctggaatctgtggaccctgcagctctgggacaaaatagttctgctgcgtctggctttctctgagcccgggttccctacccccagtccatgacagcacctcccttttcaaaccctaggcctggctttttaaactacagggaccgacagagagaagacactatcatccctgcatgggctgggagtggggttggagggataggaataagaaagggactcgtagttaaaccttagaatcagcttgtatttcatctttcctaactcacatggtcatagcaagaagtactgaaaggaaggaaacagtcatggctatgaagcaatgggaaggtctaatgtcctttaatacagccatgatcagcacaccctaagccttgatccccagggaaaggtatgggtgtgctgggatcagatctggggaaacagccgatcaaagagagggaaaaggataatatggggaaggaaagtttggggaaagaggttcagttgtgctcgggcttggtgagggacttgggacctaggcgtggggttgtgtggtgatggagaaggtagaatgggacatactgataggttctaccatctccacatagtggcaagtcataccggccacaaacttttctcatgaagcaccagagagcagaaattcgaggtgaggcctgcaagaatggtgcccagcatgggtcctacccagtacacctgtggggagagagaaggaacacagatcaggggctgtgctttctcctcataatacccagcttggggatggacagaaagagagttatagtgaaggtagagggtccatctaacctatccactggcaggaagagttgctgagaacaggtcagagagcacccaaagggtttggagctctcaattacatagaagagaaacagtccactagaagtcattggaatctcctatattctagaagcctcatcagtctcctgacttaaggccctgtaaccctcagtgcatctcacccagtaatgctcccagatcccagtcaccactgctggcctcaggaa

SEQ ID NO: 69816 - DNA, 1523 bp, Homo sapiens
tttcaaaggccaggtgcggtggctcacgcctgtaatccctgcactttgagaggccaaggcgggcggatcacaaggtcaggagatcaagaccatcctggctaacacggtgaaacctggtctctattgaaaatacaaaaaattagccagacgtggtggcacgcgcctgtggtcccagctacttgggaggctgaggcaggagaatcgcttgaaaccgggaggcagaggttgcagtgagccaagaccgcgcgccactacacttcagcctgaacgacagagcgagactccgtctcaaaaaaaaaaaaaaaaaaaagaatatttcagagtagcacattccataacacttcagcaatacccttggactaagcatccatggaggagggtcacagggcacagctggcataggtgagttcaattaatgtcatgtgggtatgatttgtgttccagaacaagactgtggtcaacctgttatttgctgcctatagtggcgatgtctcagctcttcgaaggtaatgctactgtgaccaaatatacacaataaaatactcctggtcagagattttactaggaggcagcgtaacaaaatagttaagtgcttcagctttggaattagaatggatatagattgcatttaaatgaaatttttttaaaaaaggagattttttttaaaaaaagtaaactgtctgctctatgataattaatgttagccattgttattgagtgttaagagcagtgtcctaggaagtaggtaccctgcctcaaatgggcacttaccacaggtaggcagtgagtgatatttctggaaggatcacattcccatctctctaatatgagtataacagtctcatctggatatggaaaaaagattattcagagccaacaaatctggctataggctgtttcactttctctgaaactcatccagtctgacaccagttcacaaagaacacctgtgattccagtctgatctaggcaactctagctgctttcccactaccctcaggtttgccttgtcagccatggatatggaacagaaagactatgactcgcgcacagctctgcatgttgctgcagctgaaggtactgaagggttaaggaggggaggaggagggtaatcataagaccctttctttttcaccaaaagtaccttcattatatgtgccctcaaggttataggggcagcaactagttttatctagacacccttcggtttgcagctagactatgactgagtgctgcagggtacaaaatgggaagaggccttttcccctcccctcttggtaaagacttcagtggctaagtgtctgcaccaaagggttcaagacctgcgccttctcattttccttctgcccatattcctaggacacatcgaagttgttaaattcctgatcgaggcttgcaaagtgaatccttttgccaaggacaggtgaggaataggctaaaagtggaggagggtgggcacagcttctccacctaccctccagccaccatgcaaatatatacaaccaccactctccacgtctcct

SEQ ID NO: 69817 - DNA, 1068 bp, Homo sapiens
agcctttgcagctgcgacctagttgaatccacataggctccttccacacggtggaagatctgctgcttcactcacagaccaggagttctcaatcagaggtggttttgtccctcaggcctttggcaacatctagagacagttttgattgccacgcctggaggtgggatgtgtgtgctactggcatctagtggctgctaaacatcctacactgcataggatagtccccactacccccagccaagaattatctgactccaggggtcaatattgccaagactgggaaacactgatatagacagtgttgtccctgcctcctgggttagggtaaattttcaccccaaccctggacaaacagtgccttttgacactcatgcaactgttggggaaggactggactgggatccttgaattctccccagactttgacttttgataactctgcatatagcaagagtgattcttgaaagagctgtggctccatgctgaatgcacacatgtactcagagggattcaggtgggcattgttctggtgtgtgctgtgcaatggtgggaaaggacaaagctctctaaactgtccagagcaacctgccctgccccggtgtgcttggaccctttgcccagggaaccaggacatcagaaataatgttccttctgtggaaggacaacggggagctagggtagcaaagagcaataaattccaactctttatgaggtcaggagtcctttaaaaaagcctatgtcttggtctttaactgtccccttctgcaagatgtgactctatacacatggagacagattgaagaaagacttcacccatcttctaggaaataaaatcctgctcttgtcttctcccagtcactcccttatgcactgaaaggagaatttgactcccttgcacttcaaggccaggtgcctctccactagacagtcagacaaaggcaaataatggaggatagagagacaggtgttcattaggctggccatagggagaggaagggggtgacagcaggggaaaagaaactgtagtatcagttgtcacaagtagagctcggcccagctttccctccc

SEQ ID NO: 69818 - DNA, 1173 bp, Homo sapiens
tggctctaattttttgttttgaattttgaatttaccttttggagttcttctcatgtgaatctacttgttagattgtattaatgagtgtttctggtttgggcatgggaagtgatgggggcctgaagttattttgcagtggctaatggcactgaggaatttcttttttggtgcatttggtttacactcatttcctctcctaattgttagttcatttgtaacagtgggtgagtgtttggaggaaaggagggagaagaaaggagggatactgtttctcccatgaaatagtctaattggttgggttgatggcagaaggaaacataggggagccttccagctcacagccaagggttgggctcttaaacactatgcctagtgttttctgaatgctgtcttcatggagcccagctcttactctctttgtactttacatctcacccccactcattacagatgctcataacattcttaaaatattttagtacttggcatttttctgttttcagtcagctagaacacactagagtcctttcctcagatggcataatcctttataggctctgagcctgcctagccatctcctatcggtgttattactcctcatctcaggctctgagatgatactcagaccctaaactgattggactttttggaggagggtgccagtagagaggtcaggaagatgtggagatgatgatggagagagatgtttttattttattttattttttcagacagagtcttgctctgtcgcccaggctggagtgcaatggcacgatctcggctcactgcaacctccgcctcccaggttcaagcaattctcctgcctcagcctcccatgtagctgggattacaggcacccaccaccatgcccggctaatttttttatttttagtagagatggggtttcaccatgttggccaggctggtctcgaactcctgacctcaggtgatctgcccgccttagcctcccaaagtgctgggattacaggcgtgagccaccgcgcccggcctttattttattttttagagatggtcttgctgtgtcacccaggctggagtgcagtgatgcagtcgtagtctactacagtcttgaattcctgggcccaagggttcttcccacctaagcctcccaagtagctggaagtacaggcacatactaccaagcccagttcg

SEQ ID NO: 69819 - DNA, 1146 bp, Homo sapiens
gtcctcttaagttctaaactctgctcctatgctggtgtcctccaaccattacttattaccctaagccgtcactgcacagcctactcccctggcctatcacagcaggacctatctggagagttcacactattctagggcgatcagtgagctaaaaatcccagagaaaacactgtaggaatagaaattcccaagtttaattcccaagagtttaaaaattatgagccttttctagcccccaccttcccaaccctcagagaaggacagtaaagaaatcagtgaatccaggtatttacctgttgttgaattgtgaggttgtgaggtagacgtgtaacaaggacaaggaagtttggggatctgcttggagaatgaaggtttattcaaaacaagtggacaggtcaggggtaacgggtgatgagggcacctggcttttgtaatcatgtggggactgtcccctgggaggtgcagcaaaaatcagaacggagacagaagctcacagtctggttttagctgccaactcctatggaagtccatagctgactcctatggaaggcctaccaaatgaggaaatttcaggaatttgctaatgcgtgggaggattgaaaatgtaggcagcacagaaatagagtagttggtttaaacgggaatcaggaaggattggtataacaaggcacaagatttggaatttaccctttacagactggcttttataacacccaccctcgtctctgaagcctgctgattcagggctagcagagcctaggggcaagtttgggccagatcacccacccagtttattgcccttggctaagaatgcaaagcccctcatgagcgcaatgctgccacttgcccagaaggtggggcatgtgcacaaggcagcagcaatagttcttttctagaagactaatagccactgctactagggattcctaggacattccagcaaggcctctcacagcatcatatgacgcaaagtaacagcccacgggttgacattggagtgacaggcctcaactcccaatgggttgacattggagtgacaggagtaggcactggaggcactaagggagggtgagtgagctgattgtcaagttaggaaaggaaaacgaatggagtggagctgaagtggcccaacccagcgcatggcct

SEQ ID NO: 69820 - DNA, 1038 bp, Homo sapiens
tgggttgggccacttcagctccactccattcgttttcctttcctaacttgacaatcagctcactcaccctcccttagtgcctccagtgcctactcctgtcactccaatgtcaacccattgggagttgaggcctgtcactccaatgtcaacccgtgggctgttactttgcgtcatatgatgctgtgagaggccttgctggaatgtcctaggaatccctagtagcagtggctattagtcttctagaaaagaactattgctgctgccttgtgcacatgccccaccttctgggcaagtggcagcattgcgctcatgaggggctttgcattcttagccaagggcaataaactgggtgggtgatctggcccaaacttgcccctaggctctgctagccctgaatcagcaggcttcagagacgagggtgggtgttataaaagccagtctgtaaagggtaaattccaaatcttgtgccttgttataccaatccttcctgattcccgtttaaaccaactactctatttctgtgctgcctacattttcaatcctcccacgcattagcaaattcctgaaatttcctcatttggtaggccttccataggagtcagctatggacttccataggagttggcagctaaaaccagactgtgagcttctgtctccgttctgatttttgctgcacctcccaggggacagtccccacatgattacaaaagccaggtgccctcatcacccgttacccctgacctgtccacttgttttgaataaaccttcattctccaagcagatccccaaacttccttgtccttgttacacgtctacctcacaacctcacaattcaacaacaggtaaatacctggattcactgatttctttactgtccttctctgagggttgggaaggtgggggctagaaaaggctcataatttttaaactcttgggaattaaacttgggaatttctattcctacagtgttttctctgggatttttagctcactgatcgccctagaatagtgtgaactctccagataggtcctgctgtg

SEQ ID NO: 69821 - DNA, 3758 bp, Homo sapiens
gcctcggtactcggaagaagggctctccccctccaagcggcggcgactctctatgcggaaccaccacagtgatctcacattttgcgagtgagttgagtgaatcctggggggacagttggctctacctctgccagaggaaagggctgggaggggtcagtatatttgcttcctgagatggagccatcattgtccctctaatgataggattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtaagtagatgtgggtgaaccgcccggtctttgctactgctgcaactcctacccagctcacagttttgcccctgccctgtccaggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcctgcctaaatgtctggctgagttgctggagcaaagggggattcagtgcatccaggtcctgccttgtgagatgtggccccagcttcctaagctgccacctctgtgttcctgtcatagcaaatatgggaccatcaccagcttaccacttcccactcacggataagacaccaagacgtagacttttgtgttttatttaaaaaaaaaaaagtgtgaagtaagacaaaatggacctctaccaagttgtagggaaggacaaggaaaagaccaggggtagaaaaggagtgtaagttttagaatggtggcattggcatagatgtg

SEQ ID NO: 69822 - DNA, 1050 bp, Homo sapiens
ctgctgctagggacaacagcctgatgggcctctccctctgccacctctcttctcagaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcgggtatgctgggattggcactgtgtaggaaggttggggaaaagcattagtcccttatgccctgttagaaaaaaccctgggtccctacttcacaggtgacctaccttaagtgggtcttgtttttgtttttttttttcctatgccaaattttcctccttttacagtgagttttattcctctctcttaactgaagggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatgtgagtgactcccaccctccattcttggtcttggagagaaagggataagttccctctttagtggatccgctccttctccaaagatcaccactttctccctccagatcatatgagatcacccctcgcattcgtgtctggcgccagaccctcgagcggtgccggagcgcagcccaggtgtgcttgtgcctgggccagctggagaggtccattgcctgggagaagtctgtcaacaaagtggtaagaggctgagagagcctggagaggctgaggggccagccagcaggggcggggtggggtcactggcaggtagaggctggagagctcattctgcctcctcacaaccttggtccagacatgtctag

SEQ ID NO: 69823 - DNA, 2005 bp, Homo sapiens
tttgggctgtcccagccctgtgggactctgtggcatttctccagggtctcctgctcgcctcttaggggccaacccagccaagggcgtggaagagaactgcactggagaacaagggttggcagcactaggtctattcatctgtgaataaaatgagacataaggaaatgaggatgttttcatgtttataggttccctcaacttcaggcagcagctccacacccaggcaatggtgcctgtggcaagatgaaatcaagtgcatactactaattctggctacttactggcttggaggaggcaagctgctgaggggagggagtgggttggtcctcagaaactgcagggggcggtgtgggggcagcattgcagggcatctgggctgagatgttaaaccagagtgcttgaggatcagggctggattctgcctcatcaggctctggctcctccgggggttgtgatggagctgggtctagttttcccggactgctatcaggtgtgaggactgagctgctcaacagggagctatggctctgagtctggctcagccaagacaggaaggctgactggctgaggtcatgctggctctgacccagtgacaaaggggagccttcttgctccaggaaccccttatgggactgaagctgaagctgaagctgaggctggggctgggcaggagcatgaagctgagcctcaggctgaagctgggcctggggctgttctgaatcctgacccctgacaggggacttaagatgcctaggttgcatagacccgggcttagtttttcgaggtcggcctcgggcccgggcaggagaactggcagtggtgttggagccagctaactccatcttcatagagaagagggcagggttgagtgacgcatgggctgccacttttaaggagtcagtttccttctttatcacctcctcaggaactgtaaagagaagtaaagagttaagccatatgctgacatacaagggaaaagtaagagggtatataaacttaggacctatactttctttttctcttggacttagtcccccttttttgagattccactgggaagagcttatatgccaatgaacacagtatctggggaagaaacactattctcccaagtaatcagcagcagcagcacaatcataagctaacatttattgcgaaacaactacgggttaagtattattctaagagacttaactcattttaatcctctcagtagccttatgaagtacatacactattattatctcaacttcacaaatgaagaaacagaatcatacagctggaaatggcagagcaggtgggtaggcagctttactctaaaatctgtgctcttaaccattacgctatattatcagaaaatgaaagaagcccaagactactaaggaaaaggaattatttaattcttgtttgataggactcagaatccacactcccacaggcacacctacctaagttcccctctgttccttctacaaagataccagccaaatacggcaatacccagtagcgacgtctgtagcggtcctgacccagggagaccgcccgaagcatctgggatgagtgaagcagctttttgcgaaagaaaagctgacgctgggtagacaatgaaaatgaagatgaataaacacatttccagagtgacagtggtgaattcatccagtatatcagagaaaggcaatggctctcagtccctctataaaagtgatgccatctgggcctaattcagaaggtgattaagtttgggagcggtggctcacgcctgtaatcccagcactttgggaggccaaggcaggtggattgctagagcccaggagttcagaaccagccttggtaacatatggaaactgtctctacaaaaacacaaaaattagccaggcatggtggctcctgcctgtagtcccagctacttgggagaatcacctaagcccaggaggctgaggctgcagtgagccatgatcgtgccactgcactccagcctgggtaacagaaaccccatctcaaaaga

SEQ ID NO: 69824 - DNA, 1093 bp, Homo sapiens
catgcctggctaatttttgtgtttttgtagagacagtttccatatgttaccaaggctggttctgaactcctgggctctagcaatccacctgccttggcctcccaaagtgctgggattacaggcgtgagccaccgctcccaaacttaatcaccttctgaattaggcccagatggcatcacttttatagagggactgagagccattgcctttctctgatatactggatgaattcaccactgtcactctggaaatgtgtttattcatcttcattttcattgtctacccagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttaggtaggtgtgcctgtgggagtgtggattctgagtcctatcaaacaagaattaaataattccttttccttagtagtcttgggcttctttcattttctgataatatagcgtaatggttaagagcacagattttagagtaaagctgcctacccacctgctctgccatttccagctgtatgattctgtttcttcatttgtgaagttgagataataatagtgtatgtacttcataaggctactgagaggattaaaatgagttaagtctcttagaataatacttaacccgtagttgtttcgcaataaatgttagcttatgattgtgctgctgctgctgattacttgggagaatagtgtttcttccccagatactgtgttcattggcatataagctcttcccagtggaatctcaaaaaagggggactaagtccaagagaaaaagaaagtataggtcctaagtttatataccctcttacttttcccttgtatgtcagcatatggcttaactctttacttctctttacagttcctgaggaggtgataaagaaggaaactgactccttaaaagtggcagcccatgcgtcactcaaccctgccctcttctctatgaagatggagttagctggctccaacaccactgccagttctcctgcccgggcccgaggcc

SEQ ID NO: 69825 - DNA, 1877 bp, Homo sapiens
aatacgaaaattagctgggtgtggtggcatgtacctgtagtcccagctatttgagagactgaggtgggagaattgcttgggcttaggaggtcgaggctgcagtaagcagagatcatgccactgcactccagcttgggtgacagagtgagaccctatctcaaaaaaaaaaaaaaaattacataaaaattaaaggaagaacctcttgtagacatgcaaattgtcatcttctgttatgtttaacagaactctctactcacttttctctctctagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcaggtgagtgcaagtccctcccaaagtaaccaggacaagtaaaggagatgtaactacttagtgtttctcttttccttatatttttccatttctttttcttcctgactcctctccttattttatttttctttattttttccttttcttttgtggtcttctttcgtattctgtcttaacccccatagttctcttctgatgtattttcctcttgcacattcacccaacttggttgtgcatctttccctactcacccccattatgctgtcctccacacagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaagtgagaggctgggagtggggatggtcattgtatcccttgcatcagaatggggtggaggacttgtagccttccagaagtcctcagaaatgtgtgttcactgccatgttctgaagatgctggaatgacttgggactgaattgcagtgccctccctgggagagcctaagccttctgccattcacccaatctgggttctaggctggaactcctttttcagctgcagcccctttacccttgagcctcctttccctttttttgtgctgccacttcatcctattccctattcccctgcagtgagattgacaagactctggagagtatgtccagctacaggaaaaacaagtggattgttgaaggccggctccggaggtagggaccagacagagagtagagcctcagagaggagagaagtggggcgggtgaagcatagccagggttttggcttgaaatgtgatgctttagccccttccctgggtttgggaccttaccagggcccaggatggtttagagtcaaggtatttcttttgtggcactatcatgttcctcaccagtttcccgtaattttttttttttgagatggagtcttcctctgtcgcctaggctggaatgcgatagcgcaatcttggctcactgccacctccgcctcccaggttcaagcgattcttctgcctcagcctcccaagtagctgggattacaggcccatgccaccacacctggctgatttttgtatttttagtagagacagggtttcaccatgttggccaggctggtctcgaactcctgacctcaggtgatccgcctgtcttggcctcccaaagtgctggaattacaggtgtgagccaccacacttggccttcccttaa

SEQ ID NO: 69826 - DNA, 3038 bp, Homo sapiens
cacacctgtaattccagcactttgggaggccaagacaggcggatcacctgaggtcaggagttcgagaccagcctggccaacatggtgaaaccctgtctctactaaaaatacaaaaatcagccaggtgtggtggcatgggcctgtaatcccagctacttgggaggctgaggcagaagaatcgcttgaacctgggaggcggaggtggcagtgagccaagattgcgctatcgcattccagcctaggcgacagaggaagactccatctcaaaaaaaaaaaattacgggaaactggtgaggaacatgatagtgccacaaaagaaataccttgactctaaaccatcctgggccctggtaaggtcccaaacccagggaaggggctaaagcatcacatttcaagccaaaaccctggctatgcttcacccgccccacttctctcctctctgaggctctactctctgtctggtccctacctccggagccggccttcaacaatccacttgtttttcctgtagctggacatactctccagagtcttgtcaatctcactgcaggggaatagggaataggatgaagtggcagcacaaaaaaagggaaaggaggctcaagggtaaaggggctgcagctgaaaaaggagttccagcctagaacccagattgggtgaatggcagaaggcttaggctctcccagggagggcactgcaattcagtcccaagtcattccagcatcttcagaacatggcagtgaacacacatttctgaggacttctggaaggctacaagtcctccaccccattctgatgcaagggatacaatgaccatccccactcccagcctctcacttgatgatgagggtggagccattgagctcatgcacaaggaaggccaggacagcagccttctgctggggtggctgggcctgaaaaggctgggtgcgcaggcggtcacagagggctggctctactccatatgccataaggaagcagcgcaggatctctgacacattgtctcttgtcagtgggatctcagacaccttctcccccaagatctttagggactgtgtggaggacagcataatgggggtgagtagggaaagatgcacaaccaagttgggtgaatgtgcaagaggaaaatacatcagaagagaactatgggggttaagacagaatacgaaagaagaccacaaaagaaaaggaaaaaataaagaaaaataaaataaggagaggagtcaggaagaaaaagaaatggaaaaatataaggaaaagagaaacactaagtagttacatctcctttacttgtcctggttactttgggagggacttgcactcacctgacagtaggagggaaagccaggatcatggagtgcagccttcagcagcctgaccagcaggtcttgcacctcacccaagctgtcaccttgacacaggagtccctcctgcaggacccccaggctaggcacatctttggcaggatcaaagcccagcaccttgccaaagctatgcaggaactccacaatggtcaagcagtctgagaaggctccactgggcaatgtcagaccagggactcgtgagaagtcaggcaggggctagagagagaaaagtgagtagagagttctgttaaacataacagaagatgacaatttgcatgtctacaagaggttcttcctttaatttttatgtaattttttttttttttttgagatagggtctcactctgtcacccaagctggagtgcagtggcatgatctctgcttactgcagcctcgacctcctaagcccaagcaattctcccacctcagtctctcaaatagctgggactacaggtacatgccaccacacccagctaattttcgtattttttgtagagatgaggtctcgccatgttgcccaggctggtcttgaactgctgggctcaagcgatctgcccgcctcggcctcccaaagtgctgggattacagtgtgagccatggcacccggccttcctttaatctttaatggaaatgtctctcccattgcagaagtcctttttttttttttaaaggaaagtcttcccagctgacccaggaactgttactctctcctcactacctggtggtcagtcagacacatatcctctgtcggcttcttcatttcctccaagatcatctgctgcctctgccgttcctccaagcgcctctgtgtggccagggtcttatctgctttacaggctggcttggctttggtcacctcctccttttccttcatttttaccttctccttcttttccctcttgactttttccttcagtttttcctgctttgtctttcctttttctttctcagcctacccaaggaagagaggaaccaagactgccataaagatatcagtcactatccttccctggtcccagtcctcccaacctcacagcccagaaatctcactataaaacaagactgatgtacatgtcctgcaaaatcagtttagtggcttcgaaattatacttggcaagtttgtacatgcacctaccttggatttcttcttagcttccttctgctttaagctcttggtctcttgtttccgcttatttctggcctgtaaaccataagggaagtcatttctcctcaaactctgaaagcatctctgcttgggctaggattcaaaaacagacaagggtgctggggaggagaggtgagagatggaatgaggggttggcaatggattaattctctcaccctagagatgcccacgttatttttgaacaaacccaattctctaaatcaagtgcaagaaatttcagggtaatgaagatatgctgctacacagggagtgacggatgtgggaaatgaaaataaaagatgaagtaagttgtaggaaaaattaacctactgtttcatctctctgatgtccctcacctgcccttggatagtagtctgacactctccccgttgaaccttctgcctcatcttcttcttgcttttagcaatctttgctttatcctcctcattcaatgtttctgtgagagcagaaagaaaaatgaaacaagtgaggcaggaaggcagttctct

SEQ ID NO: 69827 - DNA, 2072 bp, Homo sapiens
gattacaggtgtgagccactgcacccagctaagtctcatattttaatcaaagccttaggtagttcatctgcccataatatctgtcttagagggttgtcacgtagacatgtggtggcgtttctataccagaaacaaaataataaatattgtcatgtcagggccaggcacggtggctcacggctgtaatcccagctctttgagaggctgagaccagcggatcatgaggtcaggcaatcaagaccgtcatggctaaaacggtgaaactccgcttgtactaaaaatactaaaaattaactgggcgtggtggcacgcgcctgtagtcccagctactggggtggctgaggcaggagaatcgcttgaacctgggaggtggagattgcagtgagccgagattgtgccattgcacttcagcctgggcgacagagtgagactccgtgtcaaaaaatatatatatgtatatatagtcatgtcagaaacatcaattatgaaatactcttgtttgcagaattatacttccacaagtcttcccgaaaggaagaaattcagaacttttagtgaagcaagacatggagctgagcatgatcaataactatgtcagtgattcttttgaggtgtccactgtgtgggccttttttctggcacacccttggttaatcagtgcttctaactactaccctctttccctggcagtttggcttgctgtatcctttctctgctttctgctctaaaatcagtccgtgggtttctgctcttgtcaggtatcctgggagagagattggctccaaggctactctgccattgtggcctcttttctatcagcaggacaccttctaaagcagtctgattggagccaggggctggtgcttctgggcaggagatgtcatttgagttctttgtgccacccccatagcaggtgcctctcctacattttttcccccaatgttttattatgtatacttaaaaaaaaaaaaagctactctagattcttcagggagctgcttgggaggccagctttgagacgggcatgtgttgccctggatgctagagaactgccttcctgcctcacttgtttcatttttctttctgctctcacagaaacattgaatgaggaggataaagcaaagattgctaaaagcaagaagaagatgaggcagaaggttcaacggggagagtgtcagactactatccaagggcaggtgagggacatcagagagatgaaacagtaggttaatttttcctacaacttacttcatcttttattttcatttcccacatccgtcactccctgtgtagcagcatatcttcattaccctgaaatttcttgcacttgatttagagaattgggtttgttcaaaaataacgtgggcatctctagggtgagagaattaatccattgccaacccctcattccatctctcacctctcctccccagcacccttgtctgtttttgaatcctagcccaagcagagatgctttcagagtttgaggagaaatgacttcccttatggtttacaggccagaaataagcggaaacaagagaccaagagcttaaagcagaaggaagctaagaagaaatccaaggtaggtgcatgtacaaacttgccaagtataatttcgaagccactaaactgattttgcaggacatgtacatcagtcttgttttatagtgagatttctgggctgtgaggttgggaggactgggaccagggaaggatagtgactgatatctttatggcagtcttggttcctctcttccttgggtaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccaggtagtgaggagagagtaacagttcctgggtcagctgggaagactttcctttaaaaaaaaaaaaaggacttctg

SEQ ID NO: 69828 - DNA, 1072 bp, Homo sapiens
tcctgggctcaagtgatcctctgctgcctgcctcagcctcctgggtaactgggattattaagcacacaccaccatgcctggctcccaattatcttttgaattcagatgtgaattctgaacctccatgatagtagaaatgggtaaggtaaaagggtacaactgaaccagtatatgataaggagctaaaagatggaaagaaagggcaagaaagtcctctcctctgggctaaacacacctgggggcagcccaaggtttcactggtaacagcaactcaagaaagaccatggctggaaaagtagtattcccaagcgctgggactaggatgctggattccaaggagaagctgattcagattcattcttcccagataatgttagttacactcctgggaaatccaggtattagcaattcatcaacattttagatacctcatggagggagcagaatcccaaagtaagaaataccactgtaccttgggcctccagtttctttagggggcggttgtctgtcttgttcaatagctcagtgattttgaccttaggtggccgacctcgaccccgtttcaccttggggacttccttagtcttagccttctcagtgtttcgaggtcgaccccgtttgccagtaattgcctgaatcctcgacgggatctcctctgctgagagctgcacccactgcaagccctaaggtagcaagggagactgttacagtagtaaggaatcagtgcaggccacgaggccctcggaaccattcaatgccccagaaccttcaaaccccacgagaggaagctgcagcttgtccaccaactcttcctcagggacaaaagcatatttaacccttgggtctgcacctctggcgtgtctctttcttcaaagaaatctccaacaggcatacggggactgaagctgaagtgctctcggcggacactgtgtaccacgttgcggctcaggtactaagaggaagaagtaaagtaacattaataaagttggatcctaccatgtctttggccagcaaaggcataagcagaacaggcccagagcagacaatgccagcctgttgtcactgagcccaa

SEQ ID NO: 69829 - DNA, 1021 bp, Homo sapiens
ggtattatggcccctgtgggaagaggatgaagcaatttccagaagtgatcaaggtaatgtagctttttttaaaggactgctttcttgggctcagtggactcctttccactgcccaagactccgttcttgggctcagtgacaacaggctggcattgtctgctctgggcctgttctgcttatgcctttgctggccaaagacatggtaggatccaactttattaatgttactttacttcttcctcttagtacctgagccgcaacgtggtacacagtgtccgccgagagcacttcagcttcagtccccgtatgcctgttggagatttctttgaagaaagagacacgccagaggtgcagacccaagggttaaatatgcttttgtccctgaggaagagttggtggacaagctgcagcttcctctcgtggggtttgaaggttctggggcattgaatggttccgagggcctcgtggcctgcactgattccttactactgtaacagtctcccttgctaccttagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaaggtacagtggtatttcttactttgggattctgctccctccatgaggtatctaaaatgttgatgaattgctaatacctggatttcccaggagtgtaactaacattatctgggaagaatgaatctgaatcagcttctccttggaatccagcatcctagtcccagcgcttgggaatactacttttccagccatggtctttcttgagttgctgttaccagtgaaaccttgggctgcccccaggtgtgtttagcccagaggagaggactttcttgccctttctttccatcttttagctcct

SEQ ID NO: 69830 - DNA, 1034 bp, Homo sapiens
gccctctgctttgaagaacttgtgagacttggaatttgtagggagaaggaggctagaagctttattggcaccaggtaaaaggtatttcttcacacaatgacatctgtagcaactttaccctttaatcctcatgattggttgggagaaaaagctacttctttttccaaccctagggaagaccccttgaagtaaccctgtttagcttggtccagggttgactgagtagattctcttgttttatgtgatgccttttttttttttaaagcctatcctgtccctttggattctagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgagtatccagattctattctatccctgtctggttccaagaaacttttctgtcccatgttgtagttagcctttccctattggcctattgtttaaatattttgcttgaactcttaacttgggtatcccttcctcccaaggtgatgtcatgaggagacgtattgctaccccagaagaagttcgtcttcccctccaacatgggtaaatgctctagtttgctacatttattgaccttgacaagtttaatgcacaactctagaaagaagggaat

SEQ ID NO: 69831 - DNA, 1050 bp, Homo sapiens
ccactgaagtacaagaaagacatattttatgataaatcctagaattttgcataggtctctgggtagataataccaccaatgcctttcctttcattttcaccttgtagagatgaggtcttgctatgttgtccaggctggtcttgaactctggcctcaagcaattcttctgcctcggcctcccctcaaacttttatgatccctataatctcatgactactctttcagggagaaggctttacttgttacctaacttaatattaggaagaatcttcacattgtgggaactagaattggatgttttctgaccagtgtttcttaaatcttgctttctgatttttttctcattatcctgctctgatttttctacccttgtaaacagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaaggtaagtgacggtaggtaggacaaagaaagacctttacctgagaaaagatgagagaataagtttcatagttagggccttaagagtgggaaatctggctgggcgcagtggctcacgcctgtaatctcagcacttcgggaggccgaggcgggtggatcacctgagatcaggagtttgagaccacctggccaacatggtgaaaccccgcctctactaaaaatacaaaaattagccaggtgtgttggcacatgcctgtaatcccagctacctgggaggctgaggcaggagaatcgcttggccccaggaggcagaggttgcagtgagccgagattgtgtcgttgcactccaacctgggcaacagagcaagactccatctcaaaaaaaaagtaggaaagcaagagcaccttgctgggagctgaggggctatgggatagtgtatggtggaactaaaagag

SEQ ID NO: 69832 - DNA, 1321 bp, Homo sapiens
agttaaaacagcctcaatgcccgctgctagaccctaaccactccgtatattttgaaagaagcctttcttgatgcagggtgtctgttggggctgtttcgggctcgcccacctgccctctccaggccagaagctctgcatgagcttgaaataatttgcactcccactcgcgagctggtgctgctgccacaaaaacaccagccacttggctctgctaattgctaatcaccaacatgcaaatcagcctccactgcagagagctggaaagacaagtttttctcacctcaaaaagccactatcccccccgagctccatttttcctttccccacccagttcaccaacccagttatacctggctgctcttcttccagctccaagctgcctaccaagccagtgccattctctgccacaactgaagtcatctccttttctgctgcctcatcaggatggataccactgcctacctcctgggagggtgcaaaggtttgaatgctagatcccaacataggagaagtctgtggggaggtgaaaaaactagggggtccattgggcatcacctcaaaattctggtcaggaaaggaatcatacagttcttgtgaatcaaagttaagccccatgggactctgggtaccgttggcccagaactcttggctcccagcccgaaggttagtgttatgacttggggatgaaggttgccggctgcccccaaggatgccgttgagtgggtattgtccccccgagaactgggagagaaggggtgggtccttgaggttgctgccaggattggcagatgggtactgtgagtagttccagagacagtcgtaggccacgctggggtgatggaggtgtgaggtgctggaggagtggggagcagagttcaaaatccctgaagtagtagtgtgagatacagtagataagccattaacattcacatccccattcaaacctggcagagaaagaaagaaaaggtcagttacagatatgtaggcaagcaactttaccaaaacaaactcaaagtaatagcactgactagaaaaagacatggtaaagggaagggggattcctcccctgctatatttagtttttgggtctctggagaacaccaagcccagaggctcctggatgtaggtttagcaactgctgctgaggctgagtagggggctagagagctctccaggcctaccatgagagccaccagcagagctggttgctgctgcttactgctggcttttttttggtttattttttgtttgtttgttttgagacggaatctcgctatgtcaccaggctggagtgcagtggtgcaatctcgacccacggcaa

SEQ ID NO: 69833 - DNA, 1302 bp, Homo sapiens
tggtcccagctactcgggaggctgaggcaggagaatcacttgaaccagggaggcagaggttgccgtgggtcgagattgcaccactgcactccagcctggtgacatagcgagattccgtctcaaaacaaacaaacaaaaaataaaccaaaaaaaagccagcagtaagcagcagcaaccagctctgctggtggctctcatggtaggcctggagagctctctagccccctactcagcctcagcagcagttgctaaacctacatccaggagcctctgggcttggtgttctccagagacccaaaaactaaatatagcaggggaggaatcccccttccctttaccatgtctttttctagtcagtgctattactttgagtttgttttggtaaagttgcttgcctacatatctgtaactgaccttttctttctttctctgccaggtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccaggtataactgggttggtgaactgggtggggaaaggaaaaatggagctcgggggggatagtggctttttgaggtgagaaaaacttgtctttccagctctctgcagtggaggctgatttgcatgttggtgattagcaattagcagagccaagtggctggtgtttttgtggcagcagcaccagctcgcgagtgggagtgcaaattatttcaagctcatgcagagcttctggcctggagagggcaggtgggcgagcccgaaacagccccaacagaca

SEQ ID NO: 69834 - DNA, 1670 bp, Homo sapiens
ggtctccttgctctggggtctgggaggagaacagggctggtggggctgctgaggaccccggacggggccgcgggggcaggaggagctgtaggggctcccggcgacagtgaggaggcggagaagccgcctggctggtggagatgactcctgtgggggacttggggtggaatccccgggaggggctccacctcctcgggtgggggtggggattgcctgagcgcgaggggtgggtgagggggttcccttggcgggttaaaacgctccgtttgcggggagctgggcgttttgactgtggtgagtggagggcggaaggggtttccaggggtctgagggtgtctccctcggggagcgcacccattctcttgagcgtgaagatcaggagagggccttccttgctgagggtggtgctgcgcttggcttggggccctcgcgtcccgggagaatcgcgcactccggggatggaggttgatagggcttccgctgaggctttccaatttgagctgggctgaggggcagaagggaagaataaagaggaattcctttttccaaggagattcctcactgaggggatccccgcttccgtggcagaaagatgataccgcatcatccctttctttcccggtgttcccagttttcaggagaaggcaatgtcaatagcagttgtcctttgtagggttaattggagtgagagatttgtctgctttgggggacgacggaggggatagctttccacctctatctgtacacaaacagcccctcccccagcctcccgcaggaagtggccgggaaatggcagctgtgcgtttgctgctgcgtgtcttgttgttttgaaatgtccattttaatcagatttggtttcattttctgaagccttctgggcaagcttggatcttgccaaccatgtggcccgagagacctttcgttggactttttttttttttgtaaacttgtcaactggaagtagtcaacttcagttgactcacgtatcccaatcccttctccagaacatctctgtcttcctgtctggtttcgttttgttttccctttagctagaggtcatagagaagcaaactcagttatctaccagcggggtacgctctatgtaagtgatgcaaattccctcagcatagagagctgtcagggagactagagagcttttgtggcacgagtagcttcttggggtcctactttagtatagttattatgacagtttctatattgcagagcacctgagcaagtgagcttgtgaagaagggtagattctaagaaatggacgaagaggaaggggtgaggaagatttaactattagatggatttgtgtgtcgggggtagggactgattaacagactgagattggtgaactcagtccttggtggtgattctagcctaagggcagcccctgtgggaagcttgttatttgactaaggggtgctggagatactaccttctgcagaatcaactaattagaatagtacagtttgttatcatatgacttactctttaatccataaaagaacgtctcccctcttattcttcttggagattggtaagcttttcctctgttccctgcaaagtcgtgcccagattttttttttctttcttttcacttgataatcccaggatatttctcctgtaacatatagtgatggactgtgtgctatgtccccagg

SEQ ID NO: 69835 - DNA, 3009 bp, Homo sapiens
gaatgatactaaaaattcttccatcatggctgagagaccagataatctgtcagcttattcagcaggtattaggggtggtaagaagggtcttttgagtgctaagaatatggagtgagatgataaagataggtcagaaagggggatggcttaagtaaaattactttggttcgctgggcgtggtggctcacgcctataatcccaacactttgggaggccaaggcgggtggatcacgaggtcaggagttcaagaccagcctggccaagatagtgaaaccccgtctctactaaaaatacaaaaaaattagccgggtgtggtgatgggcacctgtagtcctagccactcgggaagctgagacagagaattgcttgaatccaggaggcagaggttgcagtgagccgagattgcaccactgcactccagcctgggcgacagagcgagaccctctcaaaaaaaaaaaaaaaaatttactttggttcctgttcttcatgggatctcactttaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggtgagtatattactatgtgggatcagtgtccggaaagtcaaaaagagggcctgtggggactatatgaggactggatctttcttagtgatttgttttggagcaaggaaagttgaggctggcaattgctagtgagagctaatgaggtctcttgagtttccaggtacttaacgctttggaatgcaatatttttctttctttttttttttttttgagatgagtctcactgtgtctcccaagctggagtgcagtggtgccatctcggctcactgcaacctccgcctcccaggttcaagcgattctcctgcctcagcctcctgagtacctgggattacaggtgcgcgccaccatgcctggctactttttgtatttttagtagagaccaggtttcatcagttggtcaggctggtctcgatctcctgacctcatgatccacccaccgtggcctcccaaagtggtgggattacagacgtgagccactgcgcccggcggaatgcaatatttttctaacagcaccaaactaggactatggagaacaagacactgatctttcttggctgagggccctcataacaccaccaccttctctgccccctagcatgtaactttccctttgttagcttgtccaaattaaaggaatgagaatacttaactcagtcttcttttttctcataggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgagattttgagtacaaatcttgaatgtttactgtgctgtggtcccattccaacaaccgtcaagcaatatatgtaatatactatgcttaattatattttttaatttaaaaaacaaacttacccattgattttgtttgaaaatactctacatttaatttgagtgtgatttgttacttgattctctagctcccttttattttatatgtattttttgagactgagtctctgtcgcccaggctggagtacactggtgcaatcttggctcactgcaacctccacctgccgggttcaagtgattctccagcctcaaccatccaagtagctgggattacaggcacacgccaccacgcctggctaatttttgtatttttagtagccatggggtttcaccatgttggctgggcttgtctcgaactcctgaccttaggtgatccgcctgccttggcctcccaaagtgctgggattacaggtgtaagccaccgtgcctggcccatgtgttcttaattcatactgtatcatatcttgtaaatttgatttgtgagggaaatttaagctttctaagatgacatgaattcatcacattctaactgatggcctgaagtggtgaggaatgttacatgatgcagaaagttgatatccctccgcttcttactctttttttttttctcccccatcatacaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcagaatttgtctgattctcttggttctgacaacatagtcaacactgaagggttatgtatttaattttagttttagagacacggtgtctggctgtgttgccaagactggtctctaactcctgggctcgagatctcccacctcagtctcctgagtagctggggctacaggtgtatgtagtctcacatcaccagcactgttttcaacaattagatttttagagtggctataagaagcagtttcagcatgaagtgggccatgtatgtttgaaattggtccttaaaaatagccattctcttttgttgatggacaaccgtacctcttgtgaggggtttcctgtgggtagtgtgatcttagtagggcctcagttttgggccttttgttcaatacaaattgatttttttttttttttggcctctattccatgtggcacatccctacttcttggttaaaaataggacttttttgaagggcatattgggaaaaactcgtttta

SEQ ID NO: 69836 - DNA, 3736 bp, Homo sapiens
ttccattttgccgccccatgaccttgagccggggaacgatggtagctcgggcctaagggatccgtggtgttaaaaggatgcctggagccgcgtcttgctctctaatggctggagaacaagaatgggacacccataggaggtttcttcgacccagctctgtcccattttgtataaagtcctttgtgtgacggaaaaggtgcgggcaggtgcgttgaccttccggttgaataggggtactgaactctcgaaaaatggggtcttgtgcatgcggatgggaaggctgtgcaggcgctttatcgatcgctgcgcggccttccctcttggacacgcgttccgtacaagcggaaagaggcctgacttcggctgagttttcctctccttgtgtgttaagtcctggcttccgatgacctttaactggcctgaccccagctccttccaatatcttttgtctgttagtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtaagtagagtttgttaggaatagtaaagaccttgtgtagcccaaatatccccaaaaccaagctgtctgccttctatgatgattttatcaaaatgactttcgttcttctgagtttgctgaagccacatttaggtactgagaaggagtcttggtcgatttaggtcttgataccaatttatccttatgtataaccctgcgatgcctgtatctaacaggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacagtaagttgctcttattgcatctatgcacaaaggaacttctgttatttgcagttttacacattaaggtgacatgttctcctaaagcagaatttttcttctgatacgttcgattattaaaatcacacagtgcagtttcacctgaagaaattaggatgcagaatttctgattgacaaaagcctactacttgaggtttttttttttgagagggagtttcgctctcgactcactgcaacctccacctcctgggttcaagtgattctcctgtctcagcctcctgagtagctgggattacaggtgcatgccatcatgcccggctaatttttgtatttttagtacagatggggtttcaccatgttggccaggctggtctcgaactcctgattttgggtgattccccccccacctcggccccccaaagtgctgggataacaggcatgagccactgcgcctggctagttgagtatttttaagactcggtcttatggcttaggtttaggagtctccaaaacttgtaggtttttgtatttgctattgctatgtgagggaatgctgttaggttaaggctcagtaaaatgaaaaatttatgacagttaaagtcagggaatgggattattgtttcctaagataataattttctttattgcagaaagttgggttagatcctagatgatagtttatctgatttatgtaagaaaggggaggtaagactgtggttcctcaggtaaagggatggacttgagagttgatagggagggatatataagattatcatttgctttcaacaaggtgaatagatactatcctctcttctacctttacagatttgctcccattcatgctgaggctccagagttcatggaaatgagtgttgagcaggaaattctggtgactggtatcaaggttgtcgatctgctagctccctatgccaagggtggcaaaattggtatgttattaaggggtacatattttccaaacctaatatgggaggaaaaactcatacaatgttatgagtggatattgacatctattcctcactgatgagtacgttctgactttcgttcttctgagtttgctgaagccagatgcaatttctgagaaggaataggatggaaggaagcaattactttttttgaagtttgcttatttaggaaagcagaactcttaaatattctttcttttcaacctcttatagggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtaagcattgagctaattgatgtccacgtggtagttacgccaggaaactattgccaactgaagccatgttctatattttctatttaatttttttttctttttaagaaaatgttaatattttcattttcgtgtcccagggcctacaaaggaaacctgttagtgttttcccccccaacttccaatacacaaatggacattttctttcctctttgatactgacattaaataacatttccaggttttctttttggtagatagtcccatcatttgaaagctaattttgggagggctggattggacgtggtacatatgtttcagttaagcctattttgtacttttcacttaacttgaataggtttttatttcctttctactatagttttgccttactaatataagaagctgtcttttttttttgaactgcatctctaatagggaaaagaaacttgcacacaaaaacgctgacaccttctgagaaaggatctgtggtcgtttctccgatttgggaaccttcagtatgtggcttctctactcctttgtcaggttttacgattatgtatgattactgcaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtaagagggaaggcttgagaggacctggttcatctggcctttcttcggatgaggctaaggatgtagacacctaagacctttttttcttttaggtgtctgcattattgggccgaatcccttctgctgtgggctatcagcctaccctggccactgacatgggtactatgcaggaaagaattaccactaccaagaagggatctatcacctctgtacaggtaagaaaaattacatagatgaagatctgatttgtataaaggcagggtgcagtggtgcatctcagctactgaggaggctgaggcaggaagattgcttgagcccaagagatcagcctggggaacaaagctgtatgtatgtagagagatgtataaaactgactgggccaggcgtggtggttcatgcctgtaataccaacactttgggaggctgaggtacgcggatcatgaggtcaggagttaagacaccaccctggccaacgtggtgaaatcccgtctctactaaagatacaaaaaattagctgggcgttgtggcaggcgcctgtaatcccaactactcagaggctgaggcaggagaatcgcttgaatccgggaggcagaggttgc

SEQ ID NO: 69837 - DNA, 2224 bp, Homo sapiens
gtgggctaaattgtcaccaaaaggcacacatcattttttataggtagataaatcctctgctgtacatccattcaccttaggtaaacctagtcaagtccaatgactaaatttctaggcttgatatgactacctacctgtgctactttagtcaaaaatatagcacttgaacttttttaggtaaactgttcagttagcaaacgaatatttgatcagctcggtaactttattttccctctttcaggattcacaagacagtgatgatgaaagtaagtgtatataaaaagtatgtttatacagtgatactttgcatcaaaaaacaaactcaaaatagagatgttaacttctttggaagtaaagtaattttttctttatgaccttgaataaataaccaaagcagaaatgtgaataacttgatagcaagacaacctattaattcattgggcaactatgtatttcgatttttggttgcttttcctttaagacagtaaaattggtagattattcacttgtactatatactaatatttttaaaaattctttcagaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttgaacttctgcattttggcagttttcattccctcacagcttctgtatttgtcataatgtagaaacactatgtattttagtgtttctttgtcagatattcaggacctgtgttgcaggcagttaaagtgctggtgatacaaagattaatatttcagatgattgctgagctcagagagctcacaggctaggggagacaaacatgagacaaaaacttgatggaaagtgcgataatagatacgcataatgtattacgatgtgtagttcttagcttcaggggggaaaacattttaaaaaaacttgtttttcttcaaaaaatttatacttcagttttgggaattaatgattcactggcttactgcccagccttgaaacgcattatacaggccggcacggtggctcccacctgcctttaatcacagcactctgggagactgaggcgggcagattgcttgagaccagcctgggcaatgtggtgaaactcccttttttttttttttttttttttttttggagacggagtgttgccct

SEQ ID NO: 69838 - DNA, 1052 bp, Homo sapiens
gcctgtaatcccagctaccctggaggccgaggcatgagaattgcgtgaacccagaggcggaggttgcagtgagctgagatcacgccaccatactccagcttggacgacaaagctagactctgtctcaaaaaaaaaagaataccttaatacatgttccacctaacttaagatagatagctgtgcaactacaaatgaatcccattcttttccttaaccaccagaggtaaccactactcaagtagaatttttaatgtttgtcaaacctgttgcatgaatagctttgcttttctttagggaaaatttagttttaatttccatatgggtttttaggattttgtataattacctataatcttccttttccagaagggaaagatgcttatatttgcattttgcattttttgatatctgtggcagacttaaggtttattctgaagcatacagcattaataattagggcctaacttaacatcatttttaaaactaatttttacacttcaaatagatgatgaacaacatgggtggtgatgaggatgtagatttaccagaagtagatggagcagatgatgtaagtctaaaaattcttttttctgtttactttcatactattaaatagtaagaaacaacatatttacaaatggttttatatagattcacaattacttcttattttctaaaaaaaaagaaaagggaaaagcaatttttaaaatgtgcccatttttgacgaatgggggtatctattagggaactggttgtaccgtagaccattcctaaatggattagatttccaaagaatcattgtatagagacattatatattaataccgtactcaattataacagtcagtttaggccgggcgaggtggctcatgtctgttatcccagcaggccaggtgggcagagtacgtgaggtcaggagttcgagaccagcctggccaacatggtgaaaccctgtcttaaaaacttagccagacatgatggcaggtgcctgtaatcccagctactggtgagctgaggtgggagaatcgcttgaacctgggaggcggaggttg

SEQ ID NO: 69839 - DNA, 1136 bp, Homo sapiens
gattacacaactagtctttccaccttggccacccaaagtgttggggttacaggtgtgagccacctcatttagcttagtctattctttgtgtgctaattacatgccctcctaaaaatacaaagtcacagttcaaaaaatattgttttgccaggcaccagtagcatgtgcctgttgtagttaaaagctactctggagggtgaagtgggagaaatacttgcgcccaagtctgggttgcattgccatatgtcaggtaaccacgctaagttaacatcagtacggtgttgtcccaggaagcggggaccaccaggttgcctgaagagggtaaacaagacccttggtcagaaacggagctggtcaaaactcacatattgatcaatagtgggattgcacctgtgaatgcttgctgcactccagcctgggcaacatagcaagacctggtctctttagaagaaaagaaaacgtagtcttaaggttcatgccaaatgcaaattagcctaatcttagggtgatatttgtattgatttatagcttaattggcttagtgtcgacttcaataattggaaagactgggaagatgattcagatgaagacatgtctaattttgatcgtttctctgaggtaagttcctttaaatggacctctccccattcgaagcacacggtacctgtctatgtagtcaatttaatatggttttgggcacctaatggtattcatgatgcatgttattttatttttaagaccattttgcagtcatagtaaatagatgttaacaatggcaattttaatcctgaagttgaaccattttaatgattttaaaaggaattagtgttagctacaaaagttacaaaagttaatgcattaagacaaactaacacagctagtttgctaatttcatcattgggactttttttttttttttttttaaagcatgattgcagtagttgacttggattttgaagtcataaaataagactataaacttttggccgggcacggtgctcacacctgtaatcccagcactttgggaggccaaggctggcagatcacgaggtcaggagatctagatcatacgggccaacttggtgaaacctcatctctactaaaatacaaaaaaaattagctgggcatggtggcgc

SEQ ID NO: 69840 - DNA, 2300 bp, Homo sapiens
gtgctgggattacaggcgtgagccaccgtaccctgctttttttttttttttttttttttttttccgtatttgtatttgtagtagagtcggggtttcgctgtgctggccaggctggtctctagctctcctggcctcaagtgacccacctgccttggcctcccaaagtgctgggattacaggtgtgagccactgcacccagccaagtaacataatttttgataggactagataaacggctaactctactaagcattgtttggtttttaaatctttcctattatgaaattggaatcattctgaaactaaatcttgttagacccataggttttaacttggaatgtagctgttagggtaaaaatgtagtttttgtttaaaattgtaacaaactgccctgaaataatgctataatggtgtcgaaggttagtatgtgaatgtttagttaatgaattccagcttgactttccctactttatccttttgtaggcagcctgcttctgcaaagtggtacgatcgaagggactatgtcttcattgaattttgtgttgaagacagtaaggatgttaatgtaaattttgaaaaatccaaacttacattcaggtaagttaagctttttatccaatgatgtaaaatagtcattcacacaactgaataactttgactggcttgtcttttcattgaagttattattaatctttgtctctttgaagaggcttaattctttctttattattttatacagttgtctcggaggaagtgataattttaagcatttaaatgaaattgatctttttcactgtattgatccaaatgtaagtagtctttatgctttaatccaaattttagttgtgaggaaacagacataccaagtattctttttagcaatgagcattagttctgtttttcttaacagtgaggcaaactatgtatatttacattttgtagaatatttcctccaaaattggtttctgcatactttttgtttttgctatcactgtttgggcttagagtagtatccttgaggctcgtctcatcttttttatttgttttgtttttttgtttgtttggttttgttctttgagactgctgcagtacaatggagcgatcccggctcactgcaacctctgcctcgtaggttccagggattctcctgcctcagcctctggagcagctgggattacaggcacatgccaccatgcctggctaatttttgtgtttttagtaaagaccatgttggtcaggctggtctcaaactcctgacctcaggtgttccacctgcctcggcctcccaaagtgctgggattacaggcatgagccactgcgcccggccaaggcttcccttatctaagaatagaatctttaaaccattctgtggttatatcatttttagttaaagtttttaaggttttattctgtttatcgtgtgcaggaaagaaaaaaatggtaccaggttaaactttaaactttattgttgtgcagattatttcagtaggaaatagaagggaaaaaaaaatttttttttaaatgaaacttaaagggggttggggcagttggatagtttgaagtttttagtagtcaagggcatgtttcagagtccagagaaaatttaggtaaagaaatgagaaaggtgagaaatgacaagctattttctatcatgtagtgatgctggaaagataaatggtatgatggtccttttgtttttaggattccaagcataaaagaacggacagatcaattttatgttgtttacgaaaaggagaatctggccagtcatggccaaggttaacaaaagaaagggcaaaggtaggtttcattttccttttttgaaaagtttgatatttttattttaggtaataaaagatgtacttatttgatgtaaggaatatggctgtgtttttgtttcacagctaagtataaagcctcatgttcatgttttttgtctactcagttttaatacgaagtgtgatcagaatatcagttattaactggtgtagaatcttttgtacttaagagacagactttgcataaattactcagctatcacatgggaggggacaaagcttggtgaaaaaataatcaactgaaaatagttcttactagtaaatttgttttcaaaaggtatgtttaacaattttcagtgttttttttcccccaaaacagggtctctctttgtcacccaggctggagtgcagtggcacgatcttggctcactgcagcctcagtttcccaggctccaagtgatcctccctcctcagtcccccaagtagctgggactgtaggggcatgccacaacacctggctaa

SEQ ID NO: 69841 - DNA, 1389 bp, Homo sapiens
gagaaatcgccgaaggcgcatggcagggcagttgggccactaacggttttctaacgcgagaagacagagcgggaggagaggcgggaacgcgtagggactagcagggggcggagtgggggtggggtggcggacgaagggcggggccggcgccaggaaggatcgcgaaggagctgggaggccccgccctttccgtagatatctctagaaagccgcgccggagcccaaaaacaaggactgcgcacgcgcggcggcaaggcccgggcattttgctgcgtcaccagccgccgcccggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgtgagtgcgacaccccgccgagggaaggtcgccgagtgaggccgaggccgcgttgggggctccctggaagcggccccctagcctttctcgcatcggtggtggcagtcgttcctgcctgggggcgggaggtccaggatccttgttccggttaccgttggcgggtggaggacatttttcctccagatgtctgcttcccccacccctgaaccgttccttggcttccccatgccggaaatcctacttttacccctttggctgtctgggttactcgcctctttcggtaacttcaccctaggccttaagctcccggtagctgctcgccatgcggcgccctgaagcgtgaaccttcgtgggtcgcctctcggctgcttgggcgctccggttctgttgctttgtggtcccggggccaggccctgagtcgagtgcacctgtggtgggtgccgccaggtgcctggcggagctcctgggagagccccacgcggacctcgccgtgagctgcaggtactgctaggcaactagaaggaagccatgcccacgccgcaacatacttccctctccagtgtctgggtttcttgagtgtgggtacttccagtccgcctcctaactccagtctcttgaaaacacgggaggttgccaaaactcagccgcttccctggcagcgaggaggagttaccattgagcaggtagttccgcacgtgtcgactttggaaagatacggacattttctgtgtttcatgttctacttgaggtgaggtttcactatcttgttacagtgtaggatgaaataggtatgtagtaggcatttaatt

SEQ ID NO: 69842 - DNA, 1817 bp, Homo sapiens
tgcttctaaagaggttgaaaacctgatactattttctcttctttaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaaggtgagtaaacttttcttgggcattgttccagaccagggtttctcaacctcagcactgctgacattttgcgtcagatagttctctgttatggaagggctatccattacatccagttttgattacccaaaaactccattgccatatatctcctgggagacctaactaccccctagttgagaaccactgctctaaacctaaacaactactctttctactgtgagggcaagcagtttaaagctgtacaataagttacctgaatgggtttacagagagttgtgaaactatatgatttatttttcaaagactgctaatctactcacatggatctgtattttctaccctgtagatcgaagatttatcccagcaagcacaactagcagctgctgagaaattcaaagttcaaggtgaagctgtctcaaacattcaagaaaacacacagactccaactgtacaagaggagagtgaagaggaagaggtatactaggaaatctttcataatttaactctcgccgtatagcattgtgttcgtgttggtgagctatattaaaaactagattcaggagactccaaagaactgctgaaattgttcttgcctttaatttactgctttttccctctcatctctcaggtcgatgaaacaggtgtagaagttaaggacattgaattggtcatgtcacaagcaaatgtgtcgagagcaaaggcagtccgagccctgaagaacaacagtaatgatattgtaaatgcgattatggtaagtgttcaagcctttgttccttgactccctctgccctgaccaattatgagtgactttattttgtcttgctaaatatcagccaattaaggaacctcattccagagcctcttctgagttgccgtataggttttagtggcctaaattctcctgatttgcctgtaagagttttagtgacctgaattctcctgatttgcctataagaaccgctaattatcttttctctgttacaggaattaacaatgtaaccatatggaagcaactttttttggtgtctcaaaggagtaactgcagcttggtttgaaatttgtactgtttctatcataaataaagttatggcttcttgttggatgaattcagtcggtgactggtctcttccccgccacccccccacaccaaaaaaaaaaaaaacttaaaaaggttctagtaatttattaattactcctaaggcctccctcatttgataaggtttagtgccacagatttcccacttagaatctcagactttatacctcttttaagaagttactggccaggcgtggtggctcacgcctgtaatcctggcactttgggaggccaaggagggggcagatcacgaggtcaggagattgagaccatcctggctaacacgttgaaaccccgtctccactaaaaatacaaaaaattagccgggcgtggtggcgggcacctgtagtcccagctgcttgggaggctgaggcaggagaatggtgtgaacctgggaggcagagcttgcagtgagcccagatcacgccactgcactccagcctgggcgacagacagagcaagactccatctcaaaaaaaaaaaaaaaaaaaaaaaagttactatactaggctgttaggaccttcttaa

SEQ ID NO: 69843 - DNA, 1968 bp, Homo sapiens
ctctactccctgttcagaaagactcttcaaagacagcaaaaggcaaagatgcttctcattccccaaagggccccttggctcctcctgagtctaaggcgtccacccctctaacagcagctgcctttgagaaggtccttcctaaacctgaatcagcatctgtctctgcagcaccctccccaccagtctctctgcctcttgctccctccccagttcccactctgcctcctaaacagcaatttctgccgtcctctcctgggctggtgttggaatcaccctctaaaccccttgcccctgctgatgaggatgagctgctgcctctgattcccccggaaccaatctctgggggagtgcctttccagtcggtcctcgtcaacatgcccacccctaaatctgctggaatccctgtcccaaccccctctgccaagcaacctgttacgaagaacaacaagggtatttgccttggtttgccgtgtgcatggtgtgtctgtcgtccacacccctcttgggcgctacccaccaatactaaccctgtgatgcgccgctttctccagtgaatctgcttgggtttggatgtagaacatagaatgataattttaaatgcaaaagttctaggaatatgaaaccaaatcttggttttcattacttcagatagatacatagtacattgtgtatcatttttgtgtaatgtggcccggactaccctgagcctgccatgccatctattttacctaattgatctgacattgaaaaccaagacctgccagaccttttcatttgctctaatccctaccacatcactaactaaccttgtccctgggcctgagatttggtaaaattattggagaattgaactatttgtatttatttttccattattagacttagtaatgaccagttgcccagggactcccttttcataaaaatgtagaaatctgtttttcctagcctgaaaatggtgcaggtgtatgctttttttcctcagtagtctttactgatgcttggcctttgaattgaaagaaatttatgtgaattatgtttggaaaaactagagatataggtcatcatcattgagaatcttctaattatattgattagatcacattgctggggtgaatggtttgaaaatgaggctgaatatgtgtacgtgtctgcttttgacttcctccaacccagtttaaaagttgaggggaaaaccacccaacctgttgtgcctccacggtgtgattttggttttttcacttaagtgtatctgggggcaccttctgacagaactttacagggataattggactattgggtaaaattttagagtcatatgggtcattatttgcctgtgccaagaaacaaagaccttgagggaaagaaagcagttacagtatattaaactgctcagctatttctagtgattagtcctcatttctggggttagggctgggtctttactagatgtgtacccgctagttagtgactaagttaggggctatcaagctgacttcacacaagccagttggtttacatttaacattcttaggtctagcatgaggcattcacctctagtccagggcaggctgtggtgaagtaccttctcttataatttctactataaagcagtaaaagttgtttctcatcttagggtctggaacagaatctgacagtgatgaatcagtaccagagcttgaagaacaggattccacccaggcaaccacacaacaagcccaggtgggtattctcttactaactggtattgggtcaaagaagcagggttgatcagggcaacttttgtatttggaactgtgaaccttcataaaggaaaacccacaaggagattgtgctatccagatcttagattctggttaactaatagctgttttatcttcttagctggcggcagcagctgaaattgatgaagaaccagtcagtaaagcaaaacagagtcggagtgaaaagaaggcacggaaggtaagattt

SEQ ID NO: 69844 - DNA, 4202 bp, Homo sapiens
gaattaacatcacctaggaaggtttatagagactattacagtccttttgtggttggttttcttgtttgggttttgtgagtaagtaaactggtaaggtataaagaagctaagtgactttaatacttgatattaaattctgaagtgtttcaactttaggaagaactgaattgtgctgtgcacctccttcccaaaactattctaacagagtcagatgtttcctagcctagtggaagcctgaaagtataaaagcctgtgttttcttattcagttcagattccccatcatcgtcactgctcactaacttctttgttccagttttcagtatcttttctgttcatgatatttgggtggacagagtagcacagctgttcttctcgtgggaattctgttggctgtgagaaagacttgggaatacagtccatttcaagaagtaaggggagggcacaactgggaaaggatagaaagcatgttgttctcaacctaccaagagtctgtgctccccatttagagataggctgctcttagactgttctcctcaccctaaaatagttggtttactttggtagaacttggggaagtgtgagaaattaggaggggaatgtcttctcacttgaccactgaaaaatgtttggggaaggttgttgttgcctgtcacctttatctaatcctgcgtggtgacttagactgtcagattttaaactccagtgtttcctaggaggcatgttgtaccaagttgggctgcataactcaccttttttctcctccccctccccctttctttatctccttttgcctttctccagctgtgctacctatgtcttcagccttgagtgtcactgctgccttagggcagcctggacctaccctcccccctccttgctctcctgccccacaacagtgccctctctcagctgctaaccaggcttccccattcccttccccctctactattgcctcgacccctttagaagttccttttccccagtcatcctctggaacagccctacctttgggaactgcccctgaagccccaaccttcctaccaaacctaatagggcctcccatctccccagctgccttagctctagcctctcccatgatagctccaactctgaaagggaccccttcctcttcagctcccttagctctggttgccctggctccccactcagttcagaagagttctgcttttccacctaaccttcttacttcacctccttcagtggctgtagctgagtcagggtcagtgataactctgtcagctcccattgctccctcagaaccaaagactaatcttaataaagttccctctgaggtagtccctaatccaaaaggcacccccagccctccatgtatagtcagtactgttccttaccactgtgtgactcccatggcctctattcaatctggagtggcctcccttcctcagacaacacccacaactaccctagccatcgcttcccctcaagtcaaagataccaccatttcctcagttctgatttctccacaaaacccaggaagcctcagcctgaaggggcctgttagtccacctgctgccttatctctttcaactcagtctcttcctgtggtgacctcttctcaaaagactgcgggtcccaacacccccccagattttcccatttctctgggctctcatcttgcacctttacatcagagttcttttggttctgtccaacttttaggtcaaacaggtcctagtgctttgtcagaccctacagtgaagaccatttctgtagatcattcttccacaggggcctcttatccttctcagagatctgtaattcctccccttccttccagaaatgaggtagttcctgctactgtggctgcctttccagtggtggctccatctgttgacaaaggtccctctaccatctctagcataacctgcagcccttctggctccttaaatgtagctacctctttttcattatctcctacaacctctctcattctcaaaagctctcctaatgccacttatcattatcctttagtggcccaaatgcccgtttcttctgttggaaccaccccacttgtggtgactaacccctgtacaattgctgcagcacctactactacctttgaggtagctacttgtgtttctcctccaatgtcatcaggtcccataagtaacatagaaccaacttcccctgctgccttggttatggcacctgtggctcccaaagagccttctactcaagtagcaaccactctgaggataccagtctctcctcctctgccagaccctgaagacctcaaaaatctccccagttcagtattggttaaatttccaacacaaaaagacctccaaactgtacctgcctctcttgaaggagcccctttctctccagcccaagcaggactcaccaccaagaaagaccctactgtattaccgttagtccaggcagcccctaaaaattccccttctttccaaagtacatcctcttctccagagatacctctttctcctgaagccaccctagcaaagaaaagccttggggagcctctccctataggtaagccagccagcagtatgacctcccctctgggtgttaactcctcggcctctgtaatcaagacagattcttatgcaggcccagactctgctggtccgcttctcaaaagttctctcattaccccaacagtggctgcatttcctttggaaagtgctgaccctgccggggtggctcccacaactgccaaaggtacctcaacttatacaactacagccagcccttttctagaaggaactgtctctttagctcctaaaaaccacccagttaaggaaggtactcttactactttacccttggttcctacagcttcagaaaattgccctgtggctccatccccccagaatacctgtgctcctctggctaccttagtgctggcccctgaaatcccaaagtctgtgccctcaccctctcttcccccagctgggactcctccaggtacaaaaaaggttgatggtatttctcatacttcagcattggcacctgttgcttcctctcccaaagagtgcccaactgaggactctggtgcttctgctactgcatcttccaaaggaactctgacttacctagctgattccccatctcctttaggggttagtgtgtctcctcagactaaaagacctccaaccaagaagggttctgctggccctgatactcctattggaaatctctcatcccctgtttctccagttgaagcttcatttcttccagagaatagtctttctttccaaggctctaaagactcaccagccacgacgcattctcccactcctccatcccccaaaggggcccctactccctcagctgtgactcctctgtctcccaaaggagtaacactaccccccaaagagacccccactccttcagtggtgaatctgcccttccccaaagagggtccagctactccagcacccaaacaggctcctgctctatccatgacttcttcctcccccaaaaaggcccgagcaactccagcccctaaaggaatcccagcttccccatcccccaaaggggcccccacacccccagctgcaactcctccctcccctaaaggaggcccagctaccccatccccgaaatgggcccccacacccccagctgcaactcctccctccccaaaaggaggtccagctactccatcccccaaaggggcccccacacccccagctgcaactcctccctcccccaaaggaggtccagctactccatcccccaaaggggcccccacacccccagctgtgactcctccctcccccaaaggaagtccagcagctaccccattccccaaaggggcatccacacccccagctgcaactcctccctcccccaaaggaagtccagcagctaccccactccccaaaggggcccccacaaccccagctgcaactcttccctccccaaaaggaggtccagctaccccatccctcaagggggcccccactcccccagctgcgactcctccctccccaaaaggaggcccagctaccccatcccccaaaggggcccccatgcccccagctgcaactcctccctccccaaaaggaggtctagctaccccaccccacaaaggggcacccacaaccccagctgcaactcctccctccccaaaaggaggtctagctaccccacccccaaaaggggcccccacaaccccagctgcaactcctc

SEQ ID NO: 69845 - DNA, 1136 bp, Homo sapiens
tagttcctgcatcattgtgtgaaacccaggattgaaataaatccttttatcctcagcgtcgaaattaacgactgtgaaggctaattttaaattctggttaaaacatatctctgtagaaaacttaggaggaggtaatgaaaagttcttaaaatgatagcctttctgagtcagttgtgcagcgttaaatgaaggaaatcttcaggctgtaattttcattctcacctttttggttttttttaaatttcatttgttatttaagggcaattcctgtccctttttggagttacagtagagttgcttatagttgaaagcataaagtttcttcccacctgtttgattttaacagctgaagggattaatacagctgctaggaaggacaatagggggctctaagctggagtataaacaatatgaaattcttgaagtacaaggggcttaaggaagggaaaaaataaagtactgttctctaaagattctgtaatttcagtacaaaacgagattttagagattgtgtcattgaacaacttaattttacaaatacgaagatttgaaattcagatgaatttagaataatctgattcaagcttcaaaactaatgcatttacttctgaaacagtccttaatgctattaaacgtattcctgaatagtctgagttgcatagtaggcttatattaaggaagtaccaatgataaatacacaaggttttatctgtaatgatagtctattagaatgaagaaggaagctcaaggaattgttgatggtgtcaaagcaagtatttgagtgcttattccatttgaggtccagtcagaagaaaacatattccatgtttttaattctgattcattatgtttggtagcgttttcctgtaatcgttagactttggcctacccactctccaggaaaaactagttgagccaccttgtcttttccatggtaggatgccataagaacttcagaattactggttgagtgaattttgaatttgaattttggtaccacgggcttcccccccgccccccttaacattcccttctaagcattgagcatttgttgatccaattctgtgttacctcctgaatgccagagatactgtcttactgtcatgccaaacattggtgtattttgacataatgaa

SEQ ID NO: 69846 - DNA, 1120 bp, Homo sapiens
ttgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggagggcggagtctgcttagttctgaggactgcgtgggtccgcgcagagagctcctgctaggcctgcgcgtcccgttctaaattcttaccctttagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacagtaagtactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaagggtaaggggtcacagccttagaacctgtaacaccgttctccctgtgacaagcaagtgttggacttaaaacaccgtctttcccctcctggtaccccaaagtcggcaaacgtagtccaggaggccccagcccagccagtgtgagtattaggagtggagggggtt

SEQ ID NO: 69847 - DNA, 1054 bp, Homo sapiens
ttttaaagagaaataaaaggcatgctggacatggtcattcacacctgtaatcccagcaactcaggaggctgaggcaagaggattgtttgaggccaggagttctgggcaacatagtgagaccccaactcaacaaaaattgaaaaactggccaggccaggagcagtagctcacgtctataatcctagcactttgggagacaactgaggtgggaggatcacttgagcccaggacatcaagcctgcagtgagctatgaccatgctactgtatgtactctagcatgggtgacaaagtgaggcattaactctaaaaaagagtaagggcacagctaatgtgaaagtaatttatatttctaaatactcttcttaacagataagtttaaccctttgtctaagccttaaataaaaattttaaccaaaaataacctgtaggagatgactataatgatttatagtccacaatcatcagtttataacttttgtgtcttacaggtcgcatatctgtgcctattgatttgcagaaagtggaccagtttgatccatttactgttccgaccataaggtatgtttcagatcattgatcactccttgtttgtaattgttgttatgaattttaaataaattgaattagcctccttagagaagtagttgcatgggaatggtatatttggttatggaaaccaaataaggttcaaaggttagatgacgatgccctaatagaacaatacaagattttcacctgctgttatgtaagaaaaagattttaaggtcaagtaaatttaggaaattctgacttaaacagattaaaagtatcttttactacagtatttcacagtctttcatatgataatatgcatgaaaaactccaagaagagatcatggtgtttagaatatcccaaatttagctggccgcataatttttttacagtaaattttatgggattcacatgctattatacactggataatgctgatcagaaaccaacattaaacttctcttgttcgtggtgaggcgcggtggctcatgcctgtaatcccaacactttgggagggcaaa

SEQ ID NO: 69848 - DNA, 1050 bp, Homo sapiens
tatgatggggagaacagcatgcactctacctgtctcacagttgtatcaatgattaagtgaaagagtaaatgtgatgcatatttgtaaactgcaaacattatatgattgttgagatattaatacaagcaattcacagtggaaagtgtaggctgcatcccacattctactactgatgtattatggtgtcctgggttggttactttctacccttattgcgtatattaaccttctaagttgtgaggtttaaaaagtaaacatttcttgtatacccattctgtgccaggttctatgtcaggttcttttcccttaaaagtgtctcatttaattatcataaccctgcacagggtagtattcccattttacctagttaagttctgaaaatgtcatgaaaataagcagtagttttccccacaatggcagcaatacctatgtggcatatgtgttactgatagtgttgggactctgttgttattgttgttcttacagaaaatctataaacataataaaaaaatactttgaagaatatgccttggttaatcaagatattctcgaaaataaagaaagctgggataagattttagcccttgttcctgaaaatatcctttcccgtgatcatttctgtgtgagctagttgttttgatctgtgatattataaatgttagacatgtctgcttgtaagttctcatatacttataagtttaatcttttttacacaaaatatctcctgtatttctggattttagtatctctggtctggaacataataaaaaatggggccatgttgcaaatcagttttctcattttggaagttggtcctagaattaacagctaaagaatggtgaattacatagtcaaaatacatgcagaccagggaaaactttacatcataccttatagttattttggcattctttctgttatatcatcactgtatttttacaggggaagatttcaatgatacaactggtgttggtttggtttggggtttttttgttgttgttgttgtttttaagacggagtcttatactgtgttgcccaggctggagtgtg

SEQ ID NO: 69849 - DNA, 1012 bp, Homo sapiens
gtcagccaggctggagtgcagtggtacaatgtcggctcactgcaacctctgcctcctgggttcaagtgattctcctgcctcagcctcctgagtagctgggactacaggcgcacgccaccacgcccagttaatttttgtatttttagtagaggcagcgtttcaccatgttggtcaggctggtctcgaactcctgacctcgtgatctgcccacctcggcctcccagagtgctgggattacaggcgtgagctaccacacctggcctaataaaatagttttttaaaaaagaaagaaattcccagcagagagaccaggatgggtaaagagatgaagcaagaacatggggagcacaggaaacaacaagtaatttaatatacattaattaaggagtttatagatttgttttaaaacctattatttctctcttcctcagaggactttggatttaagcatcgtctctgggtatattctggaaggagaggtgttcattgttgggtctgtgatgaatcagttagaaaactgtcttctgcagtacgttctgggatagttgagtatttgagccttgtaaaggtaagatcctcttaattctaatttgcattgctttagtttctagatgttaccaagcctgatatgtttactgtcaaagaaaatgaaactatcttttttttttttttttgagatggactctcactctgttgcccaggctggactgcaatggcatgatcttggctcactgcaagctctgcttcctgggtccaagcaattctcctgcctcagcctcccgagtagctgggactacaggctcctgccactgtgcccagctaaattttgtatttttagtaaagactgggtttcgccatgttggccaggctggcctagaactcctagcctcaggtgattcacccacctcagcctcccaaagtgctgggattacagacatgagccaccacactggcctaaaacttatctttaatggcattcacattgcagagtaaatgatcttaccaatagatc

SEQ ID NO: 69850 - DNA, 1305 bp, Homo sapiens
tgatcccccgggggctgatcagattgatcagggtggctcagttggtcccagtcagatacgtcataggatcagtagctcatgagatttgttgaccaaaccctctccctgttggtgacccctgtattcacacctgaacttcccgtttccccccaccccaccaaagtcatgtctgcttcctctgcctccagctcaccctcttctgaatggttttgcttgaaacactatattgtggcagagggcaccctgggatacctggtagaaggtattcattttattttgcatttttaattgttttgactttctgttcatttgattttgttgctccctctctcctggaacctagtttactactctcttctgtgttactctgaagttctgtttaagccttgaacatcctcttctcccattttcttggtatgtactcaggaccagctacatcatttgtggagccctcttattcataaattattaaaaatttcaaggtggtggtcatagagcattaaaccaaatatgaggccattcccaacttgttttccgaggggaaaatggtaatacttgtgtggcacccggggttaaacagcagaggctccatgtggccagaggcagagattagtatcctggcactccagtgacccactgggtgactcactgatgccacagcacccgctaggaagctctgctgaaccttagtatttggtcctaaattttatgactccatggagttcccgtagtccatggctagttaggaagaaaggaggtgggataagggtcaggcccaggtgacccctaagaaccaggagatgggtaaaagtttttttttatattctgcttttctgatctgtgagtacctgtttgtctccaggccaaacctttgggcttaaatatctttttcctagacaggtttttgctagtgttgaattttcttcttcctctggcctccttctgtgcccctttccccaagcccaagactgcttaacttccaaagcaaattctagatagacactgtatttattggtatgggagtgggctctatggggtggtctgcacccatctgggactcttttccctaaatcctgcaccaaatgagtcaggaggcagggtgcacagcattagtttcaatgtggttatgcatcataagcttaacatcagaatgaaaatgaaactcgattttgatgtttctttaaaacccttcccctgtccaatccactcgccgcccccaccttgaatagctaaagtctcttatgaaacagagaagagttgttgacgtctaactccttccattaaattaataagtactgacctcct

SEQ ID NO: 69851 - DNA, 1061 bp, Homo sapiens
actcctaggcactgtcagcacgggcatccagaccagcacgagctcctgccagccatacaaagttcaaagcaatggagacttcagtaaaaacagcttcctcacccctgacaatgcagtagacattaccactgggaccaactcctgtctgagcaatagtgagcactccaaagatcctggctttgggcagatggatgagctccagctcgaggacctgggggatgatgacttgcagtttgaagaccctgctgaggatataggcacaactgaggaggtgattgagctgagtgatgacagtgaggatgagttggcttttggagagaatgacaatcgggagaataaggccatgccctgccaggtgtgcaagaaagttctagagcccaacattcaactgatccggcagcatgctcgggaccatgtggacctgctgacgggcaactgcaaggtctgcgagacccacttccaggaccgaaactcccgggtaactcatgtcctgtcccacattggtattttccttttctcctgcgacatgtgtgaaactaagttctttacccagtggcagctgacccttcaccgacgggatggaatatttgagaacaacatcattgtccaccccaacgatcccctgccagggaagctgggtctcttttcaggggcagcctccccagagctgaaatgcgctgcctgtgggaaagtattggccaaagatttccatgtggtccggggccacatccttgaccatctaaacttgaagggccaggcctgcagtgtctgcgaccagcgtcaccttaacctctgcagcctcatgtggcacacgctgtcccatctcggcatctcagtcttctcctgttctgtctgtgcgaacagctttgtggactggcatcttctagagaagcacatggctgtgcaccaaagtctggaagacgccctcttccactgccgcttgtgcagccagagcttcaagtcagaggctgcctatcgctaccacgtcagccagcacaaatgcaacagtggccttgatgcacggcctggttttgggctgcagcacccagctctccagaagc

SEQ ID NO: 69852 - DNA, 1024 bp, Homo sapiens
atgtgcctactgcatgggggccaagccccaccaccctccctgtagttccaactgtgctcctccttgcccactcccgcaagaagctaggtgtgtccctctggggcaaagtccatgccagaagtttacaggagtgggtgtaaaagctagagatggaaaaatagagacagacatgtagcacatccagaggtcctgacaactgcctgtttgttggggaagcaaaccccactttcattttctttgggaaattccaatctcttatggaggaatcctgcctctatcctctataattctgccttgtcaagttcccattttaaaaatgaagctcactgtagcaatgacagggaaggagagacctttggaagaacttctgaaatggttatgggtaggttgggtgtctttaataggggctgtgagaggtaaggtgttgagaagaagcactgggggtagatggggagtctggaccctggccagggcccattgtaggagagagagggctttctgtacctggcggcagcacaagtctttgcttacactttcctcctcagccctctctccttcagtcacaactctgctcccccagttgtagcccactgggtgcctgccttcccctggtggtcagaggaaggtgttcctgttccacccctgccccacccccaccaactgtaacccaggcagcagaggatctcccccacctcctgctgagagtttcagcctccctattagcttgggctggtccagaggcctctcctaggttgggggctctctttagggccagggtaggaagagaggaaggctcttttggtccttctgccatcctcccctcaaacagttactggcccctaaagctgagtggacatcagcaaactgtgcctcttattcccaggatcagtggcccctctggacatgcctctcctggaaggttctgtgggggtggaggatcttgtcctcctggaacccttggtggaggagtcactgctcaagaatcttcagcttcgctatgaaaacaaggagatttatgtgagtg

SEQ ID NO: 69853 - DNA, 1051 bp, Homo sapiens
tttacataacaatataatttgccagttttaagtgtacaaatttgctgagttttgacaaatggagacagttgtataaccactaccacaatcaggatatagaccatttctgtaaccccaaaaagttccctcttgccccttccatggtctagaaatgttaatgggggaaaaaggaaggtgatttaggagtcaaagtagaggaagactaatacgctctggttgcttcagttttgcctagaaagcaggagattagaaaatcccagctgacttggatgtgtatttcatatcttgttaatttaggctgacccactggctccagtttgcctgggactttcctagttttaacactcaaattcccatgtccagagaaccccactgtgtcccacaggcggatcagtacagttggttgccctagctgtgatgttcatgtcattgttcttacacctgagagtgccatctcattttagagtcacttttctcgtgagtaagcacatagtaggcactcagttgactgaatgggtggacatgcaggtaaaccccagatggctgcagattcctggcctagagaacatgagacttgggttttggtgccagctctgccaggtttgcagtggtgtgaccctggaaaagtggttttctcactctagatctgtttcctccactggtaaataggtgatatttgtcacttctgcctctaggacatggatactgctccacctacacatagcattatgttttgatgtcacttccactcagctttctctcttttccttgcccccctccaccttcaaatatatgtagtagatcaataaattatgtaaaggcaggttgataatagaactgctgatgtgccaggcttacgcagagtgcttctgtgagagccatagagtttggaccttgcaccaagcagccatagctgagagttggagaatcaagtctctcttcagttaagtgtctataattacctaatttgttctttctgcatgcctgggagagaggatggtaggcagagggggcttgctgtttttaggaattttcctggctggatgaaggg

SEQ ID NO: 69854 - DNA, 2216 bp, Homo sapiens
tatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagatatattgtggtctttcttaatgaacataatattttcttgtttggatttcttgttttcaggtaatcagcaatttactcctcagtttcatctttctaatgagatggttttgcatgccactgatttccctttttttcttagccaccccttcctgtcccgagtctgtactggtctactttcatccttggactggatgatttcccaggatg

SEQ ID NO: 69855 - DNA, 1053 bp, Homo sapiens
acaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctc

SEQ ID NO: 69856 - DNA, 1215 bp, Homo sapiens
tatacctttctttacacaataaacatctttctgaaaagctgtaagttgactttattaatggaatcatattttaaatatacttggggaccttaagtaaaagactccgcagttaatttttttctccttcatttctgaatgaactgctgtagattttatttacaaagtaaaaatccttggtcatatagatagtaacctttgagttatcctttgaagggtgattaatctggatttctgtatattggttttttaaaatagtctatttcagggttgttcaacatgtacctttaatgttctgtttgaaccaaataaatttgggacagcagaaaggatagaaacttagagaaatatattctaagaaaaaagtgtgaaaaattaagtaaaaatctgatttcctagttcaattggtgctatatagtaaattaactactgcttcccacacaaattatttttaccaagtatagatgaaaaagaatgtcttctgataactcttctcataggttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcaggtgactgaaaggcaatgtaacttaatattgacaggtacattgtgggatgcagttgcagcaagaggatacagaggtgttgacctgggagcttctttgttaatgaaaagtcattgtattgtacttccacttttgttccttcccgagtctatttttttttttttactttctataggaatttttatatttttattctagtcattttatataaaatgtctagtaaaatgtcatgtgttcctgttaccacaaggtggtgcaaattctatcactgtttttttgagatggagtctcgctctgtcgcccaggctggagtgcagtggcgtgatctcggctcactgcaacctccacctcccgggttcaaacgattcttctgcctcagcctcctgagtagctgggattacaggcatgcgccaccacattcagctaatttttatatttttagtagggttccccatgttgaccaggctggtcttgaactcctgacctcaaatgtca

SEQ ID NO: 69857 - DNA, 1032 bp, Homo sapiens
ttataaccaacatttactcataatcagtggcttgtgacaatggattgaactcagcctgtcattacggaaaacatttttagttttctggggcagtttatgcctggcaattttcttaatattatagacctttgctttgtgtgatctctaataaatagctgtattgataactctttcagtttggaagtcttttttccctctatgttctgccctaatagtagattcagatcatgttaacaagaaggtattctaacagctgtctctctgtaacatgtgcagtgttatttgcccaattatgttttagccactgtatttctatatttctgataagctttgtggaaaactggcaccattactgatttggttgttagtctgagggttttttaaaaaattgtatttgtgaaaaattaaaattcctacttccttttttctcatcctgattttatttgtgttacagatccgagtaaatagttccagattggttcgagtcacccaggtggagaatgaggagaaactgaaggagctagagcagtttagtatctggaactttttttcctcctttttaaaagagaaattgaatgacacctatgttaacgtgggtctatacagcacaaaaacctgcctcaaagttgagattatagagaaggacaccaagtacagtgtcattgtgatccggagtaagtctcacctctgtttttctgatggattctgtagtgataaggactgagttctgaagggtataattagtgagactgagaagtcagcctaagacagctccagttgggttctgattataaccctgagtataccactgctctaaacagttcatggagacttcacccctatcagacaggcctagaattgaaactccacctcaggaaattctgagtacctccttacctggaactgtgaagacttttattcttttattcccaattacattgtgctgctaatgtccctgagcatatatgccaaatactcttagagtaaatcagatagacgtgttctaccttctggacacttctagacaaaggt

SEQ ID NO: 69858 - DNA, 1051 bp, Homo sapiens
tgtgtgtgcacgcacacatacccctctttctttttttatttttattttttattttttgaggcagagtctccctctgtcgcccaggctggagtgcagtggcaccatcttggctcactgcaatctctgcctcccgggttcaagcgattctcctgcctcagcctcccaagtagctgggattacaggcatacgccaccacacctgaccaatttttttgtattttttgtagagatggggtttcatcatgttggccaggctggtctgaaactcctgccctcaggtgatctgcccaccttggcctcccaaggtgttgggattataggcatgagctatcgcacccagcccccttctttctttttaaaggccttatgccttctttgggctggaaactgttatgtgcctgtgaggatgtaaactcttttgccccactgttcctattctgattctatatgagatatttcataaacccccgagctgaagaattactttggtctcatttatttcataacactgttaagtcacctggcaaacaggaatgtctggctgtaacagtgattgtacaaaataggtcctttcagaaatgtcgtagttgttataagcatagttactgataaggacatttgttgttcacatcaaaaacataagggtggacttgtggatttgttttttttttttgagacggagtctcgctcagtcacccaggctggagtgcagtggcacgacctcggctccctgcaacctctgcctcttgagtagctgggggccatgcccagccaacttgtggatttttaaaaaaaattctttaaaaaaaatgtctgacaagccgggcgcagtggctcatgcctgtaatctcagcactttgggaggctgaggcgggcaaatcacttgaggtcaggagttcgagaccagcctggccaatatggtgaaaccccgtctctactaaaaatacaaaaattaactgggcatggtggcgcacaccctgtagtcccagctactcaggaggctgaggcagaagaatcgcttgaatccaggaggtggcggttgcagtgagctg

SEQ ID NO: 69859 - DNA, 1034 bp, Homo sapiens
gtcctatcagggtcctactcataaagcgatctcaattgtaggcgtctcataacagaaaggtcgtgataaaaagtaaccgaaagaaaacggaaggaacttcagacagcttctatggaaataccgagtttggtcaaggaggcctctcccattccgattttctattggttaaacttaccatcaatcacaccagttgtaaataaactgaagacggaagcatgttgttagcggggtgggatcttcctgtcgccactgctagggtgagaacccattttccaataggctgaaagctgcttttcccgccctctctcttcagttgctaaggggcgggactcatagggcccttggagggctgggtgctcgaagccctgcccatcccattggttgataggggcgggtttcgtagaggataggctgctgtcgttgcccgttcggagttagttgctggggtaaggcacgtgaggaggaggtggcttgaggcaaccatggcgggaggaatgaaagtggcggtctcgccggcagttggtcccgggccctggggctcgggagtcgggggcggtgggacagtgcggctactcttgatcctctccggctgcttggtctacggcacaggtaccgcccgggcagcagctgccaagggggcaggtgccgagggggttatttttggaaaagggattgtcccgagggcgcgggccgttactctgcagaagggcggtggctctaccgagggccgccggcgtagtgtggtggaagaaacttggcaggctagtgggcgtcgggactgagggtctgggccctgaagcgggctggggcagcttccagagtggggaggagcctgaagccttttggcggagacaggaagggaggcctagactggttgagaagcagtcctgggggctgtgtctcgttgcagaagccttgagtttcttggttaaaagcgagaaaacctggggaccattctgggcaggcagagcagccgcgggaaagggaccatctcattcattcggcaaatcagcaaacaccatctgagcgtatgc

SEQ ID NO: 69860 - DNA, 1032 bp, Homo sapiens
ctgactggaagggaagttcaggctctgagacacaccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatgtatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgctcagataggtgctgcggtccagcccccagctggaggagaccctgagtccaacccaggcctcccgagggggc

SEQ ID NO: 69861 - DNA, 1037 bp, Homo sapiens
cctcggcctcccaaagcgttaggattacaggcgtgagtcactctgcctggccttgattataatcttatgggaccactgtggtctgtagttgacagaaatgtcgttaatgtggtgcatgactgttattattattttctgtcctgcccctgagagccactgtcacttctctgctgtattggtttttgtttactcatctgttttggccttgaaatggcctagacatttttcttcccgaagtatgacactcgggtgcttattaacttagtcaagacacaacatctcccttcccagaaggtgaggcgggagtgaggacttggggacttaagaactaccaaagttcagagtccaaagaaacattagaaattggctaatccacccccataacacgcacattttacagatgagaagactgagctcagagcatagaaatagcttgcccaggccatgactaagtcaggataaggagctggagcttgtttcctcactcagtggtcctgactttgcaccactctgcatttgcctagcctgccttcctctaactgtgctctccctacttccaggcctcacctgcagatgccccccagcctgggccagatgagcctgccctttgaccagcctcacccccagtgagtgacaaagcccctcctgaccccatgtgcctcttctttcctggccttgccccgctctccttatttccattgctggttcctggcaggggcctgctgccgtgccagcctcaggagcatgctgtgtccagccctgaccccctgctctgctcagatgtgaccatggtggaagacagctgcctgagccagccagtgacagcgtttcctcagggcacttggtgagtggcagcttgggagtggaggctgggtggcatctaggggagtgggcgccatgcctactccactgcttctcccatctccttgcaggattggtgaagacatattccctcctctgctgcctcccactgaacaggacctcactaagcttctcctggaggggcaaggggagtcggggggagggtccttgggggc

SEQ ID NO: 69862 - DNA, 1831 bp, Homo sapiens
ctgtaagatggaattattataatccctacttccatagcctggtaaagagcaaataaatatatggaaaggcttgaaatagtggctggcacgtgtaagcattaggattggtcgttgtcattgatggagtctcaggttcggtctgatcctcagccctgtgattctgtcgtgagggcactcacagctcactgcctgccctaaacaggctccagctctggccctccctcggctcacacctttccccctctccccctaggagatcctgctgggccgtggcttcaccttttggcagtggtttgatggtgtcctggacctcaccaaacgctgtctccggagctactggtctgaccggtgagtccccaccctgggtagtctgagcagccatacaccagtcacctccatactcactgcccatgccccatcctctccttcatcccggccaggctgatcattggcttcatcagcaaacagtacgttactagccttcttctcaatgagcccgacggaacctttctcctccgcttcagcgactcagagattgggggcatcaccattgcccatgtcatccggggccaggatggtgaggccaccccagccagtcctctgtctctgtgcctgtgccctctggggtttcttctgggaatgaaatgtcctgaccttcctgatgccgatcctgatcttcaggaagttcttccagcttctcttcttccttctgtggtctaaatgttcaccttctcactgtgagctctgtgggaacggagactagtgggtctctctccctcaggagccccaccctaggtcctctctcccttgccttggtggagtgagaacaggtcttatggtaggggttggggaaggggaagaaagtccggacagagggatctcagggtctccttcctaccataggctctccacagatagagaacatccagccattctctgccaaagacctgtccattcgctcactgggggaccgaatccgggatcttgctcagctcaaaaatctctatcccaagaagcccaaggatgaggctttccggagccactacaagcgtgagctggaactggcagctctgattccttcctgtcacccacttcctccctgctccccgctgccctcctctccctgcccgcgtgtcatcctgatgtcactccctatttcatagctgtgcttctcttacttccccatgatccatgcccaccttttccacctcccttcctccctaaccccagagcactccatggctgtcttttccttctcacaacagctgaacagatgggtaaggatggcaggggttatgtcccagctaccatcaagatgaccgtggaaaggtgagtgtggtggtatggacagtgggtaggtcaggggcttagtgcttatctgcaggaaggaggggtggcatcaacccttggtcagtcacatgtacctccttccctcctccagggaccaaccacttcctaccccagagctccagatgcctaccatggtgccttcttatgaccttggaatggcccctgattcctccatgagcatgcagcttggcccagatatggtgtaaggagctggaaagacaggaatgggagtggtctgtgcagatgggctaatcttagcatgggcagctgggagagctggcactgggggctgaacagggaatcttcctttccatgagagggacacctgttcaaaagcagggtgtggtggtgtccaggagaagggctggcatcagggggtctgttttctttccccaggccccaggtgtacccaccacactctcactccatccccccgtatcaaggcctctccccagaagaatcagtcaacgtgttgtcagcc

SEQ ID NO: 69863 - DNA, 1028 bp, Homo sapiens
ccacgcgggcggacaagctccggcgtgtcccctcgggtgtccctgtttactccgagcccgggagcgaggtgggggcgggtcctcgcggtccctccccaaccccgccccctccttcgcaggccccaatcccagtccggtcttccaaagtctccaaatcaaagctcagcctttccctgcaccttccccgcggactggcggtccctgtccccaccccgggcagaggaggcaccttcagggttcccctagaaaatcgagcctcggcccagaccactgagtcccggacgcccccggagggagcctgaaatcctagagtatgacactgagtttcaaaggggagccgctcagctctccgcccactgcccaatcccaccctcgaccccttctgctctctggagcaccagggaggagggcccagccaggggagagggcgccccaggccccaaactagccagcgagtccccgggaccctcactcttggaccgctttccagaactccgaaccctgtcgcgggtccgcgtcgccctcccccgggcagcgcgtcaaatcggcgcatgcgcactcactggattgccgcgtagctctttctccccccacccaccaaccttttttctttccccgccccttccctccctccctcctcaacccgtcccctccctctcccccatcagcccccccctcggcacttcagtccggggaacagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctt

SEQ ID NO: 69864 - DNA, 1025 bp, Homo sapiens
tagtaggagttagaggaagacaaagagaaaacatgtcaaggcctaaatgcaccccccttcaccatcactctgtcatcaaagccagggggtgctggtgtctgatgagagtaaccaagaatagcaaaggctttgaccctgactcccaggaacaggcagcctagaggacttggaggggtgcagtaaaatgtgcttctggatcctccccacccccaccgcagatacacagtgtctaggaactacccaaagccaccccctgacacccccaggcacatagaccatggctgagggtctgggccagatggagactgatgctagggaaggaagagcagtactaggggactttgggttcacagagttggcctccatccttcatttatatccccttttctttccttgccctagcccctaagacttgcagccccaagcagtttgcctgcagagatcaaataacctgtatctcaaagggctggcggtgcgacggtgagagggactgcccagacggatctgacgaggcccctgagatttgtaagtaccttttctggattcttctccccaaacccttaacttatccctcttcctttggcagatgtttgggaggaggacagctgatccctagcctgatgtggaccttgctcagtgattgtatttgtccatgacacagctaaaactgtcctttacaccccttcaaaatgcttggcatggtgcctgttgggcttagaaatggcacctcagatttctccctcaagtgctgcaccccaagacagtgttctctgggctgacagctttgctagaagatggcccggcctccctttccttccagctcttcccttattccacctctcagcctccctgacccttgatgattggccccaggtcttgtcggatcctcagatcttcctctgtcctttggctcccaggccagaggccactggcacttgctcagccccataccagaagccccacccctgtgctcttcccgctacccccgccttcccctgcccccagtaagtggtgtaatcggaggc

SEQ ID NO: 69865 - DNA, 1009 bp, Homo sapiens
aggtgcatgccaccatgcctggctaattttttgcatttttagtagagacggggtttcaccatgttggccaggctcatcttgaactcctgacctcaagtgatctgcccgcctcagcctcccaaagtgctaggattataggtgtgagccatcactcccggcatcatcaaaaccttttactgacctcagtcgtcatcaaaaaccaggctgtcttcagcctgtctcctgagcatagaatgttgaggcactggggtccatgggaatggggcatttggagggtggactctactgaaggcctagtttctacctccacctgtttgcctacaggtgtgtggctactgtggggaatattgtaaaagagttccaggtggaagagtctaactagccccgaggcctcctgagatctgaaaccccagttttatctcccctcatccccagtgaacagctgaccagagagccaccatagccagcttgttcatgcccacccttctgtctgccctcaggtccacagagtaaggcccagcgatgccagccaaacgagcataactgcctgggtactgagctgtgtgttcccatgtcccgcctctgcaatggggtccaggactgcatggacggctcagatgaggggccccactgccgaggtaaggacttttccactctctactctcccgtctggatgcagcatattatcagcccaccttccgaggactgtcctggcaccttcagtggggatgaggccttgtcctggtcccctgcctagatttaccttcagagagcagatgaaattgatgtgccccttgggcctggagcttggtcagacagccctgtgggcctcagccgtgggctgtagcctgggcacttccctctggctatgtgttcttggactagtcactacctctctccaggtggcagtttttcttctgtaagatgagagatcagtgttttcatacttttttaaaaatagtatgatcctttcttcaaaaggttttctgcatgaaacctgagtgtgaac

SEQ ID NO: 69866 - DNA, 1054 bp, Homo sapiens
aagaaaagtaagttaattgaaataactggtaataaacagtagcgcaagctgtacataagcatggtagacattttgaaagtgatacacaaaagactaaagttctgaaaattgaggcccagagggatcaacaggcctgatagtcccttagtcaggaaccaggcctgcgcactctcacccccacctctgaccagtctctcagctccagaggcctatggagcctgtaacccagctttgtccagcctcctgccaggctgcccctgggcaggcctggtggtgcagtctaccgaccccagcccagccctgcatttcctaagctgagctcctctgatctgtattcccttcaccttggaggatgccaccactgtagaaagaatgaggcagactgcaagattggggtcctgggaacatgggtgtgtatggtgaggggaggttctgaggttgtaaatagaggccttgaaggaaatcgggtttgctgaagtcactcaggagtttggactgtgtgtgaaaggatggtctgaaggggctctcagaggtctcagggttcccctccctgcaccatgctgcatggggaagaaggaggtggctggggagctcagcaaagggcccctaggctgcaggcagcaaggttgcgaaatgggtcccaggtccagctggccaacttcacttttcccttcctctccctttcttttatttatttatttttttagtgtgtgtgttttcgaaatcacaacaggaaatggggtagtgatttgtctagaggggaggcaaagaaggggcagacagcagtccctctgagtctaatgaactggctgctgctgctggaaggggtgctacctccccactgtgctgggcacccctggaccctctcagcctcccaccctgcctacaaagcacttccagacttcacatgtgaaagctaaccatgcccatccttggcctttctgacccatgggatgccaggctgtttggggaggggtggctctagccaccccactctttggccttaggccccctgcatcctggcacttttgcttcccattcctgttctgagttt

SEQ ID NO: 69867 - DNA, 1445 bp, Homo sapiens
actttaaaaatttatgccatatgtccagcttccagtcagtgcttctggttagcatgagataactagatttactgtagatggtagataaaagtccagtgaaaagcaaagatgtgtaatgttttggtagcctcagtgctcttatcccaagtaaaagcaaagttaaaaaaaaaaaaaaactggactgagctagtggacctgtgctctctaccttttggtgccccaagaagatggtcccttttcaaggatgggctagaattgggaagtctgtcagtcaaccagccagccagcatttacgcaagccctcctgtatatccactctgagctaagcatgggggtgttgggtgggagggcgtccagagaaggtgggcttccaggtgtgggttctcaccagcaaagggtgggcatctctgcaagagggcctaccccaccccatggctctttcattcgtactctccagacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggtgagagtggcaggcggggttctggccctggaaggtgggaggctgaggctacagtggtaaggagggtgcccaatgtccagaccccatttaacatgcatcttcccacaggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctggtgagggagctactgtctgaggttttgtgggggaaccatgatccagggccttctggtgaggggggaagcctctgtaggggaaccgttctctgagtctcctggtaaagagcgtggatgccccaggcctctagtgggagtggggtgggcttgaatactgcagagaaaggacaagatacgggttccactgtgatgggaacagtcattttagaaacaccacttctgtttacttcctgtttctcatttgacccttataataacccctagctgatgaacagggaggtggttcagttccctttcagcagatgaaaaagcaggatcaaagaggttaggtgatttgcctgtgtttacaaagccgggtgatagcactggaacttgttctagaagccttgctggctcagaggtggcatctccattgtgggataattagtgtgagcaaccagcccagtttgcctaggactgtcccagttttagccctgaaagtctggtaagccagc

SEQ ID NO: 69868 - DNA, 1031 bp, Homo sapiens
aaagtaactcatcaggaaaagattaggggtccctataccaagggaactgctatttaaaggacacttggagtgaaggctttggctaagtgaaaaatcacttcctaatttattcattttgttagttcaggatttttaggcctaggatatgatgtcacacttgtgcccagagccacatgcccgttgtttcagctctccatgcaggcacgggccagatgccctcacacgagagcccacatcagccatgtagtttaccatctgccacgtgtggttttgagaggctagccctgatacaaatggcagcacacagggctttcccctattccttttccagcctcctgtccctacccccacccatctgtctagggccccagagggtccctgcacccctctgtagcccagactgctcaaaggtacctgagtccgggagggccagaggcaggcagctttgaacttcctttgaagctgttcatcactggtccctcttcccccaacaggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtgagtcctcccaggccttggggtgggaggagctgggagtgtgtgggcctcagataactggaggatgaaatggacagggaagcaggggaaggcaggtgaggcgggatactttagcaggaatgagagtctgcaaggggagaaggagtccctgtcttcagggaaatgggagtgattccttaaacatagaagaaatctgatcctgtcactcccagttcagggccttccaccagctccccttaccctgagaatgaggcccacgttcttgtcaggcctgcacagccccacagtgtctgcctggcccttgtctgacctcatctgcatcccgcttcccacacttgaagttctgtccccactgc

SEQ ID NO: 69869 - DNA, 1320 bp, Homo sapiens
tcaggtgtggagcggggctcagatcacacgaggcacccctcagtcaaggaggcaggggagacgagggggccaggttcagtggctcatgcctataatctcagcactttgggaggccaaggtgagaggatcacttgagcccaggagctcaagaccagcctggccaacatagtgagacctcccactctttacaaaaaaaatttaaaaaaactgccgggcgtggtggcgtgcacctctagtcccagctacttgagaggctgaggtgggaggatcacttgagcctgggaggttgaggctgcagtgagccatggtcatgccactgctctccagcctagacaacagagcgagacctgtctctaaaaataaaatgaaaggagcaaaagaatttagggcagaggggatggagccctgagcaggagtggggtctgctatccccttcccagcctgggaaactgagagggctgagcttgcaggggacagagcatagctctagactggagaggaggaacaaggcagggtagatctcctcctgggaggataccagagaccccttgagagaaagagtaaagcatccagtgagaccagagagatggttttgaattctctaagagaaatggttttggatccttggaaataagggacaccaaaggcagagaataatagggaagaagaggcagtgaagagagggtcaggacaatgagtactcacacccatccctgccccccagcccgcacctgcccccccaaccagttctcctgtgccagtggccgctgcatccccatctcctggacgtgtgatctggatgacgactgtggggaccgctctgatgagtctgcttcgtgtggtaagagggatgggcagagggagtcaggctgggcctgggggaggggcatcctgagagcatgccagttgggggtgccggagacacctgcaacccagcacttgggtggccttgagtgagttaatctcggtggcctctgtgagaggagagccccatcatcacagcattgtgtctcagcaaactcatgcaggaaaagcactcagcacaggtcctgtgtctgctgactcatggggatgagtgagtggagtttccagccgaggcactgctgcggggccttccccacccttcctgactgggctaagggctgctggttatgggagggccgctgcactcacctgcccagtactgtgatgctgtgtaatcgtgaaggccctactcagctactctttcttcctcacagcctatcccacctgcttccccctgactcagtttacctgcaacaatggcagatgtatcaacatcaactggagatgcgacaatgg

SEQ ID NO: 69870 - DNA, 1048 bp, Homo sapiens
gtattcagcagtgccagcctcagggcaggcctgtaaagcttgtctcaagccggccacgcctgcaccccacctacctctctccctccaaaactagagaaacccctgcctttcccccaaaagcaagcagacccctgttcccacacctgccagaaaggggaaatgaaatgtttaatgttccctgcacccagcctttctgagcttcagtgaggggccctccaggagccttctcctcctcctcatcctgaccacgtgggccatggtgcatgctgcagtctatgcagtttctgtgtcttttctgtttgttattttcccagtgggggggttagggtgggctgagggtgggttctgggcagggggcccaagctgggatcacagagaaggctgctccaccaactcccgctttgcctctccccttcttcccccaccgccagacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccagggtgggcaccaggggcccgtggggtggggatgagatcgagccccctgcatcagacacccagcctatccatctgtctttcagacccacggtgtgtcggccaccatctgggagccagaggtagcctaggcatggctcttgtccttcaggagctcccggtcctgtgggagagggaggttgccgaaaaatcattgccacacgctgttaatatcatgcgctttgcagttggtggccttgggtttgagctccagctctgcagcttattatctgggtggccttgagcaagttacttaatctccatgggcctctgtgagtttcgtctgcaaagtggggtaataatagcaccaacatcacagcgctgatgtgggagtttagtgagatcacgcacgaaaagtgctcagcacacggcctgtgtttggtaaatagtagcttgagaaaaggatgctgcaggca

SEQ ID NO: 69871 - DNA, 1052 bp, Homo sapiens
aacctaagctccatgagggtagggactttgtctggttcagtgctggccccaggacagcgcctggcacacaggaggcactcagtaaacatttgtggcatgaatgaatgaaatagaggctaaggaggtgggcatttgggctcaggccttagcaaattgcttctccagctgagatctccggtgtcaatggggggattagatgaggtgattgtggggcccttggaggtgtgatgcctcctgactctactactgagttggtgcttccaaggagtgtcagcaaagcttggcagactctccaggcctgcctctgctcatatccccaggctgggcttaccggggtggcagggcacagggatgaggagggctgacctgggcaacccctccctcctgaggccctccactgtccctctgcagccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcaggtgaagaggatggttggagggcgtctggaacagcacaatgtgggcaggaggagaccgtgttgagagcagagtagcggcaaaggggatggcactgtgctgtgtggagtggtgctggggacagtgcaaggcaaaaggcagtccagaggaagcttgtgtgtcatgggtgggggaaggcatgaagggccagagcctgcacagaggacctgagaagccaaaaccctaccagagttgagcttcagcacctcctgctgcagattcctgccttgtttgttgcctatgtgaatttgacccaaaaagcctcggggttcctcgtggaccccacagcgttgcaatcctgaccctattagagaagcccacagggtctggaaggaagggcagggggagccccagtccccgggcctgggccctcatagtgcacctgtccctcagctcggtgcatcagcaaagcgtgggtgtgt

SEQ ID NO: 69872 - DNA, 2414 bp, Homo sapiens
gagacagagtctcgctccgtcgcccaggctggagtgcagtggcgcgatctcggctcactgcaggctccgccccccggggttcacgctgagggtgcctttttctgactttcatcaaagccctgagtgctgacagcagccctggggagaagtgaccgaaagattcccttggggcttgggaatcggggcctgagaggtgaaacctggacctgttgggttctcacaccttggtccttctgtctgtctgctctggccagcaaggcttaggggagggaatggtcccatgctcttcgctgggagggctgtggccagggcccagagggtgggcacctgggcagagctctgagggctgagatcccagctggcatcctcattctgctccatcatgctcttaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatgggtaaggggctcggggcctcgagcagccggaagggagccagcagcctctttagaagctgtagaagctcttaggagaggagagggcagtgagaacaggagcaagtctgtgctgggatggcaggggtaggccggctgttgacagaggcactgtctagcagcagagaagggtctagtagtagcggctgctggaacagggggaggagagtgggcgaggaaggggtggtccatgtagggagcagcaagtcacaggatgctctggcttcttctcttctccaccctgcccccagctcccaatccctgtgaggccaatgggggccagggcccctgctcccacctgtgtctcatcaactacaaccggaccgtgtcctgcgcctgcccccacctcatgaagctccacaaggacaacaccacctgctatggtaggagcccctccctccagagccagtgagcaactgaggctggagggaaggccgcaggccccaggatcccggttgtcagctaaggcagagtcccagtcgggagggtcccgataggagaggctccagagacagccactgtgagaaggggctgcaggtctgccaggggggctgcacccagcggggtatgtccacggagccaagggccagtagcaaacagacggatccagaagaaggcagggcctgaaaccggattggtgggaagcacagaggcagggactgccttcagtgaccagcccatgccccacagagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcaggttcttcctggccctggatgcccaccagtggacatgggcacctccacccgccccttgctcccaaccctggtctacttggtccgagtggtccttctcccagtcctgttccccctcagtgctccagcctggtttcctgatcccttttctccagaaggcacactggctcccctcctgacccactgccctgcagacacccaacaactgactccctacttgtgcccccagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggtcagtctagggcccagggccggggagcatggggtgtggggctgggaagaagaggaccctgacctttccctcttggcaccctccccccaggaagctctactggaccgatggtgacaacatcagcatggccaacatggatggcagcaatcgcaccctgctcttcagtggccagaagggccccgtgggtacgagcttccctgcccacccccacagcccctccctaattccttgaccagcaggtgcttgcagggtccttcagttgcccctcagcctccccagagccctagcttagtgcctgttctcaccatctgctcccttccctggatccccagccctgggccagactccccggcagtgactcccccttttccaggcctggctattgacttccctgaaagcaaactctactggatcagctccggga

SEQ ID NO: 69873 - DNA, 1069 bp, Homo sapiens
gccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgagtctgcggggtgggtgagctggcgggcggctgaggggaggccagggccagggtcagccgtcaaccaagaccgtccaggcacagacatggtgggaacagctgggaggaggtgagtgcctccaggccccagcctcggtcaaccccaccctgtccagcttgctcctcatcagctagacgagggagatagcaggatgcctctgcgggccctcattctgtagctgtcagaggccaggccaggctgtggtccggtggagactgggcaagaggcctgagcgatgctgtgacggtgatggtgctgtctccacaggtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgagtggggctgccgccagctgcctcaccctcctgcctgtcgtgcatggacatacaaacacacaccccacacacacatcgcacataccacacgcaccctacacataccacacacacacatcccacacatactacactacacacaccacaccacatacacacaccacacccctcccacacactcaacacatacacaccacaccatacacaccccccacacaccacatacacatacacccccaacacatacacacacatacacaccccacatacacacaccacacatatcacatgcacaccccacatataccacaccacacacataccacacacacaccacacaccacatacacaccacacataccacacacaccccacacataccacatacacacaccaccacacacactacacataccacacac

SEQ ID NO: 69874 - DNA, 1038 bp, Homo sapiens
tgcccctaccctcaccctggtcactctcctcacttggagccacacagacagccgagagcctgggtgcacgtgccctcagtgggcacgagtacatgccccagcgccccccaccacagacctgcagctttcccaggtgtctcccatgcgccctggggctcactactgcacccgtgatctcagggccctcagactcgaatctctcagaaacactcctcaaagcccacggtgccctgcctaaaagcacacacatcctcaacggcacacctgccgaaaaccccatgcacctggccctcccacagcagccatccccatgccctccccactggctgcaagccgctgtgcctgccgtgactgagcagaggcttgggagctccatgaagtcagtgaatgggtgggtgcactctgggtgcatgcacagcagagaacactctccagccctgcgcccaccctgtccctgctcaggtgaactctctccatgccgaatcaacaacggtggctgccaggacctgtgtctgctcactcaccagggccatgtcaactgctcatgccgagggggccgaatcctccaggatgacctcacctgccgaggtgagagaggcgggggggaggggctggcggggaacccaagcacacaccagggatggtgaccatctcccctacatgctccagcccagccccccaaagccttttgccaagaagacgctgatgatgacctcagctccccgggggaggaggcgtgggcactggggcccacagcgctggctcagaaagctccctccacctccctccccagcggtgaattcctcttgccgagcacaagatgagtttgagtgtgccaatggcgagtgcatcaacttcagcctgacctgcgacggcgtcccccactgcaaggacaagtccgatgagaagccatcctactgcagtaaggagccccctgcagcccctgcctcttccaggcccagagcccaggtcctcctcccccaggcccctgcaggatggagcaggatcaggacccagcttcctgaccatgagttttgg

SEQ ID NO: 69875 - DNA, 2803 bp, Homo sapiens
gggacgggacctgcatcgggaactccagccgctgcaaccagtttgtggattgtgaggacgcctcagatgagatgaactgcagtgagtgacgccctttgctggcacctcctgggctcctccccatcgctcactgcatctcccgccttcaggccctcctgcacctgcccacattcctctctgccttccctcatccccgctgacagcctccatctccctgaggccctgtccccatcccgctcctgctcctgggctctcgtggggttccgagagggggcagtgagcagatggtgcagacagtgccccaccagaagggcaccgttcaacttttggaaacacatgaaggctccatagggctggcagctgccccagtcgggggtgatccagggggaaccaggtatcaccctcacccctgcccccaccaggtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgggcgggggcaggtgtgtggtgggtggtggcctgcggtgagcagggccctcacacctgcctcgccccccaggtgtgaaacgccccagatgccctctgaattacttcgcctgccctagtgggcgctgcatccccatgagctggacgtgtgacaaagaggatgactgtgaacatggcgaggacgagacccactgcagtgagtgaccactgcacccactcagtgctccaagagcctgctgggccccacttcttagtcccccccagcaaatgcccccttggaaaagggcatccagagccttcaaccccctgccccacaccccaactcttgaggtcagactcagagactctgcctctagctgctgctgagcccccccacagaggggtgctgtgggcatctctcctgtccttcccatggcatcagcctccccaggtgggtgacccccacccttccccatctaactgtggcttctgactgccccagacaagttctgctcagaggcccagtttgagtgccagaaccatcgctgcatctccaagcagtggctgtgtgacggcagcgatgactgtggggatggctcagacgaggctgctcactgtggtaaggaagctgggattgggccgggggaggtgccccagggagggacagaccccacccaactccaccccacacacagacacccctgcagacgacggcgaaccatcacctccactgctagacctgatctacccgctcctaagtctctcagtggccctctctccccctacagaaggcaagacgtgcggcccctcctccttctcctgccctggcacccacgtgtgcgtccccgagcgctggctctgtgacggtgacaaagactgtgctgatggtgcagacgagagcatcgcagctggttgctgtgagtggcggggccacgtggagcgggtggacagcaaatggccacagtctcactttgcagatggggaagccggggtgcaggagaggaaatgcctcagcggggtccactgggggcggagccatagctgtagcccaggtgtccagactcctcatccagtgccctgcccactctaccaggagaaccacaggaggttagagtgagggacggtcggccgctggccaggcagggctgaagggctgtgtccacctctgtccacagtgtacaacagcacttgtgacgaccgtgagttcatgtgccagaaccgccagtgcatccccaagcacttcgtgtgtgaccacgaccgtgactgtgcagatggctctgatgagtcccccgagtgtggtgagccttcggcggtggtgggaggaggccctgccctctgccgggccagggcatcagcctcacaggtccattcctcccccagagtacccgacctgcggccccagtgagttccgctgtgccaatgggcgctgtctgagctcccgccagtgggagtgtgatggcgagaatgactgccacgaccagagtgacgaggctcccaagaacccacactgcaccagccaaggtgggccccagacctggctcccctctgccccctccccagactgcctgagaccccgctgacctgccgcctccgcccctccgcagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaaggtatgcccagccctggggaggagcttccacaccccagacgtgccaggaacgcctttctccactgccttattcattcattcatcccctagacagtggggatacagcagtgaatgagacagaaatctgcttggttggggtctgcctctatctggcaggtagagagccagcagatttgctgacagatgagatatgcagtgtgagaggaagagaggagtgaggcatcaagtaggcaagagatacacaggtctggagttcaaggagaggcccaggctggagagggaagtctgggagttatcaccatagagatgctatttgaatctgtgagcctggatatgattcccaagggagcagtgtaggtggagaagagaggagtccaaagtctgagccccgagctgagcaacagccaggagcagggaagtgaggggaccagcagaagagcctgagaaggagcagctgc

SEQ ID NO: 69876 - DNA, 2009 bp, Homo sapiens
ggacgagtgcagcaccaccttcccctgcagccagcgctgcatcaacactcatggcagctataagtgtctgtgtgtggagggctatgcaccccgcggcggcgacccccacagctgcaaggctgtgactggtgagatgcgcgcttggagggcatgaggtgacccaggctgtgtgggactgcccgggtggcagagctccagacaggcaggagaccagggccgctagaatgtgccaggagctgaggcaagatcctctgtctgcagacgaggaaccgtttctgatcttcgccaaccggtactacctgcgcaagctcaacctggacgggtccaactacacgttacttaagcaggtaccaaacccaggccctcctccccgctgcccatctcccagacccagcacagcctcccttgcaagtctccccgcttaggtccaaccatccctcccccagatgcaaatgtggcccctgttgccacaaccgacttctgctgtccttcactccccaaatccagggcctgaacaacgccgttgccttggattttgactaccgagagcagatgatctactggacagatgtgaccacccagggcagcatgatccgaaggatgcaccttaacgggagcaatgtgcaggtgaggcgggcggccctcggcgaccaacactggcccgcctcagatgactgttttcagatcgtctctccttcccgccccaccaacccaaattgcttccttctcactccactagtcactatatgactgcttgttctagctgctcactctcctctgggcccagacagcaaggactgggagattcctcttgcccttcccctcgctgccagcctcatgtctccttaatcatcaggaagttccctgtgaggtctggccaagcactgtgaggcttggggcgtggtcccattcacctagagccccctctcctagagcctctgctgacacctacacagtgtcaggcccaggactgggcattttacttccatggttctcccaccagagctgtcagagggagctctaccccattttacacgaggggaggctgagcctcacagaggcttgcaggtcctcccccaggtcacccagagctctccctcccctgccccttcctgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtatgtggctgaggagggttgggggagcccctgaaagcagcatccaagcccagcctccctgcaggccactggtgcgatgggttacgggatctcccagggctcactgcctacccatcgccaggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttggtcagtgtgccagtgaggctgtccaggcacagcagactcagtggggatggaggtctgaagcgacaggggatcaagttttgggggcaagagtggacataaaaagcggaggatatggcctgaggacaccactcactggggtgtggggttcagagcaccccgggggcttccccagcctggccaccacccagctcccttgggaaggaagaggagaggcccttcccttgtatacacagttctggaggactggccccaaggagggtgggggtgggaggcctgcgattgagaactgcagtgctccccacttcccgaggggagccatacactggcagggcaggaacttgccatgaggcagtctaggtttgaactccagctctga

SEQ ID NO: 69877 - DNA, 1059 bp, Homo sapiens
gcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaa

SEQ ID NO: 69878 - DNA, 1316 bp, Homo sapiens
ggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggc

SEQ ID NO: 69879 - DNA, 1052 bp, Homo sapiens
tggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaa

SEQ ID NO: 69880 - DNA, 1050 bp, Homo sapiens
ccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagc

SEQ ID NO: 69881 - DNA, 1053 bp, Homo sapiens
cccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagc

SEQ ID NO: 69882 - DNA, 2733 bp, Homo sapiens
gctacagacgggaatcataaagaaaaaagcggtgagtgggcgaactacaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgatgctgtacttctctttgttttgggcggctcgggtaagaatggggctccaaacgctgggtaatcagtggaaaggaagctcttctcctaccttagttcctagtcacaaactctggggttctcttggcttttccatgcacgtggattggggcctcagggagcggacgtgtaactggggaatccccaagacccctgggcgcgcgtggagttaactgcgagcctgtcctcattctggcgatcagacgccccagggcctcgtgaccgcccatttcacgtggcattaggggagaggacagccccggatgccccgcggacccggtgctggcaaatgagcggagttttcggcctggtctcacaagctgagcctttccggccagctctgagccctgcagatgatgcaaccgagcttcactgcttgcatcaggcaggggtcccggcggcagtgagggctggaaggaggtggaacgggtagggggctaagtaaggggaaagggtattggcttactctcgggcagatccccacccccaccactcccacacagctcttcctcacggactgctaaaggtctcccctcccacctgcattgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggaggtgggggtagtgagaactgaaacaggctggctggacaactggcagcttggtgtggccttagaagcatgagtgagggtggccgggagacgatttgtctggactgttgtgatttcaccctgacttttcctgccttcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttgggacatttagggagcctccagggtccctacagtttcatctgatcccttccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccagtgagtatggatgggctggctgatggtcttggcggcaggattggtgtgggaaaggagttatttattgaatacctactgtggaccatacagatggaacaggccttgccctgtcctgcatgtcacagtggatgaggaagataagatcccagttatagtgcctaccacagagtggacagagcagtgaggcggtgtgtcctaggactggtgttctggggacagagaactgtggagttgaagggagtggttaagtccgggggtccttccacccaggccttcttacttcctctcacttcgcagtctcacccacggctacatgtctgacgtcaagcggatatcagccacgtccatcttcttcgagtctatgccctataagctc

SEQ ID NO: 69883 - DNA, 2333 bp, Homo sapiens
acctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctggcaggggatttgtggatgggattgaggggctgattccctctaccactggaatccagtgtaccaagcccacgtgagctgtgcccttggggcccaggtccgccagcttcctctgccttctctgtcccttgtccttcttttcagcttagactctgaccatccacctctcacacaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggttggggatcctgtctttgtagggtgtgggggggcaatggcctggaggcttagaccctgcaccttgctaactgatgctggggctgatggaagggaaatgccaggatggaaggagtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtaagccagcaggtgatgggtgagggcctctgtagcttcaggcagaggcccaggactcaccactccccatttcttacccaccttaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagacctggggtttgaggagggaaggggctcccatgctggatgactgccaggtgaccttgggctatgctcatccctccccttgtgcctcgttccaggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcccacggctgcttctgtttgatccctggggacagaggggagcaagggaggggagtggcagggggaggcccaggtgtggggctggagggggtactggcggcagcgggaggcagtaggcttgggcaggg

SEQ ID NO: 69884 - DNA, 1815 bp, Homo sapiens
ctgtcccttctttcctgtatctctgggctaggagaatagaaaggttcatttgtttttctcctagttgccctgatcagagctgggatggtggggaggggaagaaagggctaagagagaaaggccaggcttttgaagacattgtatacagacttagtcagctggacacttctctgctgggctgctgtcaagtccttcctgtcctattcctctcacaaccatgtcctctctcctccccttccagtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactggacatcagtcactgtttctctgttgccgccctggtatgggtaaagggttggaggccctgggtaggtatagccctacagctgttggaggtgtttgtcgtgggttgggatggctttctctagcatacgcacactattttaacaccattccctctgtctcatcctcttccctgtacacggttctgatagatggctagatctctaatgggaccatggctttgggctctcc

SEQ ID NO: 69885 - DNA, 1887 bp, Homo sapiens
cctacctgctcagcagtcgtgctactcatgtgaaatttcttctatgattattaaccttattgttccttccctttccctccccatctctgcccgcaccccccccccaccccaccccccgcttcccacctctcttttctcttcccttttccacatgcctctctgctggcccacagccagtcccggctctgcagccctctccgcagcctgttcagttctctccaagctcctgtccccaagtccttctgccagtctctccgccccagcagtacaacatggtataaactccattccccctttttgtcttgttcatgtgtggcctgtatctgtaggtatgtctgggtcagtctgtgatggccttgtaagcatgttgtgcttttggagggcatattgaaagctatttcttcttgagggaccagcacaggctgaactatactccatgctaatggcctcatcacagcacatcaaaagatgcttaaatgtaagacagaggaacactgtgttcccccaagtttcaggacagagaatgaaattggatgttggtataacctaggctcctcatctctacgatgtacatcctaaatctaatttgctccctaggcatgtctgaggaacctagtttcttctatacagaatggttctctataatttcctttaaaaataaaaacacaggccgggcgtggtggcacacacctgtagtcctagctacttgagaggctgaggcaggagaatcgcttgaacctgagaggctgaggttgcagtgagccgagatcgcaccaccactgcactccagcctggacaacagagcaagactccgtctcaaaaaaaaaaaaaaatgcagttgcagacttctctggtatcactggcaaaaacttaaactgttcccctgttttaccatgtcagtttatattttaaaaatcctcatccattgcgtagcacatgctgtttaaatcgtttgtactctacaaatcctttgaagatctgatttgcctcatagttgataacttccatcatagttgtaggagccctgaattgttttgctctgtcttaacatctactttttctctagaatcctctccctcctcctacctcttatttccatgttgattgtcctggaatatcgagttcaaaataatctgcagtccagttcacttgtcatctattcctgcccaataagtagcaaaacagctaacttgaagatcagatccttgaaaatggaatgaaactacagaaaagcattgtcttttggtttctgctagttgtgtgtgcgtgtgtgtgtgtgtgtgtgtgtgtattactgtccagggagcagaagggaaaaggaagctaacaaactctaacctatcaccatatgagtgagagatggaacaccatcacccttgctgcttaggaaagagagctgagagagaaggcaattacagcctggccagtcagtcttatcctccagcttagccactcactctgccctccttttggaggtgagaattggaagtagtttctgaagggcaggagaattctaggctagtgtcagagaacaaaggtggaaatgacctccagagggagtaaggagataagcagcaggagtgggagcccccagtcttgctgctgcataggcagagctgtgaaggcacatgaacctagctacccatgatccactcaaggtgttatctgggtcctttattataaaaacaggatttgtggcaatgtaggggcctttttatggttgggggcataaggaaaacaggaaatggaaagactctttaatctttttcgttaagccgctagtttgtcctgttttttctatatacagtaattgtgtcatagctcccatctcccaaggactaaccctaacaacaatcataggccaggcgcggtggctcacacctgtaa

SEQ ID NO: 69886 - DNA, 1020 bp, Homo sapiens
tttaaaaaatgtattgttattattattattttgagatagggtcttgcttatgttgcctaggctggtctcaaacttgtgggctcaagtgatcctccctccttggcctcctaaagtgctgagattacaggcatgagccaccatgcctggccattgtcattaaggtgactatgtttaaaagtcaccttaaggccaggcatggttgctcaagcctgtaatcccagcactttgggaggctgaggcgggtgaatcacctgaggtcaggagttcaagaccagcctgcccaacatggtgaaacccggtccctactaaaaatacaaaaattagccacgtatggtggcgggtgcctgtaatcccagctactagggaggctgaggcaggagaatcgcttgaacccatgaggcggaggttgcggcgagccgagatcgcgccactgctctctagcctgggcgacagagtaagaccctgtctcaaaaaaaaaaaaaaaaaaaaaagtcaccttaatactccgagcagagctgtgctgagatcttcacttactcccttctcacacgaatagagctctttttgaggagagccccatactttatcctgaagtattctctggtagctggaaagcccatgtgtctgcagtcttttctgctgtagtttacattctcatgttacctcccaggctccctcatccctctgcttattagtccagcttggccttagatatatttcttccctaggtgtaagaagcaagtcccaaacactaataccccatgaactagaaactagagtgcaaagaccccagaatggcccagtattgccctatctcaaatattgtgaaatgaagctgaaacaaagaacagtgaagatctaggaaatcctactttgtgtctaaatgtaatttgcatgcaagtcattgcagtcctctatcttagtctaagtcagttctttctatagtcctaactttcttgttctaccaccatctaccccagtaagtctcgttcacttcagtttaccttgctccctactgaa

SEQ ID NO: 69887 - DNA, 1059 bp, Homo sapiens
aaaaatgttcgtttctgcatcctcacctgaatagtaaaatccaaattacttaatatagcataacttcctgactccagtttgccattgctgtctaatttccagatctttccttctttccaaccatttctttctttcctttttttttttttgagatggagtcttgctcttgttacgcaatggcacgacctcggctcactgcaacctccgcctcccgggttcaagcgattctcctgcctcagcctttcgagtagctgtgatcacaggcacccgccaccacggccggctaattttttgtatttttagtagagatggggtttcaccacgttggccaggctggtctcaaactcctgatgtcaggtgatccacccacctaagcctcccaaagtgctgggattacaggcatgagccaccacacccaaccaaccatttcttgaatatggcattagctttgtttcctcttggtcttataagcatctgtcattcttcaaccccagctttcctgctgacccctctttaaatcctttcctgaccctcccaggagtttttgcttcctcatctttgctttcatgcaactttgtcgatatcactgatgtattccttatccttatcagattataattgtcatgtggatgtctatctcccatcagaagttcctgtgctgttggctgggcatggtggctcacacctgtaattctagcactctgggaggcagaggcaggcagatcacttgaggccaggagttcgaaaccagcctggccaacaaggcaaaaccccatctctaccaaagacatcaaaattagttgggcgtggtggtgggtgcctgtaatcccagctacttgggaggctgaggcagaagaatcgcttgaacctgggaggtggaggttgcagtgagccaagatcgtgccactgcattccagcctgggcgacagagtgagaccctgtctcaaaaaaagaaaaaagttcctgtgctgttaagggcaaggactgtgtttcactcatctttatgtctttagttcattatacagtgcttggcacatagtaaagtatgttgtgttgaat

SEQ ID NO: 69888 - DNA, 2084 bp, Homo sapiens
gttcttggttgcttaatgattaagaagcagtgagagctcaacaagacagggttttcaggccaacctggctatcttgaggcatacagctgttaataatcatagacagtgattataacatcaagataaccctgctgtttacagagccaaataagagagggagaacccctttccttaatagttttgcttagggagataggattatgaatatgaaggcaactaggcacagtcaacccccctgctcttcgccatcctgagtcccaagagcatatttgctgaagactttagcccttagagatcctgaaaccaattgttcgcagacagtaacatggaatttccacaaaacaggttggatcaatcctagactatcaaactgagttttccatagttagtgcccctttagttcactatactcttcttgcaactcctggaagggtggccataagcagcacctctgctggcttagacatgtgttatgtggaagacccattgtgggttttatccatgtcattggctcctgccttttagcaatagcaacttctaggagtccttttattttaagaactttcagaaggaactggtacccctctgttccccattattgcttgcatgtgtgggattaccctcagagggtggggaagagaccacagccaatctcagcatcatgtatatggtttcccatccacctctggtctgatgtattaaattagttgccagtgcactgtcttccagatttgcctctgtgttctttgttactgtactggatcttgttctgtctgctcccatcaactcttagttggccagccaactaacaataagtcagtgtccatcctccctttaattcttacccattctttgttattgagagaatagaaatgaattatctcctagcccttctgctaaagtggtgggtgggaggtgctctgaccactatggtctctgcagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtattacagcttcttttcttccatgtcatacccatcccttcttgcttgtctcctgtgaaacatcactgatatttacttttttttttgagacagagtctcctctgttgcccaggctggaatgcagtggtgtgatctcagctcactgcaacctctgtctcccgggttcaagtgattctcctgcctcagccgcttgaatagctgggattacaggcatgcgccaccacacctgactaatttttgtatttttagtagaggtgaggtctcaccatgttggtcaggctggtctcaaactcctgacctgaggtgatctgcctgcctcagcctcctaaagtgctgggattacaggcgtgagtcaccacgcccagcccatatttactttcaataaaacatttgtcccagtatagtttcctggaaacctaatacagccaggggaagggacatttgaattttggatccattgtccttgcttggatttagtcctcctcattttctttcaaaccttctgcctgattggaaaaaaaaaaagaattgattgtgattagattattttctctgattttcatgtaaggtggaacatccatatcagcccaggtctcaagttatatactaagatgaaaatgatagccactttcattctatgactcttgagattgtagaggctttgtagagcagagggaatccttagagtttagtagtttgtaattaattgataccagctaataggctagaatttagagggatgctgctatggctgcttctctggagctcagtcactggaaaggagcagacactcctatgttccacatgaaagctctgtaaccacccatcagctctcctgctacaaaaccttctctatctatttctgctgctctcttagcagaagggcatttagacctctatttcatcgtc

SEQ ID NO: 69889 - DNA, 1052 bp, Homo sapiens
ttcagctctaaccccctttccaaagggtttctctcttattgactactacacttgataaggactgtctgactaacttggatttgagatctcactcctactactgtagttgtcctttccctgttgtcctttctaaagctagccaaaccttgtggaaattggggtagtgagatttcccattcttggggtagaggattttccatctctctcaagtctttttttcttaggctgtcctgccctgtggttcatctgaaaaccccaggcagagaggaccttgcattgttggtggtagtagagatagatagagtcccctgcattaaaaacaaaaaacaaaaaatcaggattcctgttccacagtctacacttcggggtcatagatcatcccaggataactgtaagaaataggagttttaaaccaactcctatgtgtgaattaatgcacagtgctttacagtcaccagagtatactttatctgattcagttctctcaacatcctaatttggtcagctggattacatgtaagaaaacaaaagcagagagatttaagtggctagcccaagtttacatggctaatagaagcaaaaatggagctgattcttagtttagtgtcctcttcgctacaccacaccagctctctacagatgtcaccccttcctctcttagtagtgttacatttggagccctaatccagattcactggttagaatgatgctcttattagggctatggaccatcagactacatcaaactgtgcagataatagcttgaaggatctactgagtaggtgcagccctttcctctccagaccttttttttttatttccctgagatggagtttcgctcttgttgcccaggctggagtgcaatggcatgatctcggctcaccgcaacctccgcctcccaggttcaagcaattctcctgcctcagcctcccgagtagctgggattacaggcatgcaccaccacacctggctaattttgtgtttttagtagagacggggtttctccatgttgaggctggtctcaaactcctgacctcaggtgatccacccac

SEQ ID NO: 69890 - DNA, 1674 bp, Homo sapiens
gatccccaaagggaatgtttcaggcttttaattttctcattttttctaggccctgaaaagtaactgcttccccaatatcccaccctccttgggtctcaggtcagaatgtctttcattttggccaatgtaggagacagaaatggaaaagccattgaggatgatttccaaaaacaaagtttctttctcttgtctcccttttcccttcctttgaacacactctttaggaccaaggacatcagttattattcccaagttaccaataaattcagagctaaaaaggaaataataattaggttaatactttcctcttcctccttttcacactcctgcctttgtcagcctcttttttttaaacacctatccaaaggctaaaaccaccagatgttctttctcattaaaggtgagaagtcagattgggtatgcgggtatgggtcatcctgtccctggcccctctctccctgttggtggggtgagctttggtttgaggaccttgggtattcatagcatcatggacatccttttcggtcatgccatgctgttttcttataagttattttccgttttctccccctcacctagactggccagaacggatatctaaatgacatcaggttagtaccacttagcatgttccctgcttctcattgagctttgccagtgaggttaatataatcctgtaatgatgcttttctttgatgttaaccaacagactctccaaagaagccttttcttctagctctcacaagagaaggcagatttttaggtacctctgtgtgatctatatctctcctttttatttttaattttattttgttttgctgtaatcttttcagcagagtgggtttgctccatgcatggctgcttgtggaataattaaatttgtggtttttgcaacattggatatttttccccatttaaaaaaatggctcctggtcaatgactttatttttattgttgctgatttcatttcgagtcctaaacaggtggtgaaggggaccaaataggtgtgtctgggataggtacagcttcctcccagaaattagctggaattgggcatttttgaaagattcaaacatatttatgataaggtaaaagaatgggtgtcttctggctaaccttttctgaatctatggaaaagatgtgtagacattattcctgacccagcataggaatattttttcttaaagatatctttaagaaaaaataatacatatatatatatagagagagagagagagagacatatacggacacctttatgtatgtagttttctcttgaggcaatgtaatgtgtaagatgacctcagaaaggacctggccaggcgcggtgactcacgcctgtaatcccagcacattgggaggccgaggtgggtggatcacgaggtcaggagttcaagaccagcctggccaagatggtgaaaccttgtctctactaaaaatacaaaaattagccaggcgtggtggtgggtgcctctcgggaggctgaggcagagaattgcttgaacccaggaggcggaggttgcagtgagctgagatcacgccactgcactccatccggcctgagcaacagagcaagactctgtctcaaaaaaaaaaaaaaaaaagacctaagggacctctctgccttagaatggacttaaagtgtgtccttcatacgattgttcattacttact

SEQ ID NO: 69891 - DNA, 1207 bp, Homo sapiens
atcaaagggtccgagagagaatatttgcccgagaggtaagtgtagcatctgagagttgtcagcccatagcttttagctcttaatcattggaactgtgaatggaatgaaccctccacaaatgtttttgggtttgtttgtttgttttattttaaccaacatcagccaaccctagatttgatctctaaaactaaatgtggcttattgggaagctgcagattttcacttatattgttttcaatacattctgccatatggtattcaaagagaactataacttggagtggctgaatttggtaaatttgcctagactgaaaatagaaatggttttggcagggtctgaatcttgcctctaaaaccctccttctgcttaccctctttcactccctctatccattttaggcatctttgcttctaagtggaagacatagtgttcacacaggctgtacattcatcttgtttgaccagcctcatttttaggatatgttggtgattgttagagcacaggtctggcatccatcctctatgagctccacattctacatgcacagagagtaccactgttctctccagtctctacctgaaaaggaagtctctttcttcctatatttcttaccttgcttcctacaacaggactagctcctagggctaaaagccaacatgaatcagtttaggcaatgttactcttaaatgtgtggactatatcaaatatacttggtacccctgtatctggttgcctttgcctaccagattgaagagaagaatagcagaaattcaggaaaggttgtgggtgtacaagagggaaacaaatctccagaaaatgtagtatccagatatgagcaccatctcacaatcacatgagtaacaaaagagggaaagccagtctcccttcattgtcaaaagatggtcagggttttctttgttttttattttgtttttttttgtttttttttttttagatagggtttcgctttgtcacccaggctgcagtgcaatggcacagtcacagctcactgcagcttcaacttcctgggctcaaacgatcctcttgcctcagcctcccgagtagctgggattacaggcacgcattaccacgcctggctaacttttttattttttgtagagatggggtctcactatgttgcccagactggtctcaaactcctgtgctcaagtgatccttccgccacagcctcctaaagtgctggga

SEQ ID NO: 69892 - DNA, 2984 bp, Homo sapiens
ctccagcttgggcaatacagtgagactccatctcaaaaaacaaacaaaaaaaatttttttaagtattttgcagggaaggggattggggttggggttggttatataattaattcctactctttctgagccttggagatagattctagagagactgatgtttcatgaagtctggccctagcctctcttcacttcactgataggacagatataactatggaggaagagaagttatagatgtataaagtacagaccctgaagatttcattaaaacctgcatgtgactttttggattccttactccagaaattccctgagtgtgagttgtgtaatttaggagagctgtacctaataggtctgcttcctaacaaaacggtctttgtcctcctttcctttcacatttctctccaaatctcagccctgaacagaggttctcagaacatataaaggatgagaagaatacagaatttcaacagaggttcattctcaagagagatgatgccagtatggaccgagatgataaccaggtgaagaatggaaaggggtgggcctatatagagagtttgcagtaagagaaactgggaagggagaagaatttttgtgggatggagaaaactcaaaatatcttagtacggagaaatgtattgagctatacggagttggctttggcttaatgttgagaactgtttatttgttgaactggatgccaccctcttagccctagagagacatggtgctgaggtttgctaggtgatctcatttggcctggaactccttgggtctgccactgacttctaacaccacatcatttggaataaagcaaggttgatccctgcctcagccttgatccaactgttggtttcattcttttttttcctttaatagttagggatttctttgggaaccacaaaaagctactttgtcccacttcaactcttatcctagcttagggctagccttgaactggcaaagttgtgatctaatttacccaattataaaggtgtttctgatccctttctgcaaactccttaatctttttccaactccttccaccaaggtgagtgagttaatttgacatttgatgctgggaacctcagatagatcccctttgtgatccactgctgtgggaataagaagggaacagcctatcccatccctttaaatgggcctggctattgctttgacctgaagcctaccctttagatagtaagtgattatttgcgggttagctaagaagaagatttagatccagcctgcctctgcttggcctccaaaagggattcgatttgaagagcgtggttgagtagagcctacattaatcttgctaattaataactataataatatcttacctctagtgtcaaaattagttttcttgggatattgtatggtcttgagaccaggacctttcctgcttgctgcttgagtatttgagggagtccttttgagaaaagtgccattatctattgtggacaaacacactgggactgattgaaaacaaagaaacatacaaaaagacaaaatttaaaaaacgagaaagagcctttccatcctgatgcccttctccattttcccaaaccctttttctgtggatcaggaattattcaggcctagaggcacattggggcaaagtggagtctgtccctattgtgaacttttcatctctcagcttcaggcttgatccaatagggttgtttctgtgtactttctgtctgtgacgttaataacaagcataataattgctatcttattgagtgttttccctgaactaggctgtgttctaaacacatttgtatgcattatttcctttaatcctcttcacaacccaatgaggatgggggttattatccccactttacatataagaaaactgaggctaagaaatgttaagttacttgtctaaagttatattactgggaggtggcagagctgagattctgcctgacctcaaagcccattatgttctttctactttgccattgatttacctaggggctgaggacaatatagctccttgaggccctgtgtcttcttggaatggaatttataagaggacatttggtaggatttaggttcttgaagctaatgagaactaaatctaggcaaggttgatattcttgaagttatggttacctttggagattggtaaagatcaggaagaccagcctagagcagcaatctccttagttgcttcatgtgaagctttcaaagcctctgggttggaagtcagaatcttttataatctggtgatattcatttgatgagttttctcccttagaactccttgccttcaagagcaggatggataaggacactctattacaccctaccctggacagtgttcaccaattacaggccaggagaggaaagatcatgatgaggatttagatggtaggctactcagaggtggtgatctccccagccatcccgtctggttacctcactacattttctagagaatgtaaggttcttctctatcctctattttcttattttccttgtctatctctctgtctctccccttcctccactgtaccttacttctcttcctttctctgcccctctttctatctgttctccttttctttctctttgtattgctctgttctctttcttctttatttctgtaatttgtctctccccttccccacctccagttaatatagttaagttcaggaaaaaaatgcttaggctttgagtttagcttcgcccttgggatttcatttccaaggccctctttgctgagctgtgtgtgatttgggtcttcaggccatggcattagtgactaaataaggaataatgccaggtgctagttctataaacctcctcctctactgttcagctctgctaaacacctgtttcttctcccgttccagcttccctctgtcctttgctttccctctaaagcagtgttgttccttttcccagggctattttctcgatccttactgactggaggctacctgattactagagggaagcaaccc

SEQ ID NO: 69893 - DNA, 1015 bp, Homo sapiens
gactatctttgcctttaaactcttgtactggtagcaaaaagacatagtccataaaaatgataattgataagaaaaggcaaacaggattaaaaaataatatttgggcatatttactgagattctggaaaattcagccctgactgcccttacctggaatttattttccttaataaaacctgctatattttgatcaggacattcagtaaatacctattgatgatagatggcttttcagtgtaatattgatgtaatactatggcccagattctttcttctgtcattctgatgaggaattttgggatctagcacatcaaggtcattctggattttatgttaaaaccctggaagtttgattttgctttcctattcttttttctcctggttaggttgtggacttctgcttaggattagatagcatgcaaagcagtttcatgtattttaatttcttttgttgtggtggttctagactccagccaggaatatacggactccactggaatagacctacatgaatttcttgtaaatacactgaaaaagaacccaaggtaataacatgatgggtataagaggaaaaggggttaggggatagcaagattccaagaggccaaacggcttcccagaatttttccattcttagaatctaggatgctcatcttcctgtccccctagtatttgtcaggtatagttttatattctgtgagggattcaaaatactctcacattgaggtttctgttttcagaagaattgggaaaacttctgtgaaagaagaatgcagaaacaaagaaatatgaagtcttgggagtatactgattaaaaagcacacattgggagtgatagtaagaagagctaaaataaaaagcacagaaggaaaaaataattgatttgtacataagctaaattataattcctttaaaattgtttataacaagatggaatacagaatgacgattagatttataacgtgtgtttatatgaatatgttgttaacagtgagatttctgatatggtataaca

SEQ ID NO: 69894 - DNA, 1013 bp, Homo sapiens
ttccatttatataaaattctagaaaatacagactaatctgtagtgacagaacagatcagtagttggctggggttagtgtgaagggaggaagagattacaaagggacatgaggaacctttggggcatggtgaatgcgctcactgttttgattggggtgatggtttcacaggtgaatgcatgtgtcataatataaaattatacattttaaatacatgcagtttatgtcaattttacctcaataaagttttttttttttaaagaaatgaacccagggacagcatttattaaataactcttttctgggttaaaggaaggctgctggaaaaaatgtacccgtgtgaaatacgagtcttgtgtatttgttaagtatggatacatacctcctgcttaatgcatttgatgtttctttaggagtccatagaggccactgtattctattgaagaacatgtctaacagtaacactactcaagagaccctggaaataatgaaagaatcagaaaaaaaactggtggaagaatctgtaaacaaaaacaagtttatatctaagactccaagtaaggaagaaattgagaaagaatgtgaagataccagtttgcgtcaggagacacaggtaacgattggaaatgcattgtatgcacactttttttttttcctttagagacagggttacccagctctgtctgttacccaacctggagtgcagtggcacaattagggcccactgcaccctcaaactcctgcatcaagagatcctcccacgtcagcctcccaagtagctgggactacaggcatgtgcaaccacatccagctaatataaaaaaatttttttgtagagacagggtctatgttgcccaggctggtctcaaactcctggcctcaaatgattctcctgtctttgcctctcaaaatgctgggattataggtgtgagccactgtgcccggccaacattctttatacctgaataaaagtggagatgtgtaagaatcagtcacttttagaaacacttgattc

SEQ ID NO: 69895 - DNA, 1058 bp, Homo sapiens
catttacctcttcaggcacgcagttatactgtttttgtttttgtcctttgttttgacactgtaatggaaagaacatggaattttggaaccaagtagacctggatttgaattctagctccttgcctgtagtgtatggccctgaacaagtcacttagtatttctgagtgttgatatctttattttttttggtatcttttttataaagtggagataacactttataccttgagaatattgagtaagatgatctcaataaactgtaaaaaaattcaaagtcatagggatggacccaggttgaggggaaagatgagagtttacaagtctaattttttatttcaaaaatatgttcccccactggtactcagaggcctcagatctaggcacccttcccatccgacactccacaccccagaatgcttctgaatgagcagccaccctggaacacctaggactttaacttttggatcagacacagctaggttggaattctaccattgcctctcttgtattgacttgggaaagttattagatttatctgagctttggtttcttcaactggaaaataccctaacaaagagttgtgttaggattcaacaataagtaaaaagaaaaaaataattaaaaaaaagtcgagaaagaatgcagactttggaatcagacaacatggaggttctggtctgtttctgccacttagtgacggaaccttgatcaggttgcttagctgcacttggtggatatgagttgaagtacataaagcaccaggctcataatcatgctcagtaaacctcagtaaatcatgtaccttttcattttctcctaattcccaatgtcaaagaatggaagaaaaggcttgtgacacaggagcacctagactgttttgtttttaagctaccacttaacccctgtggatgtttgttcctactgtttgattcctaaaggaatttttgggtttgtttgttttggtgtagttaaataatgtataataaaatgcacagatcttaaccattttgttaatgaggtttgtttgtttgtttgttttgagatggagtctcactctg

SEQ ID NO: 69896 - DNA, 1056 bp, Homo sapiens
acagatcagcagtactaaattatatatatgaaaaaatatatgttatatattttgtagtgaccgagtcttgctctgttgcccaggctggagtgcaatggcccaatcatagctcactatagcctcaacctcctgggctcaagggatcctcctgctatagcctctcaagtagctgggactacacagaggtaccactacacccagctaacttttttttttttttttggtagaggtggggtctcactatgttgcccaggctgctctcaaactgctagcctcaggtgacactcctgctttggcctctcaaagtgctgggattacagacatgagccacgacacctggccagcagtcctaaactaaagtctttagctctccgtatattgaggcatgggaagtttaaatattgtgatttagctgaacactgattcctcactgattcctcaatatatccctacactgattcctcaatatatcctggtgttggttttccagcagtttaaagattcttgaatttctttactgaaattcaacaaggaaaaatctccagggtttttgggatcccttgttatttgcatagattgattgtctttgctattcactccttgccccattcatttttagtataacagaatggcagcatttcttatttgtctgtatagactattctctgacagtttttgcagcagtttctatggaaaatgctttatttcaaaaaaaaaaaggcaagggaaatctcatcttgaggctcttagtgatagagcctgttgccatggagtcttggatcagattggctgacccaggggccaatgaacagatagaacataaacacattatcatttaactttgcagaatttattattcgataataggtgacattaacaccctaactgtatatagaaactgtgaaataaaatgtttcaaaaatggtgtaaggtgttttttaaatttgctgttaaatataaatttgataattgcatattcttaatgtgatttgattgggggaggatatggtgggaaatacctaccacctatctgtgaattgagctgctactgcagcc

SEQ ID NO: 69897 - DNA, 1031 bp, Homo sapiens
aggtcctggcagccagctctgagcatgcctctgcctcccacacttgcgtgcccacagctggtcagtttactggatgaccaagcatagatctgtctcatcttttggagggattacagagggaacaggtaaagcctaggtttttattagccatgagacctcaaagatggttctggaaggatggagggacggggtgcctaagaaagaagaggcataaagtgtgagatggatacaatagttcagttctgaggagaccatgtgaagagacagcagagtaggcagactacagcataagcaggcaggctctgtgtcatctggggtgccagttagggcccttgtaggagatagaggacttttcagctgtctgtttttgcttcatcaagagaacttagtgaaggaattatttacagaggtataggcagagttaagggaaccagtatgagatgttgaggccccagggactagcaagatagaaagcctttaggaccccctagtgttgaagcagttatatcagaatgtaggcagagctggggccatggaagggggtagccaggtagtgtagggacacagaatagccacagttacacagaaccatgacacctagacagagagggaacagggataagaaatgccctgacctcagcaggaagccagagggcaggggagctcaggtgatagagctcaggcaagtcagcccttaagggcatagagaaaggcagagaaggacaaaaaatggatgaaggtatgcaaagagagctttagtagttcacctggacaactaagaaggacaggggctcacaacaaagaggggggtaggtaagcctctattttgggcagcagtgatctaaactttggtgaatccaaagaagggcctctctggagatccacaaaaattgggggaaggggttgtgtcaactcatcttggagtggggaccattgagtagaaaggacaggaaggcatagtgggttatggggtctattaaaggtgagctaagggtgtctttgcctgggaaccagatggcattgctcatggt

SEQ ID NO: 69898 - DNA, 1146 bp, Homo sapiens
gatcctctcacctcagcgtcccaaggcgctaggattatagacatgagccaccacacccagtcctcactggctttaaatggggggggacccagacccctccacattgaattcatgaaggtgggcctcatgctagcttttctccttatgccccaatttctccaagaagcttgatggggagaaagctgtgggggaagtgggtgtgatttggaaatgtgtctttactccactttgctcatctcccctctgtttagatgatgggggctgtcaagagagactattagatctaggcgacagggttcctaattggaaggctggacctcagtaccaccagtgtccaccatgtggcagtgccgtgcctctggacagcagctggcttgtagctggctggagcttcccagggacagggaaggggcagctctggggaatggagtgatgaggagtgcccctcgacctctcactctggggacgctgcctcccccacaagagacagggacaagctggttcctttgttctttccccatcacactgccagagaagagagactgtcttcaggatccacatcactgctacctttggttttggacctcatcacacaaacacgtggcaatggagcttggtgatgtaccaggctcttcctagaacctcagggcactctttggtgggggtggagtggggtgggggcgcactgagacgattagaccctcctgtccaccctgcatttctccccaagctctgaaacacattcaagagctctgtccagtgttctccccagctcccagcaaccattctgttggttgggctgggaaatgacagccctctaccccctcgggtctggaacattggtcagcaaagtggaggtatctatccatggtggtgcctcagacggcttacctgttggtatcagtaggcagtcaggggaagtgacaagaagtggctgcaggagtcactgaccccacctctccccaccctcactgtcagatgcccccagtttccagctcttcccacccgcttgctgctgtgcctggcctggccctacctccccactgacacttacgtcagagctcagctataaatacgctcttagcatcttagtcacttttcccaagaagtgctcctgggttataaataccccagccatctgcctca

SEQ ID NO: 69899 - DNA, 1001 bp, Homo sapiens
tgaaagctggtgttattctggggtagtttaaatcaggcccacctaatctttttggtctctgttttgggggaacaggaaaggaagtatgaggggagactctgagagaatgaaaaaaacaatgtgatccttataaaagcgtagcgaggaagaaggtgctgctgtccgtttttcttttcaaactccagttttgactccatcccgggttttccagtctcccgggaatgagggtggggtggggcgggatggggtggagaaccaccgggagcgggccgggccggccggcgcggtgggtgatcccgggatgctgggatttagggtgagggcggggtgagatggggagcggaacccggaccccgcgacccagcccggcccggcagcctgggctgtacccttttctaactcctccttttccaaccgaggtgcggatcccgcatccaagacctcccaactcgaccttggaactaatgttggggggcggggggcacagctggttggcagctggatggggggacaattctcccgcctccttccctctatgactcacccaggggaaggagggaagtttgcaaatgatcccccaaacactagagactcccccaaacttgcctactcagtcatctttctgccccactgcctagctgccgaagagcctccaaggaaatggggctacacccctcctcgcccacgcgttccacagcccacccatatctccccttcaggctagtaaaaggaaaatgtcgccaacttttttagcttcggtaaagtttttctggggtgtgagagttcgggatgggacagggagctctagggttcccctgccggagccctaaaccatcttcggtgtctccctgttttccagcgtccccctcgcacccccgctccccaactcccaggagtcggctccgcccccctactcccggtcccgccttccccgcccccgtgcctcctcggcccacccaagtcgccgccgcaggcactggctgcagacggctccgctcccc

SEQ ID NO: 69900 - DNA, 1117 bp, Homo sapiens
gtcatttcaaagacaactctcctcagtacttccctgggactgcctcaaccactacaaatcccaagtcttccagaaatcctccaaatagcccaatccttcctgagacttcctaattgtcttaagtaactgcctcctctcctcctcagcccatctctgggattcccagcccagatgaatcaccaaaaagggccctcgccttcctttggggtccagccttgtggtccccatgactctgcccggggtgggatgatcccacatcctcagtcccggggacccttcccaacttgccaggtgagagtccccatattgctacctgatttccctcagctcagggtgggtgggtggtggattttgtaggggaaaggtgaaggaaggacaagggatataagttttcagtactagaaaagtaaagaggtgtgggtgctggggttcactccttgcagttgagtcagacgcttccaaatgggatcccaccttttgcccatcccattcaccagtgtagtctgaggaggaagtcccttccaaacccaggaggttccagctgcttgggtgggggcacttagggcaggaagacctggcttggtttcctcttccttctgcttacttccaccctcatcaccgtcacctcttcccctggggaagctgaagtctgagctggacatgctggttggcaagtgccgggaggaacccttggaaggtgatatgtccagccccaactccacaggcatacaggtaaggggatgggcaggagctttacctctgggacctgagcaaaactaaagctgtcacccaagtgaccctgagattgcctctcttgccctaggatcccctgttggggatgctggatgggcgggaggacctcgagagagaggagaagcgtgagcctgaatctgtgtatgaaactgactgccgttgggatggctgcagccaggaatttgactcccaagagcagctggtgcacgtgagccccagggggtaacaggaatggctagccagaacctttaggagattctgagtgggacatggtggaatccggctgagggcaggaggtcagaggagactgaggttgaatgctcagttgggtaggcagaagctcagaagttgtagctttgcctta

SEQ ID NO: 69901 - DNA, 1010 bp, Homo sapiens
caacagagcgagactccgtctgaaaaaaaaagaaagagtttgggttggatgcattggctcatcccagcactgtgggaagctgaggtgggaggatcgctcaaggccaggagtttgagaccagcctggtcaacatagcaagactcgatctctaaaaagaagaaaaattagccaggcatgatggggtgtgcctgtagtgatcacttgagcccagaagtttgaggctgcagtgagctatgattatgccactacactccagcctgggcgacagagcaagactctgtcagaaagaaagagagaaagagagagagagagaaagaaagaaaggaagaaaggaaagaaggaaagaaggaaggaaggagagagagaaagagagtgagagagtgagacagaaagattctaaaacctctagatttggggaagcccaaagagcaacactaagacaagagacaggcagactggtcacagaagagtgacttctataggagggaatggatgggttgggaagtaactagaaagatgtccacagggtgggctggggtatggaggtgagggttgcctgggctctctcaccatggcaccctctggcacagtcagtctgctttcctccctgatgggacctccttcccgctccctcttgggctccactgtagaaatggatggtgcccgaggcagggggccatccccacggtgccgtttggtcacatgggcgtcaggaccatgcactgtcttgacatgttttcgcagcgagctaggatctgtatagcgtttggtgcagccagggagcttacatacatacggcttctgttgagtggagagtggagacagaaggcaaacggatcaaagcggaagaatgcagaagaaatgggaaaaagtggtgacaacacagggggcaggggaggagcacacagcaccaaaggaagtaaggaggatggaggcctccggtgggagtcaaagatgcagagattaagtggagggttaggaaaactgacagcctgggaaagatgaggggg

SEQ ID NO: 69902 - DNA, 1050 bp, Homo sapiens
agcttcgctttctggtggacagaggtgagaaggcttgtgggccagtggttgtactaagaatgtcttgcctgagaaccatgggcggtcctacatgaggaagctggcagaatagagaggccgtcaggctggaagtgtatgtcttagctcctgatctctcctcattcatgttgcagagcgtgcggtcacctccgatgggaggtatgtgttcccagaacagccaggacaaggtacttacatggaagacccttcagatccctaaaacttccacatatcctctttgcttcccgtggaaacccccatgtactattcctgggagggttgtcctcatccccaccttagctaccttgccccactgcagaccctctaggcattcctatagtctgctttgactggatttctccagaacttctaatctctcagtctctaaatctttctggcccttcatgagcccctatacctccttctccctccagaaggtcggttagatttggacagtactgagtgggatgacattcatgtggtcaccggagccctgaagctttttctccgggagctgccccagcctctggtgccaccactgctgctgccccatttccgtgctgcccttggtaagggttggagctttggaaagaacccttgatgtgggggacacgggtggtaaataatagaatagaggttcccttatactcttctttcccattctgactttagagatggaaaataatgttcaactcaggtgcctactccagttgcttttttgtgaatgtttagagggctgaattgaaaagaattatgaggctatagttgggctatgtgaaaaagaaagctgtgctagattaatgatgtcttccatgcctgtgggaaagagcagtgcatttacccatcctgtcctagcaccttccctaaccttactaccatgcctttcccatcactctctctagcactctccgaatcagagcagtgcctctctcagatacaagaattaataggctcaatgccaaagcccaaccatgacactctacggtacctcctggagcatttatgcaggtc

SEQ ID NO: 69903 - DNA, 1050 bp, Homo sapiens
gactcatgtcccctgcattttagccagctttgtctgctgccctgtactatttagtggtccaaggcaagaagggggaagatgttcttggttcagtgcggagagccctgactcacattgaccacagcttgagtcgtcagaactgtcctttcctggctggggtgagttgggtcttgagatgaggactggggaaggcttatggtgtaaggattaagagggaagactgtattcagagtgttcgaacccaacactgccacttactagtagtgtaatcttggcaaatcacttaatctctctaatcctcaatttttttcagttgtgaaatgggataatattagtacctatctcagtgagttattgtgaggattaagtgagatcatataaagtgcttaatacagtgcttgacatataaagtgctcagtaaatgttagatattaccattgggaagaaactgagtgtctcatttgtgtacattttccttttctatccccaacaaaggagacagaatctctagccgacattgttttgtggggagccctatacccattactgcaagatcccgcctacctccctggtgagaactgtgcatatcactccaaccctaggagcttggtgtaggggttacagaatgggcagtagaatactgagaactcccttcaaggtacagcttgactgggcaactatagcagaagatggttgagggaactggggaaagcaactggagaaacctcacaaagaaggggaaagatgcccgctcctgcctaccaggtccttatgtttgctgattttcttttcttccatacccacagaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggtttggaatagggcagagccttggggcctgaggtgggaggtggctaggagatggactttgagcatggccac

SEQ ID NO: 69904 - DNA, 1441 bp, Homo sapiens
acccctgtacccttagaaggttttgaagacaaggtaaaaacccttttttattcatatcattcagccttagtgttgaaaccctgggctagcagagtagactgctgattatgtcttgtttcagtttgagactttggattggtccctaacatgtttacctccttctgacctccaggtattctatgtctggtttgatgccactattggctatctgtccatcacagccaactacacagaccagtgggagagatggtggaagaacccagagcaagtgagcagttcttggttaggctgtgcatggggagggtaggcggtagggtgtgggtgttagggttgggtgtctggtcttccttgggcctttgaaggaggtctcaggaaatctctcctaaccacattcccctaggtggacctgtatcagttcatggccaaagacaatgttcctttccatagcttagtctttccttgctcagccctaggagctgaggataactataccttggtcagccacctcattgctacaggtaagtaccctggaagactactgatggggtgttcataggaaatgaggggtgaggcagtacttggaaaaagatcttggagagctgctatcttgagttaggagttgagctgaaataggaaataattaaaatgagaactcaacctagagaaacgaacaagaacctgaagaaagcaaaagtctaaagctaaaactctttagtagatataagcaaagagaaaaaagggccagaatggataggaagggactcccaaaatctgagcataccagccccttaaggagaaatgttgctagacacccatagttgaggttagaaagaggaaagaaggaagagttagtgggctagagaggggaaggatgtgatgtgagcagatggttctcactcattctcctctgtccagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacaggtaggacttggtaaggggtcagagttagcagtgagctggggtggggctcattttccctcaggagatgggaatgtggagagaactagaaaatgggcaggaggctgtgaggacactgtggaaagttgatttctattaattgggatctgttcctagcacatactaggctatgtgtgcttgatggaacagttagctgtagagatgtgatttagcaaagttggttataaagtgggtttttgtaaattgtttccttattactgttctttgtagaattgaagatgtattctctcccagcaaaatagttcacctgcagat

SEQ ID NO: 69905 - DNA, 1017 bp, Homo sapiens
gagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactgttacaacagccaagccacagcagatacaagcgctgatggatgaagtgacaaaacaagtatgaagcttaagccctgtgggagactggacaagctgaatcctaaatagatctttttcttgcctcactgttacctccccacccccctttatcttagggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcctctacttccctggtcaggcgctcgatttcctgcttgagccgttcattctcttcagctagctgtgccactttcctttcattctcctgttctttctccttcatgcgctgctttccagcccgggctggggaatgaccactctgtttccgtttc

SEQ ID NO: 69906 - DNA, 1784 bp, Homo sapiens
ttctgggaacggaatccccagggctgcccctggcccccatggcgcatgcgcgggaggccgctcggtgatccgcggcggcggcagcggcgcttcctgctaggaccggccggggccgtaccggaggctcgggctccaccgaccctcctcccaccccctcccactcaccctctgggccgcgactgcgcagggcggggccggccgaaccatgggccgcggtgagtgcggggcccggccccccccaccctgcccctccccctcccgtccctaccctctgccccctccgcgtcctctcggcccctttccccggccccatccccactcccccgccctcacctgcccccgccgcttctccctctcactgccagacttctgccttcctcaccgccctcccctcagtgcttcgcccaccctccgcccgccctctccccaagttccttcctacttcgtgcgccttcccctcctcctcaagctgagggaagcagtctgggtgacagggcgccttgttgtgagagggaaagtttggaagccgccagtgtggggtgggagcaatggtgaggctggggaggatacctgcaggttggaggggcttccccttctatcggaggacaggctctcttggagataatcggaagccagtggaataggaggttctgaatccctttgccgtaggcttgagggaaaatcaggagcttcccaggatcctgggagaagactgagctgtgatcctcacctcttaagacccgaatgaactatatcagcgattgtctgatggagcaggcatggggggagttctgctggtaccaccccagcgggcagttgggcaattgcctggtgacctgtggggcaatctgtactttttatatcatcttcctgggtagagaacaacaggagccagacactctgggaaacttcctagtggcctagcattatgggaatgtgcccatactcctggttgaagtcttctactccgaatggagggaggccttgcccttcatatgcctaagaattgggctagactttcttggtcccagggagctgaggttctgaccctctggtccctagggactgggcttggaaaggatggttgtagactaagccagcagatccccgagatctttataggtgcttgcctcacattgttaaggatctttcttttgagagggtgctgggctgtgctgctctttagagttgggcagactcctgacagtcccatctctctacttgcgttgcaggtgtgggctaagctggtggccccggctttagactggaccccacaatgtttgcagagatgttcaggtagctgtggtgatacggcagaggactcctcagtctccctcccagctgaggggttccccttgctcctctggggcttcccctgagttttcttgggtctccccacaacctttgccttcctggagtcctctctcaggtacttcgctcagtttaatcctcctagtgcctacatggatgtctgtgttatcaggcacgcgggagctgattacacacaatgaatgggggcaatgagagcagtggagcagacagagctgggggccctgtggccacatctgtccccatcggctggcagcgctgtgtgcgagagggtgctgtgctctacatcaggtacggatcttcacaggtccccaagctctgccactccagttgcccaggttttctttcttccgtttcttctctcagctcagctctctggtacccgattgctctcctctcttccccttccttcctcagcctttttgctttctgtagctctgggcctttgaatccat

SEQ ID NO: 69907 - DNA, 1087 bp, Homo sapiens
gttccttgagagggagcaaagagaaaggggagtgggtggggagctgcatgttgaaaggagggcacagggaggttgggaacttgtgggagatgggactagagaagacaaaagagtttttggaaggggagccacaggctgacccttcatttttcatttattgcaggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggt

SEQ ID NO: 69908 - DNA, 1050 bp, Homo sapiens
ccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccaggtgaggatgggggtgagtaggtgggacagaacaagatgtagaataagagatgggagctgggaatcaaaagctttcagtttcattcctgagctcttccttggggcctttggggaggccttagttcttggctgggggtaggatgactgcaagaattgggtctgtatttaataagcatggcctatctcacttgaggcttcagtcagatagtggatgtgaaagcactataaatctgttgagtattttacacgcgtaagtgttagaatcattcttttttcttagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgagtctgagggagtgtgaattcacactcttggtgtgaaaaagcaggagtaaaacttgggagtagtggctgaataaattggggaagaaagtctttggccactggataaagcctaaagagaatagtaggtctgctcagcctaattggtttgcctagggagagacccctgactataatttctcaacaggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccaggtgagggtgtgggcatatatttgtcagggagataattttttctcaaactggaaattt

SEQ ID NO: 69909 - DNA, 1141 bp, Homo sapiens
ggcagggctctcggggggtagacagggggcttctggctgctctggagggatctgctggcaaaaaaataagttctcagtcaatctcaaataccgtccctcttctactataactcagaaagccctaaatttccagtttgagaaaaaattatctccctgacaaatatatgcccacaccctcacctggagactctgtagcaggcaggctaggggactagaagcctctgagaggggtggaggagctccccccccagggaggagctgcagccccaactggccagagagaagagggccaggaggctgcaacaggctggggagggctccagggctgctggtcagtgaagacaggtcacctgttgagaaattatagtcaggggtctctccctaggcaaaccaattaggctgagcagacctactattctctttaggctttatccagtggccaaagactttcttccccaatttattcagccactactcccaagttttactcctgctttttcacaccaagagtgtgaattcacactccctcagactcacccagcaggctggcacccagcagagggctaaggagttgggggggtctccctgagttggagggggccttgcccagagaggaggcccccgggtcagtagttgccgtggtgacactggaggtaggtggtccaggttggggggcactcaggacacagggctaagaaaaaagaatgattctaacacttacgcgtgtaaaatactcaacagatttatagtgctttcacatccactatctgactgaagcctcaagtgagataggccatgcttattaaatacagacccaattcttgcagtcatcctacccccagccaagaactaaggcctccccaaaggccccaaggaagagctcaggaatgaaactgaaagcttttgattcccagctcccatctcttattctacatcttgttctgtcccacctactcacccccatcctcacctgggggggtgtccccgaggggggatccagggtggcagccagcagcgcagaatttaaagctatgagggtagggggggctgaaagtggggggaaaagtaggggggacaggtctcccaagcctgaaaatggctccccacttggacccccggctccctctgcagatccctcccc

SEQ ID NO: 69910 - DNA, 1059 bp, Homo sapiens
atggacaaatggaaaggtccccaagaagaacccaccattggcagcataatggggagctggctgaagggggtgctgagcccaaggatccaccccctcccgggccccattctgaggaccttaaggtgagtgcagagtgctggtagtctgggctcaggggctctgaggaaaggttggggctttggagcctttttcgaaatttcccacacacatagtccatcttttctcaggtgcccccgggagtagtcagaaagtctcgtcgtggccgtaggagaaaatacaagtgagtgttgggcctactatagtgctggcctttgcctacttctttttggtttggacagttctaatgtccaaatagtggcttggttttcaaaagggcagattcttatttgaatatgaataaggatattatgcctttactatccaaatgtagaaagtttcccacccaaacttctgaaattcacctggtgcttgggagctgttcctgatcatctgtgccccttattgcagccctacccggaacagcaatagctcccgccaggacattaccttggaacccagccctacagcccgagtaagtgtgtgtttgggtggatgggtggatgggtagggtgtaagggatgaggcggcaggaggaaaggagggttagagggagtggggagaaaagaagacttcctgatacctagcaattgaccacttctatcaacttcccctctgatattaggcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtgggtgggggcactactccccactcagagcacaaatgcaactccttcccctacaatcccatcctgagccattgcagggggcagggaagttcacccccccccaccacccccccgcccccccgaagccatgtcactgaaaaggcctgggggggatggtatatggccctttccc

SEQ ID NO: 69911 - DNA, 1291 bp, Homo sapiens
ctggccgcaagtcccaatttctgttggaggcactgttctcagtgctggaaggagcattaaagtcgagagaccagcatcaatcacaggatcactgagataaatgaaaaaatatataaaggacttagaataatatccttttcctccagagcagttttctaacattttgaaccagtgaaaccctcatttcaacaaaatcttatttagctctcattacataaaacagattttaaaaaactgttctggctgaagtcaggatgggaattctcgagtcctacctgcttgggctcaccccaagcgtggtctatgtactctaagggtagcttgaaaattggtgctataaacatcccccctctgtggcccacaaattgtgcttccatttcttgtcttctctctcagagaattccttcaggtcctcatccagttaagcaactggacctgacaaagagtaaaacctctctaccactttgtaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctc

SEQ ID NO: 69912 - DNA, 1059 bp, Homo sapiens
ctatgtttctttcttttttttttttttttgagacggagtcttgcactgtttcccaggctggagtgcagtggcgcaatcttggctcactgcaagctccgcctcccgggttcacgccattctcctgcctcagcctcctgagtagctgggactacaggcacctgccaccacgcccggctcattttttgtatttttggtagagatggggtttcaccatgttagccagaatggtctcgatctcctgacctcgtgatccgcccgcctcggcctcccaaagcactgggattacaggcgtgagccaccgcgcccgacctcattctctatgtttccctcgcccatctacctttggttaggattttaagattgtggctaggtatgtattccagggaaaggaatcccttggggtggtgagtggcaggcagagtagagcaggatcgtattcctcccattgcagcagcagggaagcagatggcaaatctcacctccttcctcccactaggtcgcagaacttgaaaagcgcctgacagagctggagacagctgtacgttgtgatcaggatgctcaggtcaggtgttctcctgtacataatctgagccttagatcctgcaactctaggccttaaggtctacaacattccacataagcctgggaggagtcatcaaagggcttcagttacagggatcagctagtgggttcccagctagaaccaggaaagatgggagaagacgataatcatggagatataaggaccactcacttcttcccttcctttcccaccagaatcccctttctgcaggtctacagggagcctgtctcatggtgagtttggaagaaactggagtgtttggatcacagaggggatagttgggtttgggtttgctttgaggattatttttgagtttgtagctatatattaatttagtggaatatgggaggcctcttgctagtctgcctttcctcttcatgatgcttgtcccaacttccatccccaggagactgtagagctgttgcaagcaaaggtgagcgccctagaccttgcagttttggatcaagtggaggctc

SEQ ID NO: 69913 - DNA, 1074 bp, Homo sapiens
cagtttcctaggttaagcctgggtaggcgccttggaatagagccacccttctttccccttggacaagtagggcccagtcacctaatggtttggggattttgtggggtagagtaagttctagagtgggaatgagtgtgtccctggcctaaactacctgttcttgcaggaggagctgacaagcacaagtgtggaacacatcattgtcaatcctaatgctgcctatgacaagttcaaggacaagagagtggggacaaagggacttggtgagactgggctggaagctgggtggggggaagactggaggataagcatgagaagtggtttcctgtcctaaagtcttagtgagttgtgcttgggggaaggggtccctcatggagatattttatggaagccctcacagtcacctgagaccatgactgccttgggcctagatcaggccctcagttccatcttcttttcttggcagatttctcagatcgtattggaaaaaccaagaggacaggatatgaatctggagaatatgagatggtttgttgtgtgtgtgtgtgtgttgatgggaatggtgtagtgaccctatctagcagacatgtagtagggagatcaagggatacaggcgggattctgttcctcctctgttcctgaggaagcagcaggatgcagccagggaaactctgccctactgctgtttgttctggagagcctccagccctctagctgtcctcagttctttggtactagggtgttgtggattctcaattggatatgatacctttatgacttaggcccagggtgtggatgaattcttgaggctccctgtaatgagacatataacattaccctctgtgcctgctctctagcttggagagggtctgggagtgaaggagacaccccagcaaaagtaccagcgcctactgcatgaggtccaagagctgacaactgaagttgaaaaaatcaaggtaactacaaactctcttctcccttctctgctgtgacttacacagtagaggaagacctcaagcaagaagagaaagattccctgcctggctgggtgcggtggctcacgcctataatcct

SEQ ID NO: 69914 - DNA, 1367 bp, Homo sapiens
gatcttgccctctgaggcacagccacttagccaaacagccctggggggtctgggagtcccttagtgaaagagactgggagtcacgtactaggtaagctggcacccggggccagggcacttgaaatcttccaatcaaggtgactagtactactccaggttatgcaggaatcatgcctaaaatctcatcaaccttcaacccacccataggacagacctggaggtggtatatactatctgcaaactaatataccacttttccttttatttgattttctgtcctccctattctgcccaatccgcatggtttgaaattgagcttatggcccattgtcttctttctctccttgagtttctcccaagctggttttagcttggtgggacaaatcagagaaaggtatagtgtgtgtacttctcctttgtgtttgcatgtttgcacttatgggtgcttacacccactctatgcagagacatcccagcctcgaccacaggatctggagccacctctaccctgagctgaaagaggaattttttttttttttttgagacagtctcactctgtcacccaggctggagtgcagtggcatgatctcagctcactgcaacctccgcctgccgggttcaactgcaacctccacctcccgggttcaaatgattctcctgcctcagcctcccgagtagctgggattacaggcgtccaccaccatgcctggctaattttgtatttttagtagagatggggtttcaccatggtggccaggctggtctcgaactcctgacctcaagtgatccacccacctcgccctcccaaagtgctgggattacagatgtgagacaccgtgcctggtggaaagaggaatcttggctgggaccctagcatcgtctagggaacagagaggttgtgattaagaggtatctggatgaaatcttggtgaaaggaagcacttgtttttaatcccaccatggtttttcatatgcatacaaccatcctcaaccatctgcccatcagcagagctcctagaaaggcaggacataccactggatatccccttctggcagttctaaaccagccttgcccggaagtgggagccttatctatgtggcccagactcaaataaggcctcttggaaatactctcacccttcccctttgtttaccctccaacccctgtgaatcttgtgaacagagggttgaagaaacatgttctgcacatgtgctagtacctgtgaatcttgatgtcccctggaccctctgtgtaagtacatcatggcagaattgctctagatccttcggagctgcagggtgagttaccagccactcaaggtggaggcaaacatgccaggctgcacaagggaccaggagcagctctg

SEQ ID NO: 69915 - DNA, 1291 bp, Homo sapiens
tgcacgggctgtagccctttcctcctcaatctgggaagatctctttgcacttcagacactcccaggttaattggggcaataggcttgcttggagatttttcttaaaatgtttggaaaactaattcccaaatagaattccacccacacacacaccccgaccctaacccctgggcccacagcctgccttgggtcagtgaggctttctgctcatggcttttgaactgctggaataagggaagtaaattaagaaaaacctcattagaaacaatttagcttctctctttatggcataactacccgcagtaaaaggggaaaaaatgacctagccatagtttgatggggccctggcagaggcttcatttctccaaaaggtagatattactggacactcctgagatgagaaacagtacttccttacagtttagaagatcctggagtatgcttgattgtgttcattgactgttggcgcacttgaacttacctgagtttttcctaatgcttcccccatcctccctcctcaccaccttgcctggacactagtttgcacaagtaagaccattcaatgcttcttctctgcatgtttttttcatctgccatctcgcatgcaatgctctgccactgtgctattgttgtagctaatcgttttaaattccagtgagtccctggctgggtcactgaggggcctgctggccttatgtttaaagatcattaatcaagggttagaaacagctatgatccatgaatcattgtctcttccccttgtgaggtctgcagagtaaaactgtccagtggaggatgggatagaagcatggaggctttaaatgtttttgaacatgaggcatttaggggctggagttagaaggcagtttcctttctcctcctcagactaagatcaaatgaagatttttttatggaatgacttttagctattctagacaaggatagaaaacaaaagggatgacagccacagtcctcagttcttggctgtatgtggattatctctgggaaaaactcattttaatattcccctatgctaggtctttagagaaatgtaaatgggatgagaaggaggtttatatgcaattgtaagataacttggattatttgtgcttttgtgagtctttctgtttctgcacccctccttttgaaatggatggatggtcagcaatatattgatccatcccggacagttttactctacagctctgtccatcttccttgtcatcatggttttgaagtaccctggctgcagtgttggcgtacagcctgaataggctcagagagtaacagt

SEQ ID NO: 69916 - DNA, 1444 bp, Homo sapiens
tgtaccttccttttgtgctgccctgcctgcttctcaaggtgagggttgggacacaggaccttgagtactaaggtcctgagtcactctcaatccttgtgccagggtggtggtgtacggggcctaattggaggatagccttcaccttctttggcaatagtgattgccaaggacctgcccgcctctagatttagggtaacatcgttgctatcacttacactcaccgtttactgtcaggtcccaattgtttccgctgtcatccctaccccttgagacatgggaactgacatactgttgactcacggggcaggtggaggagaaaggacagaaccctgacatcacaccccgccttctctgttagcttattcaaatggagtgggggaaggggtgttgttggatgctgggtagtgaggttgggtggtcactgcttctacctgcaggccaggaatgagccagatgtttatgaaactagcgacctacctgaggatgatcaagcggagttcgatgcggtaagaatgtgtgctgccacagactcctccggactctgacctttctcccctagacaggtccttccctttctcgggggagctacagcaataagcgggtatgccaaccccagcctgggtggtatataggttgcagggcttgcaaagaccttgctgggcttgcagccaccaatgagcaatggcaggagggagagtcaagtcagcggaattacagctaacaacatctgtttgcaaagccctgattcttgggccttttaaataaaattgaaatatctcaaaacaggtttggagctagtgacttaggcccctgggttctaacccatggaaatgaatcatgaagcctgggcacttgtaataaactgctaccaagaactagactttgaaatatggagaaatactttttccatatgaatatccagtatccattgggcaaggaattaagaaagtgattccaagattttagagcaaaacaaatttgaggaagaatgtaaatatttcacatcagcggatgtgagactgtggttgcatttttagatccgagaattctgaggatggagtaattaggtacggatacattttaactgtgaggggaaacatttagtatggtttattgagtgtgttcattctgtggttttttttgtgcaatgcagaggaagaaatgtctctgcccccaatgagccccagactaatggggaattaggatacatataggaaacatatagaaggaaaaaaaaattgagtgaatggaaatcaacatagtaaaaactctgtttaagtgccaagaggtgtgtttataggatgtgttttaggttctattatttctgaagacagctgggctgggatcacattgatgatgtgagttctcagtaaagatgtgtccaagagtcattgcaatatgcaggctcagtatgcttgtctgtaagtcctgtggctatgtctgt

SEQ ID NO: 69917 - DNA, 1037 bp, Homo sapiens
gatgaggtgaaggaagtgctgcaggccctggaggagctggctgtgaactatgaccagaagtcccaggaggtggaggagaagagccagcagaaccagcttctggtggatgagctgtctcagaaggtggtaagtggtgtgccaatggtccaacagctccctgaccacagaacatctcccatgtcgaggggacctctgcatccttccagggctgtatggtggctgcacctctgcactgctgttcagtgcattgtgagtccctccccaaccctgtcactgcactttcccctcacagtccctctgtctttcagactcttctgcagggcctgtgttctcttcatagcagccctcagggtcttgcatgaagggagaggcctctgcctgggctgggcaagggagcaggaggatggcaacaggaatgacctgaggggctgtccccaggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctggtgagtggtgagagacagcagccttgttcaggctgggcactagtggaagacgcaagatgagccatccaggccttcacagatactgagaaaggcagccagagagccaggaaacatgcctttgaactagacccaggaagacaggtagaggcttgtatagacccaattgaaaagatacattctaggttgggcgcagtggctcaccgctgtaatcccagcactttgggaggccgaggcaggcggatcacttgaggtcaggagttcgagacctgacctcgccaacatggcgaaaccctgtctctactaaaaatacaaaaattagccaggcgtggtgatgtgcacctgtaattccagctactcaggagactgaggcaggagaatcgcttcaacctgggaggtagaggttgcagtgaactgagatcacaccactgcactctagcctgggttatagagtg

SEQ ID NO: 69918 - DNA, 1027 bp, Homo sapiens
ctgcagatggagagtcaccgggaggcccatcaccggcagctggcccggctccgggacgagatcaacgagaagcagaagaccattgatgagctcaaagagtaagggttcccaagggcgactccagcccctcccgggtcctgtcaccttgctgtattgactcacatgtcccctctgggtctgattctttaacatccatgtgtcattccctcaacaatgccacaacttcgtagccccacctcaggagacacatggaataacgactagtccctatccttgagggtcccaggattagagaggtcagggttcctggctctgtcatggaaacagtggcctgagtctgcctctggtatctgaaggtggacacatcaattctaactggactcactcgttcaaaaaggaagaagtttgaagagctggccttcccttccccctcattaacatctttctcccccatctccattaccttctgatgctctgtagcctaaatcagaagctccagttagagctagagaagcttcaggctgactacgagaagctgaagagcgaagaacacgagaagagcaccaagctgcaggagctgacgtgagtggcatggatttacctgtaaaactacagccttgtaggctcagaactgtgaactcagacacgcttgcagaggcaggacacacatgcagacatgatagggtgactcatgggaaaaatatgatggggtagggacgggaccaaaaggacactctcagcaaagactgccgttgagtattcaccagtatggaaggaggtttacgtgttctattcagtgtaaaaacaggttacaaaaccatatgcatggtatgatcccataaaaatgtatacatggatatgtaggcatagaaaaaagtctagaaaggtggacaccagaaggttaatgttggtttgatctgtaaatagtagaatcataggctttttataaaaactcaccttatgtctctctttaaaattcttttctaatttttgcacagtaaacatgagtaacttgtgtaataaataa

SEQ ID NO: 69919 - DNA, 1079 bp, Homo sapiens
cccctctttttcctcctctgtccccaggtgctctcctctagcagcacaggaaccttctttgttcttgtgtgtcactgggtttctcaccaaggttgctttagggcccagaagtggcacagagaacatggccagtctcttactgggctgcatctaagctgagccctctccaggggtttcccagaatagtaaaccaggcacacacaggcagaaaagtctgagaagcagagaagtaggaatgcagaagaggagttggggagacctaggggtggaggtgcaagcctgggtcacggggggcggtggtaggggggtctgcttgttggtattaaaggaacaggacagtaaaccaaagtgtgtgcagatgccacctgttcctgttctgtgactgagctacaagctgggccctcacaccctctttctctttctttcccagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggact

SEQ ID NO: 69920 - DNA, 1109 bp, Homo sapiens
gaaggctgatggaggtagggctgcctctcatatgtaccttccaggtgattcatccattccctgtgggatgcttaacagggagggttttcccttgttaaggattgggggagttacatgtaagacctacctcagcttcactaggtatatatactttagccccagcaccccaccctctgccaacacacatctacttcaagtgtttggaatggagaaattccttgaacatatgtcttagtgatgattcagcttgcttagcaggtggggaggagggggcaggaggagctatagctgaattttaggctgggagtctcaagtggctttttttttttttttaatctggagggatatgttctgtcctccttttctactgagaacgggaggagttggttgcactgcagtgtgtgtgatttaggttagactgcagttcatagcctctgtggaatgatctagtaaggataggcaaggcattcatttattcaattaatagacatgtcaggatcactgtgtgccaaacattgtgctagttagacacctgaaagatgcagacgactagaatgagcccttgttcttgaagagctcacaatctagatgggagaacttacataaactagtgattagagtcatgcagtaacaaaggcaggtgaaaggtactgtagcaacaccaaggagaaagcacggctcaggatttttaagtactagagctccctttctaccctgaattagcagactgcagatcctgggggccgaggagagcatgtgatgcttgtgtcctttgggctgtggattagtttggctttagggaacagacgcctaatgagctcatatcctctgattgcctgcattcgctctgaaatcagctgctcttcctttaccttacaccttagacaggtgggggcctactgcaaacaactgggtcagagtggtctaggaagactggtcctgtttgcaaagagatgccttttgcaggatatggacatttatcctttttgctgtggttggccccacagaatcccattaacactcttgtgcatttttaaaatgcctttttttttctttttctaatggaacatgtagctgccttgagcttgcagagtttttttttttttttt

SEQ ID NO: 69921 - DNA, 1003 bp, Homo sapiens
aaaaaattagccaggcatggtggcgcatgcctgtagtcccagctacttgggaggctgaggcaggagaattgcttgaacccgggggatggaggttgtggtgagccgagattgcaccactgcagtccaacctggcaacagagtgagactctgtctcaaaaaataataataacaaataaaaattaaaaaaaaaggacctcacagggttttatgagaatcaaatgaggtaatatgtctgaaggtactttataaactaccaagtgtatgtaaatgtaatattgtttgttttcttactttgaaaacctgaatttcagggaaaatctgcccagtcatttcaagttcaaggagtattgtccccaggtcttcaggaacctccgtgatcgatttggcattgatgaccaagattacttggtgagagtccattaaggggtgagggtagccctttctccccagcaactgaggagtactatttgggacagccatatttggagaaatgagagtcttggcaaatataattctttacctttttgtgattgcagcattttcaaaaatttaatgaaaattataaaccttgtccttgggggaaaagatgtagatacattaagaattttggccaggcgctgtggctcacgcctgtaatcccaacactttgggaggccgaggcgggcagatcacctgaggtcaggagttcgagaccatcctggccaacatggcaaaaccctgtctctactaaagatatgaaaattagccaggtgtggtggcgcacgtctagtccccgctacttgggaggctgaggcaggagaatcacctgaacttgggaggcgaaggttgcaatgagctgagatcgtaccactacactccagcctgggtgacagagcgagactccttgtcaaaaaaaaaaaaaaaaaagaattttgcattcagtttccttcagtccacatatggacacctgatgaggaactgtgctgaatctcctaccccagggattcatccactttcagctgac

SEQ ID NO: 69922 - DNA, 1007 bp, Homo sapiens
gttttgcaaggggcgtgatatatttgttatttagaaatatttagaaaatgtgacagcgttttagagaatggattggtgggagggaacactggaagggtggataccagttaggaggtaattttaatagtccagggtagaaacaatgaaggcctgggggagcgatggtggtggggatagaaaggaagacctatgggagaactgagagttaagacacaggggcctccaagttcctggttagggataactgggtgcctattcaccagaaattagaaacagaggaacaggtttttggaggaagaaagttctgatttggacatactgaatttgaggtttctgcaattcatccagatgaggatgtccagtaagtggttggggtatgtgtacagaattcaggaaagaggattagactgggagtataggtttgagaattatatgtgagtaagtgatcattaaaaccatggctatagatacgattattgtagggaggttgtgtgcagtgaaatgaaaagaaggttgaggacagaacctaaaggaacaagtgaagaaatgagcccataaaggaaactaagagtagatggacacttttaattatttatgccatgctacattccatacgggattcgacgacagagaggaggggaatcaggagggtggtataataagagctgaggatgaggagacttttaaggagagactggtcaataggatcaagtgccacaaagctgaaatatgacaatgactagaatacttactagatttgacaactgagggatatgggggagatttcagaggagaaatgaggtataaacctgatttcagtgattcaacgtgtgaatgagagacaggaaatggatttcttgctgattactttcctgagaaggttggctgtgaagagaaagaggcagcaacacagaaagagagatggtaagcactgaaggagtaatttttgttttttagagacaggatctcactgtgttccccgggctggtctcaaactcctgggctca

SEQ ID NO: 69923 - DNA, 1031 bp, Homo sapiens
cctgggaggaggcgggggttacagtgagcctagattgtgccactgcacttcagcctgggcaacagagtgagactccatctccaaaaaaaaaaaaaaaaaaaatccaaattgtaggccatcatgcagacttttttttttttttaggtataaaaatctgtatttatattacagtgacagaatgacacagcacagcccaacccaatgcagacattttaaattatgggaatctagcctatgaagaaacactgctctagataaaatgatttcattgataagatataagttgtaatcctggttctgtgccacttgcatatagaaagggtctaaaataaggataataacacttaaccttcctcatctcaaagaatgataaaggtgaattgagagatgacacttaaaaattaagagatgtacaaatggaaggaatcagaggaaagggggattcagaaacggcatggataacctggagtgttttggggaagcttccaccacttttgactttgtaatctctctacttgaagtcctctgctctaccctggaatggcagtgtttgaacttccctgggctgtttgtgtatctgctactcagcctctccccattccttccccctctttcactgtagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaaggtaagaagagggtagctcggacttagagggaggctcctgatagcctgagaatggggaagaccctgggaggtctttggatgattccttttaagggaaagaaggctgggtttgagtactcatcttaggggctgggttctgactgttcttttagccacttctactgacttggtgtttgggtctttctgcagggttccctagtgtcccgggaagccagcgataaggaaaaggtgatagtaattttatgtgctagggtgagggatga

SEQ ID NO: 69924 - DNA, 1004 bp, Homo sapiens
tagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctt

SEQ ID NO: 69925 - DNA, 1068 bp, Homo sapiens
gagactggttccttgtccggcctgggttgccacagaggaatcacagacccaccctaaactggggccccgcctcccttttctgtgccagcaggacttggacctaggacacctaggtcctgggtcccccgtgatggggagagaagtgttgcatcgcggatagactgtatgggctgagactctagggttccattttcacttatgaatctcgaggtgcatctggccttgggggacgatgatggaggcatgaagggacagctgctccttcttggatcagtcaataaatggaggtcacactaatggcccttctttctgtttgagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaaggtgacaatgagaactttgttattgcaggggctgctgccactttgttcacatccttaacagacttcagcagaagggactgagttagctctcaaggaaggctccctggcaataggggctgaattatttggcaatgtggagcaggcgaggagttggggagcataggaaatattccggtccatgtgatctgagggaggtggcaagaagacctccacctgtgtgggcgttttctttcctgacttctcttatgtgtgccctaggctttcttgggggcctcagagctggggaagaaaggaggaaggttagcatgttgaagttccttcttgagcaacttggggagaagctgataatggaattctgcagagaagagaggagatggaaggggagtttttatttctgggttggctgaggggaatggtaacatttgccatcataactttttacccttcccccactcccagtcctggtcagctgagtggaaatagaaggatttctgctgccatcatcttccatgggctttccaggtatctcccccgcaagggatcctcaattttcacccttaaactggtttccttcattccatgttccaagt

SEQ ID NO: 69926 - DNA, 1478 bp, Homo sapiens
cactttccttccatttttccgccctaccaggtcacacgacctacaagtagggagcagggaaagaagagtgagcctgcatgccaattctaagctcttcaggatcaaagtaagcaaaaaggaggggcaaagagtctccctcccctttaaacagcccatttttccccaagaggtgggaggggcaagttgtttctatgatctgggagaaatgacaggagaaacaagactgatacttggcttagatgataatatagctctggaaacttttttgctcttcagtgggttttgggtttggaagataaggggagacagaatatgaatttgggtgaagggttggggattaggctttgagaaaacagaggtaatagagggtttggaaggaacctgaagtaggaggcactgatacttgtcaaatggggaccccccaccctgagtccctttcaccctgggggcagtgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggtaagaagaccatggcctgcccttaccctttggctttccccaagctctgacctaggaaaaccgggtgagggtgagtgtgcttgttagatgtgagacagtcttgctgtcttccactgtgccctcctactcagtgccctggacctaggaggtccccgtgaggcccagcctttccatccctgtgatcccaaggcacacgtgaaaatcagatatgagctaggaaaaaaaaaagcaaatcagatatgagaggaaggaattgcatattatttccttgatgaac

SEQ ID NO: 69927 - DNA, 1703 bp, Homo sapiens
gttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtgcgacccctcttcatttcctttcccttggctcctcccctttgttccatttccactgagggacccaccaacccctcgctcacggagcctcctaactggagagaaccacttccaaactgttcagccatctcagtttctcctacattcaacctggtcctggtgtgcccagcttagcctacaaaaataagcagaactgggctaaattatcttggatttggaggtgtcctcccttaggggaggtggggaggtgtctgagccacctagaatgagggtgagcatggggataatagcaagttcaaacagctaacaaccctcaccctcatttctctttgctcccaggtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactctttatgccacacccgttcttttccagggactgggtgggggtggggtggggagagggacctgctggaaaggggagaggggatgatggggtgatccctgcgtgcactcccagtccctctgcctcctgaggacctggggaaacgggatgcaccagcgggctctgtagtaacactgagaaaccctgggtcacttcgatgttggaattagtattaagagggtgtttttttgttgttcaactatggttgtagagaaaacaaccctagccactctgcgaagtttggctggggtgggagtgggggcggagccgggcagggggcggattccgcagcagcaactccccggacgcgcgcaggcctcaaagccccccagcttcagtgccccctcgaccctgaaacttggagcagggtgggggttcagtatgaagcccccggaccgccccgcccct

SEQ ID NO: 69928 - DNA, 1783 bp, Homo sapiens
tgttggggaggtgggctgcagaagtcttttctttttatagtgattactgcaattggtggaggaggggactgggagtggcagatggacccagctcatcctcccctcttcccagagaatggtctgtacccattgaaagagggagggttgtaggagagcagatggccacccccagcttccaatgtctgcccagatggctgcccccacccccatatctatgctatgctcaggatatggggaacctccacatgtaactgggggttccaggcctggagagccaggcgtttaccttactgtgctttctcccaggggtgccctggtgaaattttctatcctggccaactcaaatgaggatggcaagagagtgagcccttggagagagaggctgagcatcatgaagagaagaccctgggagttccctggggaccctgagtctggagctggggcaaggtctatcacctcctctctttttcctcccattagaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgaggtgagcagggaacggcaccaaagcatgtgggacatctatgaaggacactggcagagagggcaagttggggccacccagctactgtccccgacctctgacacttgatttctggcccccagaactggatgttggagccagctctagccacaggagaggagctgccggaactgaccttgctgaccacactgttggagggccctggagataagacgcaggtgtgaggacaggctctggggaggctcctttcactcaaggggcattcgtttgctcaccctaggatgttctttccttccagccacctgaagaggagactttgtcccaagcccctgagagtgaggaggaacagaagaagaaggctctggaaaggagtatgtaagtgtccacagcccttccctgcagttgcacaacttccagaagactgtccctcacattttagatggaatttcctccaaggttggctatgatgataaaggggaggagggaggaacgggctgaaccaaggatgagctccgacgctgaagtgggggcctcctcctgctttcatcctaggtatgtcctgagtgaactggtagaaacagagaaaatgtacgtggacgacttggggcagattgtggaggtagctccctttaccccttcccagcccctcctgcctgcttttccatctgcccagggctattttcaggaggtgcctgggcgctcctctgtcccacctctcaagcctccccactcctggaccttcctactctgggggcagggcggctcccaccagggagggggaggtggaacacaccctggatttgtgtacaggagcaccattaaggtggggagagggccaccacatgctcatgacccaacctcaactttcccacagggttatatggccaccatggctgctcagggggtccccgagagtcttcgaggccgtgacaggattgtgtttgggaatatccagcaaatctatgagtggcaccgagagtgagtggtggaactctgacagctaggtgctggagaggggccctcatctggttgtcctgtatcctaacatcagcccattgcgacttaaggaatgtttggagaagttttgtagg

SEQ ID NO: 69929 - DNA, 1067 bp, Homo sapiens
gtgcaaagcggcaagggtcaccttggaggttcccctccagtcccaggcagctcacctgaattggcagataggagacagcccccagattcctcaggccctccctggctcctctgagacatcctctcagaggcctcatgccctctctctctccaagccctccctcgtggccttctccccaccttaatgctgttcttgtatacatatccaggctgtgttccacctctcactcctcctcccagggcttcactgaagatgatgatttgctcaaagaggaagacgcgcctctctcgacctcgggaagacagcagccctccagcctcaggctcggtgacccagaaagtgtcctggcccaagagcttcccctgagcagtcagtttgccctgaaaccaaaaggatagtggccttggaaaaagaacaagaaaaaggacaattctctgctcctcccttcctcgcctgacatgcccaaccaaccatggggtcagccccaggagaagacaactccccataaggacctcctgaatgctagggctggggcagaagagcatcgggcctccagtttcttgccctatctccgtacctcaaatccccgcaatctccccagcgtcatcatatcgttgcagcgcttgggcacaaagcacatgacctccacagcttgctgggacacaggtgagggaggcgcattgttgggcgaagagagtcattattgggaaagaggcctcctcggccagttgcctcttcagacggtatctcaaccccaaccagcctccccctaaaaaccagacagctgtaaaccacccaaggggctgggggaacccatgagatactaggaggataaggagcacatggtgtgtcctggaagatctggggtcctcacctctaggtctgcagtatccatcccagctctattgtaatacttgagaaaatcctaagacagagagaagaaatgctcagggaggtcacgaggacacccttagaagctctcacatcctcccctgaggacaccagtgagggccctcaggaagtctgggggagccctaagaaccctggggagatgaatgaggaaacag

SEQ ID NO: 69930 - DNA, 1073 bp, Homo sapiens
acgaatagagctccctcattgtagggataaaaaggggagagcctctcttgttctgggaccccaagttccctccccatatcattccttccttttatctggtccttcctacttcccatcccttacgcttctcccctctattttaactctggagaagctgatagtctcagacagtctaagatatctagcaagaggaggtggcttggctagggacttaaactgaaaagagagaagtgagggtagatttctggcctttttgatcctctgacttgaatcttttcttcaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatcaccgaggctgctgtcttggcagagggaaggggaggctgtagtgggggtaggtggggtgaagtgatatggaagagatcggttggccccagccattggaggagggggtctggtgaaaggagaaggggacagggtgtaagataaaagatgttgctatctttgtccctcaactgcagttgcagcagttgagggacaaagactgaggcatggaaccactggaaagcccttagattcttcttcttccctttttttttttgtagagttagggtctcactatgtagcccagggtcttgaactcctgggctcaagtgatccaccagtcttgccctcccaa

SEQ ID NO: 69931 - DNA, 1164 bp, Homo sapiens
acccctgctctactcccagggcttcccctagttcagaccacagtcggtgcaacccatctggcgtttatttaacctctgggagtaggggtaggtttttcgattttcaaagcacaagtatattgactccatttacacaagagtaagactgagacccagggagttgatttacatgctcagggtccttagaaacaagcctttgcacacacactttccacaccctaaatttgagagttctcccttaccagtcggccttctgcaccctcaggatccctcactgtgtactcccctccacccccagaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtgatggcccgctggggatttctgactgtcaggctgggcctgcctccttgtccctgccaggaatttccaacaaaccccaccaccctgtgagcactctactggctgtccctgagcctctagttcctcactcttccttttcagaacctgatgcccagtaggggttgtcctggtgacacccctcctttttccagtgcccagaggcctggtggagccataacctctcccacagccagtgccaagtcctccccctgcccattctcatggggcaggaaatggggggatcactttccaagtgccaaagagcccagagggactctaagaacctaaggtggaaacactgtcctctcatcttgggaccgagggggtggggaagttccccaacacataatcccaagactgtgcccctcatctgcatcttcagatccagtactctgtgtacctgctccagccccacccccacagagagaacttgtggctctggggctggggtgagggctggtggttggtgaaagccattcttagttgtgtctctgcaatgctgtgggcacaaaagaaggggcaccagagtccctgtgcaaacacctagactcacttcatggattccaaagctctcagcttcattttattagttacgttaggtaagggggttcaa

SEQ ID NO: 69932 - DNA, 1228 bp, Homo sapiens
cactctctctataaacattgaaatgtctttaaagtcccaacatatggaggaggagaccacacttttccaacctgcttcttcaaacagaactttgttggtgcaggtggcctgattttggctttagaaaacatttgttttcctataggtgacgggcagaattattgggtagggcgggaagatggaaggctgcaattggtggagggagctctacaggctgaactgggaggggcggggcacacatttttttgagccctggctcatatacatgttgagatggaagagctgccaaagccaactgatgttttagggggagatgacccccacacccctaaccctggagtcacgcctctgctttgtgtttccctgtgtgtctccccctctaagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcaggtgggccctggagggcggctggacccagtgctgtcggaagggcaagctgccggaagtggaggggctgggaccagtggggcagggggcctgccctgaggctcccaaccatcctctcctctcactgcatactgctcctttccagggaaaattgagatcaaaattgtccgcccatgggctgaagggactgaagagggtgcacgttggctgactgatgaggacacgagaaacctcaaggagatcttcttcaatatcttggtaagaggcttctacccccgagtcctggcccccagccctcctggagtggaggtgcgggcttgccccagccacgccattgctgagcttccatttcctgatctgtaagacaaggctggggttccagtggctcagagtgctgccatgcaggaagagcccctcaggacatgggtgtcctcattccctgccttcccccagctgcctggcccaggacttccctgggctcaacggccagtagctccagcccacctctaccctctcccaccaggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatcc

SEQ ID NO: 69933 - DNA, 1127 bp, Homo sapiens
actcagaggctcccagactctgccagggccaggaaatgcttttccagcactcccctgtgtcgagctggtgggacttggtctggatgcctgttctgctggtgcctatctccacctgttgcttgcatcctggtttcttgctgcagagtgggcagtccagccatgacccatgggcacccaaccttttcctagttcacaagctggtgtcctcccaccagttcagggttctatggatttgcagggcagggtgattgtcgctcgcgcctgggtctcagctatgtagaccttgtcaggaagcaccactcagcagctctggagtattccttgaggacacacacacacacacacacacacacacagctcacccagctaggtgtgtgaactgggcccagtactcagaaagggcttatgtactcccattccacctggtcacagaaaagatgatctctcacaccccatccccagtggacccagcctgagggcccagtgcaaggataagggaattgtgaaaaatcgaacaaggtggggctccttgttcaatcctgcccctttcctgtcccctcagacaggatcagtgcttcctcccctcgggtggtgggagatgctcgtgccagagctctgtgcgcggacatgaaacgctgcagctactatgagacttgtgcaacctatgggctcaatgtggatcgggtcttccaggagggtgagtgtagtgatctccagcatatgtgggaagccagagcaaggggcctgggatattctcagtggtcaggcatccaggcctctctctgtgagtgacaggaaattagcctttgtgggagggaggagagatcagggaggccagagaaggtttgcttaatagtcgcaaggtctttctgggctggaggagctggcaaggccacaggtggcatggaggccacagtgacaaggaagttgggtcctgtgttgtctactggggatttctcaaagctgggcatggaagggtggtcttgggtatctggcctgctcacacctccttccgtcaactcccctcagtggcccagaaggtggtgaccttgcgcaagcagcaacagcttctggctgcctgcaagtccctgcccagctccccaagccactcagctgcatccactccg

SEQ ID NO: 69934 - DNA, 2060 bp, Homo sapiens
gggccctccttctacgggcggagccctttttgcccagctctcagagcggccccctacccgcccctcccgccgtctccccttcacctaagttcctccagagccgtctccctgggaattagccctctcctaactccgaccacagaaagctcagctttcaacctaagcttttggagtttaggctgtagtccctaagagagtctctagaaaccctgcccctagttttaagtttcgcccaatgaaaaaacaaaaggagagggacagaaggcgggtcggtgacgtaatgcgggttgattggcatgcaggccttggacgtccaggattagccacgcatttcgccaatccagaggcaggggagggacggtgcaggcgcagagtattgggtttggctggcctcgatttaaagagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatggtgaggttttggaggtgggggaagcttcaaggcggaaaggccccgtggggagaatctctagggtacttccggtggggagaggggtgtatgggggttccgggaagattcccaggaacttccggcgacgagggaattcctggggacttccgtgggagagaggagacttccggttgattaagggggtttgtctgagggtgggggaatgaactgaaggccgtgggcgtaagttccatacctccttcctgtgaacctcagtttcttccaaactggaagtgataggatgatcctgagggttcatcttttgcattcatactaccatccctgccaccccctccccgccatcctagccattctaacctttgggagtgcctagggatgctcccggtgcggatagcaccatccccagctcccattcacacactattccattattccttccccctgccccgctcccaagtcctcttgtatggccttgggctgtgccgcatgctagaattgttgagatgtatcctgctctttcttcgtagctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttctttgtatcctgacctgaagtgatgggggcaaccgggggcttgggagggctgtcatctaaggaagatgttagaagggtaggggacctcagggatcttggacacgtctccttgccctgccctgtcccataatctacgaaacaagagctgattttattgctttcaatttgacatggtggtgtaagttctatgaacagatgagaccagacagttattatagatgaaacataaaggaatctaggacttttttccataacctttcctctcagtacatgatcatccttggtttggtcttcatcttccaatttgtaatctcttgctcatgtctggctattaaccgaagcaaacaggtaagacagtaccctttcaagtacttacttgctttttaaaattttcctcttaacctcgaactccttccttagtctggccccaactacccaaagatcatccttaggtgcactgcttctggcctcttgggctatttgcttcctctgggatgtctggttaattttccatgaggatgatctagagaacctcaaaaggtagatatttatcgtgtctataattgttgcacaccgttatgcttctgtttgacttcctttgctgggctagggaaattgaggcacttgaactgataacaggatgtagggagacttaatttccctctacccatatctttcagacagatgtcatcaatgcttcttggtgggtcatgagcaacaagactcgggatgaactggaaagaagttttgattgttgtggcttattcaacctcacaaccctgtatcaacaagattatgatttctgcactgcagtg

SEQ ID NO: 69935 - DNA, 1057 bp, Homo sapiens
gctggagtcattcttagctgtttcccttcctctgtccatatactggatcacctcaacataccctggtgtggctctaagggtaaatcagggatagggccaaggagaaaacaaccaagaactctttcctgtaataagcaggatccagtttgagaaagtttagcgaatataaaagtaaaagccatttaaaaatctatattctttttttttttttgacacagagtcttgctctgttgcccaggctggagtgcaatggcatgatctcggctcaccgcaacctctgcctcccgggttcaagcgatcctcctgcctcagtctcccaagtagctgggattacaggtgtgcaccaccacgcctgactaattttgtatttttagtagagacagggtttcaccatgttagtcaggctggtctcgaactcctgacctcaggtgatccacccgcgttggcctcccaacgtgctgggattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaaaaagaccattatttctttgttttgtttttcctgtataaaaaaggaccccaaatataaaggtagggaaagggacaagagggaacataccccttagtgtagagaaatgggaaggagaaggagaagcctcaaaaggagaggtgggaggggaatgtcattaaggcagcaaagtaatctctgtagaaagatggaggaggaccctccatagcctcagagataaaggcaaagattgccctctcagtgtccagaagggaaatggcagcttttcttccttccatggcagccactccattgctcactccggattaccttcatccttatgtagataagagtgctgcagagctcgaaaggcagagattcgcttgtgtgggttaaaa

SEQ ID NO: 69936 - DNA, 3516 bp, Homo sapiens
aaatggctttagattttagacaaattctcacaaatgagacactaaccgctttcctcctttactcccatacccccaaagggctgggagataaagaccttggagccaataaaacaaagtaggagaaatctacttgtgtctacctaggtgtctgggcagaggccatttgggaacaagtgtgttctggacagtgctaagtgctaagaaagcggcactagggaaaaagagggaagcacaataactccaaatgagtagtcacaaggtttgcagaagggggcatgtcattttcattcattgtggtggtctggagggtgcagggggtgtggtggtaactttcttgcacatgtgcaatcctgtatccgtcttatatatgatgtgataaataatatcatatacatacatatatacatagaagcatatatgcacacatacaaatatcacataatcatagaaccttcctactggaaaaaaaaaaaaaacttaaaaggtcaagtattcctgtctcctgctcatcaataacttctctgccagatggcctcaggtctttgcattaacactcccagggaggtttggaagttggaaaagtgagaggattaccttgtcactgagcctgttggattactgtattaatctgccttccgtcatcctttaatcgtagttttgccctcaaatgggcattgtttactccctattgtagaagaccccattgttggctacatctttatagatagtcgtaccactactttaaagggccagtgacagacaccaaaaacaaaataaaaacccacatacacactggaagcaagcactcagtaaaatgttgtagaattaatgaatgaaacaatgacacaaatgagagtatgttttctcatggtggagcgaaaaggtgacagcatcacctctggtaccccaactcccaccccctccccaatgcagacaggctgaaagaccggtagtgagactggagttcagccttcagaccggtagtgagacaatccttcagccgggagttgggctctgggtggcctaggttgccatggcaccgcctcgggctccaccctctcttgtccccctcaccgctccccccctgcagcgggggttgtggcagccagtcacgtgcccgccgcgtagccacacctctgctcctcagagcaatgtcaagcggtcacgtgtgatagcaacagatcacgtggctgccatcgcccctccgcccccttacactcttcgccctcctcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggtaagtgcagtcccttcccaggaatgagaaccagtgcccgcccccctcacagctttccacgcgttcgtttcgcgagctggttatggaagggtcgctcaagggcgggaagtggggcctttgtggtcatgggaaagtataattttagggactgaggtgtaggatcttcgatgcaaggcatgtgtcatgtgtgatctttgtgcggggcgcgattgtcccaaaggaaaaagcgttttctattgcagggcctcacgtggctggaggggttggtattgagtcattgtgttatctctggggccggccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggtgagaaggtggtggagggttgggcgtggggagtaaagggaaaagacagcctataggtggggtgtgatgatctgtagagaagtggggaccctgaggaaataatgagaggccatgttgggttaaaggggattgaaaagtgagcatttactctggtcaggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggtgagtggggttggtaggcattgagaggtggattgggacctttgtagtagaaccttctgggatttcaggtatggtgcctagtttccagtgcatctgtacctcccctttgaaactaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggtcagtagaaagatggtaccaaaatgggttctggttgggagtaggagagtgattgcccgtagcaattgagaagtcatgtgcttcatgtgttcagtcaagcaagttgtgtttcatggtaacccatggggtccccatccattcttcctattccctttaggttgttacactctggtaccgagctcccgaagttcttctgcagtccacatatgcaacacctgtggacatgtggagtgttggctgtatctttgcagagatgtttcgtcgaaagtatgggacccacataccctggactaccttgaattccccaaatcgcttgttcataaaccacatccataccttgcccattctttttttttgagaccagggcttgctgtgttgcccaggctggattgcaatggcatgatcacagctcactgcagcttcaacctcctgggctcaagtgatcctcccatctcagcttcccaactagctgacactacaggcacgcacctccatgcttggctagtttgttaatatttttatagagatggggtctcagtatattgcccaggctggtcttgaactcttgcactcaagcaatcctcccacccctacctcccaaagtagcataagctactgcatctggccccattcttttacttgcgtactactaacttgcccatagcagaaagctctgaaatgttctggaattaggaacttcatatccctttattctctttattttttatttatttatttatttatttatt

SEQ ID NO: 69937 - DNA, 1133 bp, Homo sapiens
ggcaacacagcaagccctggtctcaaaaaaaaagaatgggcaaggtatggatgtggtttatgaacaagcgatttggggaattcaaggtagtccagggtatgtgggtcccatactttcgacgaaacatctctgcaaagatacagccaacactccacatgtccacaggtgttgcatatgtggactgcagaagaacttcgggagctcggtaccagagtgtaacaacctaaagggaataggaagaatggatggggaccccatgggttaccatgaaacacaacttgcttgactgaacacatgaagcacatgacttctcaattgctacgggcaatcactctcctactcccaaccagaacccattttggtaccatctttctactgaccacgggtgtaagtgccatctggtagctgtagattctggccaggccaaagtcagccagcttgactgttccaccacttgtcaccagaatgttctctggcttcagatctcggtgaacgatgcaattggcatgaaggaaatctaggcctcttagaaactggcgcatcagatcctagtttcaaaggggaggtacagatgcactggaaactaggcaccatacctgaaatcccagaaggttctactacaaaggtcccaatccacctctcaatgcctaccaaccccactcaccttgatcgtttcggctggcaagcctggtgggggtgccttgtccagatatgtccttaggtcctggtctacatgctcaaacaccagggttaccttgatctcccggtcagttcgggatgtggcacagacgtccatcagcctgaccagagtaaatgctcacttttcaatcccctttaacccaacatggcctctcattatttcctcagggtccccacttctctacagatcatcacaccccacctataggctgtcttttccctttactccccacgcccaaccctccaccaccttctcaccggacaacattgggatgctcaaaagcctccagtcgcctcagtaaagccacctcacgaactgtgctgatgggaaggcctcctccacctcctcctccattggggactctcacactcttgagggccacaaagtggccactgtggggatcacgggccttgtacactgtcccataggcacc

SEQ ID NO: 69938 - DNA, 1021 bp, Homo sapiens
ttcctggaggagctgaaagatggggaattcctgaggatgggcctaaaggggctgggctcactggtagaagtgggaatatcagagactgactagtgtagcttggtcacctagtccctactaaaaagccttatagcctttcctaggatgagactttgaggctcctagacaaaggcactctcccaggaggaaaatcttaggccctccctcccatgagggtcattgcaacatgagacccaagggagttgtgaagtcagccccagccccgcctactgttcctgggtgctaatccccagcacagaccactcaggaggagggattggctgaggagcttggagagggggcgtcatcacctcacccaaaggttaaataggggttgagatatgatgctcaggagaagcgctttctttcgcgagcaccctgaaccagaccatgacccagaccctcaagtacgcctccagagtgttccatcgcgtccgctgggcgcccgagttgggcgcctccctaggctaccgagagtaccactcagcacgccggagcttggcagacatcccaggcccctctacgcccagctttctggccgaacttttctgcaagggggggctgtcgaggctacacgagctgcaggtaggaagggacgcctttcccgagacagagtgctggggaaactggttttgacagcgtcagaaaggactgactagtgcagagcaaatgtgggacagccagagagaacggatgcccatgaaataaggaaaaggcgagttgaggctgggggcggtgtggctacactcgggcagagcccgtcccgactcttagcagagggcgctgcgaaagcgccttctcgctgtcctgaggtgtggagatcctgcagataaagtacaagtgcgcgggagggggaggccggagtgggcagtaccctccgcctgcttgcggcttaaagctacatgggttccttttcattcactgaggactcgtcctgagatggacagtccagacatggaacttttagagatttctcctcgac

SEQ ID NO: 69939 - DNA, 1436 bp, Homo sapiens
tgtgtctgtctcacagctgacaaagatgttcttcctcttccccgacccacatttcaagcggacaaagcacaagtggcgaatcatcagtcccaccctgctagcagaatatgcctacgtgctaagagttggggtgagttgggatcggagggatgatggggtgagtggcctactcaggggcccttcactaagaattcagtgggggtgcatttagggactcacaccaccacttccttcatctggctgctgacgttgcatgcagcctcctgtctagggtgattttgcctatgcaggggctggtgtataccataaccgatgtgctggagctacacgactggatgtgcactcatttcgaagagcacccactgtttgagcgtgtgcctctggaggacctggtgagtaggggacctagaggaggtggaggccctttccagagtggttctgtatttggacttaactcagtgccaggaggatgggataggtgtctaagggccaggggcagtctgaacagtgggcaaggacttattggacccttccttctcccagagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccctaagtgttgtctctggagagtccttgggaaggtgtgggggtggagaccctctcctttttcacattgaccttcaattccagaacttcagagctagctgactggcacagagcctgatagagttgcagtggggaatgagggagtaaggagcagagaggtaaactgtgggagattcttttattttaattttttttagagacaggccctctctctgttgc

SEQ ID NO: 69940 - DNA, 1050 bp, Homo sapiens
aacactcaggccctctttttggggtgagaagaggcctagtagcttctgctgcctcagcaacttttgtggggggtcataattggcctttcccctttcgtccagacactggtgacatcagcatggagaggctccacctaccctctactctgggtctgtgacctttgccctggagagtggagggggctgcctcaaatgcttcttaaaacctgggttgtcctttctggcgtcaatccctacatgagccatttcatctgccaggttccgggtcagtgagctggtcagcacaagcatcagagattagccgttgtggccagtgatcctgaactgtcttttctcagagattctaccatctcccctcccctttgcccctccctcgccagatctcattccttctgccccactctcctgttttttgggttcctcttgtattgtctgtattgtcccacccatgcatgccaagccactccctatttttagatcttcccaaacagataacagcctgatagagaagaagagcatggtacatagaggcagaaaaccttggtttaaggtccagttctgcctgggcacagtggctcacacctgtaatcccaacactttgggaggctgaggcaggtggaccacttgaggccaggagttcaagaccagctactcaggaggctgaggcaggagaattacttgaacctgggaggcagagattgcagtgagccaagattgtgccactgcactccagcctgggtgacagagcaagactccatctcaaataaataagttccagttctgccccttcttaactctatgatcttcggcatatctgaccctcagtttccttatcttcacaatttaccacagagtgttataaggatgaaataacacaatgtgtgaaaacactgtggaaaactctaaagcaatggcaaatatacatgtatcctcagccctcccattctggtcctggtgacaattttcatttctccccccgcctcttgagcataaaactatccatatatgtatctctgtcctctcttgccgttctggactttggtagttgca

SEQ ID NO: 69941 - DNA, 1040 bp, Homo sapiens
tttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacccaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtatttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactc

SEQ ID NO: 69942 - DNA, 1072 bp, Homo sapiens
tttcctctcaatttacaggcagagatctggctccacaaggaggcccagaaggagggctggagcaaagctgccaagctccaagggaggaagaccaaagaaggcctgattgggctgttgcaggaaggaaacacaactgtattagtagaggtgagttgttggaaattccagataccaagaacagctgtcccttgggtgtaaagcttgtagtaggccctaaaggggcctgttcttgaagaagagatctgtttaagaaccataaagcgtagttgaagttaaactcatgaaaccctgggtattagttacgaattcgtttaagtatagaaatgtactggtgtgttgatgagaaatggcctgacagtctagaatattactcctgaatgtgagtctggcacaggcttacaccttgtcactgattgtttcctggaacagttagattacaagttaattatattaattgttgctgaatagagagtaggtattttagaggaggtttgggggccataattggtgaagagtcagatgtggattagtttagagtgagagatggggataaacaagataatagcataagtggtttggagttgggatggctggagaatgaggtgatgatggtgtgcagacataggtaagtggtgaacttgtggtgagtccttcaggacattattgaaccatcttctgaatatacaggctattgctaactcactggcccaacataaatcacttcattctgttccaggctaggagaggaagcgtagctttaaaattttggagtcattttttttccgttgagtctgtagcttgttctatcagtatcttgatttattctccagccttaaggcacttttggaaattatcattaaacagcttatacagctatatcaatttgttcccacaggtaaactgtgagacagattttgtttctagaaatttaaaatttcaactgttggtccagcaagtagcccttggaaccatgatgcattgtcagaccctaaaggatcaaccctctgcatacagtaaagtaagtttgggatttgtctccagtgtgctgaatttgctgtcctcattgggtctt

SEQ ID NO: 69943 - DNA, 1053 bp, Homo sapiens
gaagttaggctggaggatgagagtggaatgtaattgggggtggtgcagtgatagaataaaatgtttataaagatggaactgttaccaatttttaacattcttgcctttatgaaaatattgtctacacttagttgtcttaaagaatgttttctttctttcttttttttttttgagatggagtctcaattctgtttccccggctggagtgcattggcataatctgagctcagtgcaacctccgcctcccaggtttaagcgattctcacgtctcaggctccccagtagctgggattacaggcgtgtgccaccatgcccaactaatttttgtatttcgttggagacggggtttcaccatgtttgccaggctggtctcaaactcctgacctcaggtgatccacccaccttggcttcccaaagtgttgggattacaggcgtgagccaccacgcctggccaatacttttcttagagatagactatttttgcctattcttttgataatttgaatagtacagaatcagttcatgtttgttttcttcgtgcacttagggtttcttgaattcctctgagctttctggacttccagctgggcctgacagagaaggctcactcaaggatcagttggctttagcaattggtgagtatttgtaaaggttctggaaactggaaattagggactggatctcttgttatcttgttcctccaaatctaggtcaagaatcatgtgcctacaagggtcagatgatacgaacgtgagaagtggtgtgtgtgttagatgttagggaacattaggcatcttttttttttccgagacagagtcttgctctgttgcccaggctggagtgcagtggcgcaatctcggctcactgcaagctccgcctcccaggttcctgcctcagcctcagcctcccgagtagctgggactacaggcgcctgccatcacgcctggctaattttttgtatttttagtagagacagggtttcaccgtgttagccaggatggtcttgatctcctgacctcgtgatccgcccgcctcggcctcccaaagtgctgg

SEQ ID NO: 69944 - DNA, 1027 bp, Homo sapiens
tcttcctaagtatccttgatggagggtgggtggtagggaagggttggagcttgctgggaatttactaatctgaagtttccagtcaaggcatcagttccgtttttatcaggtcatcttgtattatctatgatgtttcaatgagtcatgggtgagaaaccaggcagacagctatgtatgaggcttattaagaaattctggaagagctgggtgtttcagccttgtcagtttctgggaattaactattgggtatatgctttgagctattttaaaatttgttttggtttctggattctcctttttcatgacttttagatatgactatggctaatccaggcatacttatacagacccttttgtttattctcctacccctttttaccttttggcttatttggacttctgttagaagagaataacatcctgagagaaaggggaaaaataagttaaaatctgtttctggttctcataaataactcttgacaatgttatcttttctgtttttgatgagaggaaattgaaactatccgatgacatggtgctttgagctgtggactttttccggatagaagggatgatcaggagttgtctgtgtcagttatggagtattcaggatggtgggaaaaagcacctaattgctttggagtcagatctgagttttaattctaactctgccttgtgttactaggtgggttacctaagttctctaagcctaagcttattgtaatagtagctagcatttgagtgctatgtgccagatactatagttaatgctttatttatttatttatttttgagacggagtcttgctctgttgcccaggctggagtgcagtggcacaatctcggctcactgcaagctctgcctcccgggctcacgccattctcctgccttagcctcctgagtagctgggactgtaggtgcccgccagcacgcccggctaattttttgtatttttagtagagacggggtttcaccgtgttagccaggatggtatcgatctcctgaccttgtgatccgcccacctcgg

SEQ ID NO: 69945 - DNA, 1030 bp, Homo sapiens
ggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataatattaaacataaagttattaaacattttaagcattgttttttggttctctttcttttgatttctccagatttatgcagttttagtgctttctgctgaggctttagctagagggccacaaaacccaaaaactatatggttaacattttaggtatataacaagcaaggaatgcaaggatgagaaaaaatggagaacatgccgtgatttgcagactctattatatctaaattaagtagctgaatgtcaggcagaaattggtggataaattatttcctgatattggcactatctgctc

SEQ ID NO: 69946 - DNA, 1107 bp, Homo sapiens
gccattgcccgctcatccccactagacccctgagagtggggcgaggagagcacagatgttagttgcacaggggcacttcgatgtggaaagaaaagcatctgagactaataactcagtgtgccaggatcagctaccaaaccacagtccctcagcctgggaagacagacaagtttgttctagtgctggggagtggggaggaaaacagtgtggggcaaagaacaggactaggctttgaaacccacagtgggtgttggcaaaagtcacctttgtttcagcttcagtttgaatttaggcacctacttttgatttttattttagagaaaaaatttaaatttatttttaaaagtacatacaataaaatatactcttttgacatacaattctaagaattttcacaagcagaatcatgttactaccaccacaataaaggcacagaacagtttcttcctcagtccgtcccaaaattatctggggtgcgacccctttggagtcaaagcctccctgaatccttaacctctggtaaccatgaatctattctccatcactatagttttgccttttccagaatgctgtaagtggagtcatacaatatttagcctttcagtctggcttctttctcttagcagaatgcatatgagatctctgttgggtttaccagcgcgctgctcatccctttttattgctgagaagtattccatcatgtggatgtactactgtttgtttatccattttccagtggggttgtttctgattatgaataaaggtgctataaacatttgtgcacaggtttttctgtgaagatagttttttgttttacttgagtaaatacccaggagtaggattgctggatcatacggtaagtgtatgtttaactttgtaagaaactgtcagctgggcgtggtggctccctactgtaatcccagcactttgggaggctgaggcaggtggatcacctgaggtcaggagttcgagagcagcctgggcaacatggcgaaacctcgtctctactgaaaatacaattagctgggtgtggtggcacacgcctgtaatcccagctacttgggaggctgaggcaggagaatcacttgaacccaggaggcagaggtt

SEQ ID NO: 69947 - DNA, 1467 bp, Homo sapiens
ggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttccaggaatgtgagctgccaccaaccttcattggcccttaagtgttcactgggcccatggcaagcaccgcctttcttctcgcaaccccttccatcatgaagcagctgcacccccgggctgagtggggtgttgcacccaccgggaggccagctgcagatgccacacagggcttccgctcaaggttacacaagttctgctgtgatcaaccccattgcagtcaggtgcttagcacgtgtatatgcttgatgtcctattgacttctgggcatgaaccagaagccctaagggaatggattattatttttttttttttttttgaaatggagtcttgctctgttgcccaggctagaggcagtggcatgatctcagctcactgcaacctccacctcccaggttcaagcgattctcctgcctcagtctcctgagtagctg

SEQ ID NO: 69948 - DNA, 1062 bp, Homo sapiens
ggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccagggcctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaattgggagcacaaggggcctcccaaaaaggagccccacctcagcatcactgccttaatcgtggcctccctggggtgggtggggttctctcctccctccctccctcctcctggggtgggagggcgctcctgttcccatctctgtgttccctggaggcaggtatcacaaagcatttgtgaattgctttaggtgcagggacaccacccactcaggactcttccccatcatcccttccattgccacaccctagatccagcctcaggaactaacaagttttgagaaaagcaggtagtagagcagcagcttcgtgctctcagcggtggctggctggcatttttctctagcgttgtggtgccaccttcccttcttgtcccaaggttataaggccttgt

SEQ ID NO: 69949 - DNA, 1031 bp, Homo sapiens
tgcattctgatgaattctctggagtagtatttagaaaggaaaggaggacagccagcctggaaaaggatggagggaagcagggccccatcaagggagtggggaatgagggatgcctgaggtattgaccttgctgttgtgggtctgaggtactctgcttcaagctcctgcccccaaggtcaaggcatttgtggtctcagaggcccaggggctgccggccacattgggtttttgagaagaccctcatcccctgcagagtccaagctccctccccatctaggactgaggcgcttctgcctgttgggctccctgcagcgggcgcaagccaggcctttccatgcccccagccagctgcccctttcacccccgcaacctctcaggattactcagccttcacagcgtctgtcactaagatgctgagtgcattcctgacggcctctcttcaggaaaagcccaggctgtgtggccttttaaaaaagactctgtgcccgggttaagcctctgattgtggttctgcatgaagaaaccataaaccaaagggaaagcgatggttcagctttggtcttggagctttgtgtcagcgtctgtcctgagtccctgagcttagaatttaatgtgagccatgcaggcaaggtggggaagctgtcctttccctccaatttcagcatagaaatagggaaagtccaaggaacctctgtcttgctgtcttttgtttttttctttttcttttccttttttttttttttttttttttttttttagccagagtctcgctctgttgcccaggctagagtgcagtggcccgatctcagctcagtgcaacctatgcctcccggattcaagtgattctcctgcctcagcatcccaggtagctgggactacaggtgtgtgccactacgcccggctactttttgtatttttaatagagacggtgtttcaccatgttggccaggctggtctcgaactcctgacctcaggcgatccgcccacctcggccttccaaggtgctgggatatcaggtgtgagccaccacg

SEQ ID NO: 69950 - DNA, 1003 bp, Homo sapiens
ctttacatagttagactactctgttcgccctcctccattcccccaaggacacagtgtaaacagcacgtagtcttgtgggttttatttttcaagacaggtggccgggggtcagaggggacactgattgtgggggcttgggccttctggaaggatcaacctcttaggcttacaaacagccttgctgcacagaccccttctttgtgtcatgtgacttgggatgtgatttgttatctgcctgggctgtgggactttggccattctgtctggtgcctgggcatctgggggtgggagaaggccaggcatgtgccccctgtgagtctctaaagtctaaacttccttagaggttctcaaatatggatataacgaatattcaggacaactgtatgctacattctctcactgtctgctttgagagttaatgaattcagagagattgaggtttcttttaggtaattttaataagagggggaaaaagaaaatggggtttgaagagaaatagatgttcttaagctatttgtttgctcctgtggttttggggtacaacattgagaaagtacaaaagcagcattgatctgcttttcatcttgtcttagtctggccagctctgggaagcatggaattaactcgcttgtctttgggacgtgggattgggtgtggccctgacatatttccctcacttttctgaaatggagtagtagttctgaactgggatgcagatgagcacattaacacgcaaatcttacaaagaaagtactagaaattaaagtggataagttgacgacttaaaactggaagcatctctggaccagagaccaaatagaatggagtttctttgtctggcaaaatgcccagcccttcaggtctgagtatgcctgcaccaggatctgttatcacagggtactccagtgagcgccacagcctccctctaggcaaaagtgtgtatgccctgttttatgttagctattctaggagttagccttgaacctgatctctgagtggatct

SEQ ID NO: 69951 - DNA, 1056 bp, Homo sapiens
agtgagatctgatggtttgtaaaggggggttcccctgcaaacgctctcttgcctgctgccatataagatatgacattgcttcttatttgccttccactatgtttgtgaggcctcctcagccatgtggaactgagagtccattaaacctctttccttcagaaattacccagtctctggtatgtctttattagcagtgtgagaacagactaatacagtcttctttactcccctttcagggagagctgtgcttttcagggaggaagctgcaatgatggtagcagacatcagacacgtgggacaaagtgttgagaggccaggcagtggctgcagtacccctgtggcccagatggcacaactagtcagctgtggtgctaagatggcagcttctcacgtttttaatcaataatttttatgaatttacgtgataggttagagttctagaagtatttagcaagacataagtgttcaatctatttttcatatgaaaacttagcttattctgtgttggtggaagccccgtggtcagtccttgggaagagccctgtagaagtcaggtgagaggcctgagctcacagcacctgtaaccaacggtgcaatactaggccgagggcagggctctgcctgtagccaaaatttccctgtagaaaacatttttccttgctcaggcctcattttttaacattgctgcaagttcaagatgcaatcaggatggaaacgggtcctttgggcctgcatcaggagtgaagaggagtggagggtgtgtatgattactggtggtggcatcctcacaggattgactttgtatattgatggaagtccttcctgaccatgttattattcattgcaacaattttagttagttaattatttattacattgttccccctagtagatgtaatggaacaagaatctttatacaaggactatacaaatgctgtccttctaccttatataatggaaggcacttttgccagttcaagataattgctatcattaaatattgatagagcatagctgttttttttttaaatttctagaagtagaaatagaggaaag

SEQ ID NO: 69952 - DNA, 1032 bp, Homo sapiens
gaaggtgggccttttaacatttgagattctgcaaggtctgtaccaatattacccaaactgattatgacaagtcttgtcaatgagagattttaagtgctgaatatctgacactaagtccaaccttctccccaaaattcaatatcctcttagttaagatctgagtggttcttgtagatatctctaaaaccccaggtaccttctctttcacctttatagttatcccagtcaaccctgttactaacagtctaatttcaggtgcttcctggggcaatgtcctccccaaaggtttgccttcaaacattccatcttccgtgagaacttctgctaccacttgttccaggagcccttagtgaagtcaccataaaaatcaccatatttaatatttcccacctcttgggaaagatttggagctaacaaactgttgtcatataagtatcaccaaaattggtttgttcctttttcaggagatatacgtcattgcatcaaatggcatatataatacttgcaaaattactgtgaaaaatcttgttccaaaaatggtgccagatttctctttaacatggttagcaaagatcagcgaggaacatgattcattcaataattcttgaatggggtgactgagttatgaatggagttcatcacagccagtcatttctgtctaaacagattacaagaggcattggatcaatttctttttcaagcaggcacttgtctaagggctaaatcttctacatctacttaccagggtgacaggttgaaatctgcttgttcatgtgagataaagaatcacctcacagagggcttagacaagggtggtaatacctgaaagctgtgtaagattattttgaggaaagaagtaaggatagaataactcttgactcacctccaggtcttttggtcagtcctgaaatttctacctcattgcttatttatttatttattttttgagacagagtcttgctctgttgcccaggctggagtgcagtggcactatctcggcttattgcaacctctgcctcccagtttcaggtg

SEQ ID NO: 69953 - DNA, 1029 bp, Homo sapiens
ttaggtagtgaattttttcgtctgatgcatggggataataggatggaagagctgaggtcatcttttcactgaacagagagatggaaaaatcagccacaacttgccatgttgacaataaaatttaaaaaaggagaattttcaaatattttacccaacttctacgaaatgttatgttttatcacagtgtaattatttatattccttttttggaaaaaattaaaataatatgctttgtataactgaggcaagaatttgattcaattgagtaatatttggctacaattaatgaagaaagggcaggacacaggtttattttgaaagaaaatttctttatttagcctcagttaacttggatgttaccatccaacacacccgtcaccaaaattgggctctcagctaggatgtggggaaacttatattggggaactttattgcatgaccattaacattactacaggtcatgagaaatgataaagaatagatgcatttgttcagtggatgtaaatatgagggaaggcaaatgtcttttgctccattctagaagtgatctggctgtaagacagatgtacatgtatgtgagtgccataatgtggacttgtagaaaacacttactcatattcatggggtaagatgttccttcatttgcaatgggttttattgattcacatgctagcaaagggacccatgtgctcaaggtgtttctttctttcaggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagcttaacatactacctcaagtgaacttttatttaaaagagagagaatctt

SEQ ID NO: 69954 - DNA, 1164 bp, Homo sapiens
tacaggcgtgagccaccgcacccagcctctttgagaagtctaattctgacccttgctttcaatgctgcatagttttgagaataataatggagacagcataatacaagagcacaggtttggtacaagacctactacttactgcatgtactgtggggcacatacaatactttctggtgaggtacttgtgcaaatgaaatgaagatggaaaactacatggcgctaggcacatattaagggctcagcaagtggaagccatcgatgttattctaaaatatatgaccaacttttcccataagtatttattatacgctctgtgccagacattgtagttgggagagaagtatatgttttcaatttcacagtttcgtcagaggtggataaactaaaagtgcttggcaagccagaaataaagagcgtagagttacaggatctgagcatagaagtgagtattctggttagacccgtttagaggcagagtggagacccaagctcattaaagcataatggggttaactgaaaagacacttaaggaaaacctaaagggacagaactggggcataataatgccaggctgcctagatgctgaggctggagatgaggctgctcccagagtagctctgggccaccagcattactgtgtcacgttctgcatatttgcttttctctcagcccaccacctcttgctgcccagtttctgcttcccagacacatgcgtcatcgtgacatctctaaccctgatgatatcatttactcttcacctgctgtgtccagcagtaaatggcgtatatttctgtgttgtttggttcagatactcatgagatgatatgtttagctgagcttatctttgagatgggcattaagaggtcattggccaagtgccaatcctggttctggtcatctgggaccttttgtaagaaggggacagtgctgatggtatgtggtttagaccatggctgctttggctgcaggatctgcacatatcagtttcccgtagaaaccaagtgagcaataaggccaccacacctagcacaatggctaattaagtcctctaataaattttttaaaaccctactgtaaatttttgcaatttttttgtctatatgatgttctagtcaaactttcatctataaatatggaagatgccaaaactggggagaatgttga

SEQ ID NO: 69955 - DNA, 1629 bp, Homo sapiens
tacacccaagatctcacagttgattgttgaggaaactaaaaagtggcagaaaatagcaggaagaccttcattctgagaatcagatgacctctgttttatcctgacttcattgtttctgtatctgtaaccttgagcaagccttttaatctttccatctcaactttagtttccttgacttgaaattggaattaacccctgcccaatctatgtcagggacaatctgtaagtatcaaacaaacaaacaaataataaaaaggaatgcaagtgaacctgtaagactccactgtgctaatgcctatattgtttctctgatttcagtgcttccctcattcaccaagacccccatggatctcaccatccgagctggggccatggcacgcttggagtgtgctgctgtggggcacccagccccccagatagcctggcagaaggatgggggcacagacttcccagctgcacgggagagacgcatgcatgtgatgcccgaggatgacgtgttctttatcgtggatgtgaagatagaggacattggggtatacagctgcacagctcagaacagtgcaggaagtatttcagcaaatgcaactctgactgtcctaggtgggtgaatttgttaagattctgtagtataaatcagtcttgaagatactagctcatccaaggtccctaagtatcagaagttgtgagagtaagagatgaagatgtatggggcattgccttttcctagaaagtattaatgcaaatggcctcttgaacactttgaagtcagggattgcatgacatcctcaagtctggccactgaggtgaatccctgccccctccatcctgaagagaggggccgaggaaaagttgggatgctttcccttttatgggggatcaccctcctctaatttccccactgtgctgtctatatcagtagtcttaacaccataaagaacattaaaaaaaaatgtgggaacaaattgggaaggccttactctcttttctcagcctaccatacctctccggaagtcagagtttttttttcatcttttacctaaacaaatgctttttaaaaatgtaaacacaattattattcacgtatctttgaaagagctaattaacgtaacctattaagatactaaataataaaagtaaattattgtcagagttttaatataggcccaggcatccggccctaaaaagtttcacttaaaaaacttaagcattctgattttttttatttatcaacatacccttgtgcttgaaattatttttgtactttctatttttaaaaagcttttgtttcccactctccccccctactaccagcttcccgacttttgcaaaagtgagggaagctgagattttaaaaatagtagatattatccttaactggtgttatgagtaaatgacagcagaatagtgaaatactgaatgttgtatatgtttaggctcttagaaaagtgtgtccagtaagttgtgggagaataaaattttaggttacaatttgaataagtttaaatgctacattttatgatatggaaactaaattttatttgggaaattaaaagcataacttgttatttcagaaacaccatcatttttgcggccactgttggaccgaactgtaaccaagggagaaacagc

SEQ ID NO: 69956 - DNA, 1083 bp, Homo sapiens
tttatgatctctttataaagcttttatttctgctgaggtagaggaaaatgggtctatagtttgctgattattttaatttcacagatgggaaagagagttttctaaaattgcttcatctttgttttggcatcaggatggtgcggtggaatgagaatgaaattggatcttgggagaatggaagggtaatctcagcccttctacttaacttaaattccctaaatattagtctctgcatccatgaaatggggactctcctttcttctcttcccaactctgaggcttgttgggaggtttacatgaaagagaaaattattaatgatttatggggtgctaaaaaattaactattggtcggtaaaacatttacaagtaataggaaatgtgaatttattataaataattttaaggtccattgttttagcatccaagaatctcagcattagaaatctagttacctgaactttacatagctagttagtagcagatctggatttaaaagaaaagttttcatctctggtgtaactttctgtctattacatgatgctgccatttactattagctgccatggagacctctgtaaaaataaatatgttttataaaccaataaatcagaatttgcttttatttaagcatgggtgttaaaatattaagaaccttcttttgcattggcatttaaaaatttacttaaaactgctttgtccacgatatatatttttaggttgcagcattaagcagtgccagtagtttctggaaataaaacctctgatgtagcttttggaactgaataagcttttggcattcatctgtaagggcctgaactgctcctttcccatggtccttgtttcatagttttttagtcccaagatctgatccccctattacgttgaaacacatgtatagtatccatcgtttttttcacttccttgtgaatctgaacatcgatttattagatgagaatttcagaatagtacagaaaacacctcgattacaatatgcagacattgaaaaatagcagccctggagttatcaaagcatcccctataacccattcaatacacataaaaagttgtcttttcaaatagta

SEQ ID NO: 69957 - DNA, 1064 bp, Homo sapiens
ctaagagaaagaaaagggagttaaattaattgacctttgaaaaatttctcaaatggtaatttaaggttgtgcaatgggcttttgatttttgctctgtcagaaacttttgctctgttcgctatttgaagcattacgtaattgaaagacatactgtatgctttggcgaacttctgcatgcgtggttggaagagtggttttaaagtttaatgtatttttcagactgttcggatcattcagaatgtagtcattttgatagaggaattaatagggccagtgtcagctttttcggattttagggaaaaacttaaaatgttgttgagggaatcaggcagggtgtaagaggtaagttggagaaaaagagttttctattattttgagagaggtggagataatgtggggaattatgagaaattttttacaaatgatatgccacctgggtggtgatactaggctttctgagcttatcactctaaagggaatgcttcttttaaaattagggatctgaagaacaatgaaatttcctggactattgaagacatgaatggtgctttctctgggcttgacaaactgaggcgactgtgagtatgaattgcctcataatttagctcactctttgatttaaaaattttgtcttcactgaagtcagctatacaagttgacatcatgaagagatgagaaatcagtgcttaatctggttaccacccttgatcctctccccaaatgcctgctgttgcgcaagatgtatattattaactttttcttccttaggtgaaagtgttttattcaacattttagtatgtgtaatttactttaatatcctcataataattttcatctatgttgagggcttacacttttggaattatcattgcgtaaaagttagtgcaggcacttccacatcttgaaatcctcaatgttgtactgtccccgtaggaatttttttaatgaagtaatctagtagccactgataatgctgtggtaggttacaagcaaaacaggatgaaaacatcttataattaaccataaaatggtcttgcagatggtcaaattacatgtgttaagcc

SEQ ID NO: 69958 - DNA, 1052 bp, Homo sapiens
gttgcgtccagtgtgcaaccaaggctgagaactactgccttaaagagaaagcattaaacctaaaaagaagggtgaaagatagtaaccaacttgtaaacagattgtacaggataaacttgaggcccagctccttgatagacctcatgttttagtgtaacatttaataatctcattctggattgtttaaaaacaaatcttaatttgtttgtgtctatactgagtggacaagactttagaaattaaagtgcagtctagtttcagtattttattattccaaaaacacatgacacatttcagtaggaaattcactgcctgcttaacaaattgaaattctttgcaataaaaatgtttagaaactgaaaacactgtatgtaattgaacactgactggttgaactatattgtagtaatgacacattttattactacctccagaatttaattgtcatataagctaactcttgtaatactcaatgcagcgaattgaaccgaaacaagattaaaaatgtagatggactgacattccaaggccttggtgctctgaagtctctgaaaatgcaaagaaatggagtaacgaaacttatggatggagctttttgggggctgagcaacatggaaattttgtaagtgtgggttatcacagttcctactgaggtagtatgatcatagaatgctcagtgtacattcagcaggtcttatgtgaaatcctatgttaaaatctcatcatccacaatcttatttataagtcagtattcagttttgattcaggtaatgtgatcgataatttataagtacctaaatttagtatagtataaactatatagtatttttttgctgacgtcttcatataacaaaagctaaacatctaataacaataggaatctgtaataggttgtaatcatatgtcccctttgaagagactagataatgaagttttgatcctgcttttgattcttactgtaaatgtaggcagctggaccataacaacctaacagagattaccaaaggctggctttacggcttgctgatgctgcaggaacttcatctcagcca

SEQ ID NO: 69959 - DNA, 1117 bp, Homo sapiens
cgactgtataaaaaaattagcgagatgaggtggcacttacctgtagccctagctacttggaagctgaggtgggaatattccttgagcccaggagtttgagctgcagtgagttatgagtgtgccactgcgctgtagcctgggtgacagagtgagaccctgtctctaaaaaataacaataaataaaaatttttaaaaaaaaagaaaaataggataaagaaaaatcaaaccactgtctttaagtgcatagcatttagacagccacagctgctaaacagaaccccagatttatataggaatgttttccacatatttgaatattatgatttataatttaatgaataacttaaaatggccatggtattgctctttaacttttaaaagtactgttcagattagtcagttccatatttctgaagaaccagtcaggaatagaaaatatttttcttctttcagattgttgtaccgttaaccttgttaactgtggtttcttttaattctagggctggaaacaggattgttgaaatactccctgaacatctgaaagagtttcagtcccttgaaactttggaccttagcagcaacaatatttcagagctccaaactgcatttccagccctacagctcaaatatctgtaagtgaagttttctttagcaaaaactttcacctgtaatgaaaatattacaatgaaaaaataagatataacaaactttgtctactttactactgatggattgaaagtataatttattgacttgaaatttgctgtaagctcgaatgaccacaatcttcagtttattcttacacttttagattacaaaaaattacatattttttattagaaaacctagatggtgtgaaaagtgctcatttttaaaaaaacaatcaaaatcagaccattgctatgttttattaataaatgaatgtcataaaaagtggatatttataaaaaaattttgcatccgtcacatattttaatcactcttttcccagcaatatgtgtgaatcttaacatctgtccttgaggacctaaaaagtaattattttaagtttccattgatggttaagttctctggagactccttctaatacagagatggcctgcactttaacttgcaa

SEQ ID NO: 69960 - DNA, 1125 bp, Homo sapiens
aggtacatatctgcataagaaattaaatgccagaatatctttcatactctgtattctgtgaaagaagccttaagggattgctttaggaacaatcagacttgttctttgagctggctcgggaatgcttgaacttgttaggtgaaaagccctaattttaagatgttttgtaatgtctgtaccagagaaattttattatgattaaagggcataatatatgaaaagtgtttagcatagggcttggcacttaatcgatcttcaatattgttagattttatacacattctaagggtgatatatagagagaattctgcttctaagaatatctcagtatggcagagaagaccagtggtgtaagtttgacgtcagcttgcagcacaagattttgtgaaaatatgtaagaggtacacctcacttgggaacctactgtgatagtgagagactgatgagttacaataatgcagaagagctcagaacactgtagaaatccagttttgggtgcaaaaaatacacaagatatattttgtaagttttctttttaatcgaagattaactgcagaccgtgtacaaacaccagtgtgtgacttatgtaagacacagaattctgtttagagcattcagattgtttcattgtttctcgcgttgtaaagaggagacctttctatgatttgtaggtatcctttctaccttgacgttattttctcctgccaaaagatggtctaaaaaagaccaaactgcctgatctaatatgacaattatgatggcttgcacatccgtttgattgccattttctaacaaaattgtcatttaatgctgcattttcccttgggagttactatattgattgatgacttttgaagaactttgaaatgacttcttttttttttttctgtttgtttctttccatttgttcagtataacagtcaccagtagaactttacacaatggtagaagcattctgtatgtgtgctgtaccatttgatagctaccaggagtggatggctattgagcacttgaaatgtggctactgtgactaagtagctaaattttagcatttaatttgaattaatttaaatttaaagagcctcatgtggctagtggctgccatactggacgtcatggtctgat

SEQ ID NO: 69961 - DNA, 2291 bp, Homo sapiens
atttatatccacttaagagagcatgaaggttcttttgagacacttatgctttctggagattacagtgaatcaagaagtagaaccagtcatcacactaagtggtcatatcactaacctcataagttatattttactgttgttaatttggtccagatttagattcaaggcaggtgttaagagtatccgaacaaactagcacagttcttatatgtgagaataatgcacttatccattttcttagtgattacagaggcattaaaatgccagtattgggctgttctgggcagtagcatctcacacctgagcacagggggaccctagtctgcactctgtgtcttagaaaacctcccatatcagaagcaccaaatgcaatggtaatggatagtgaatgagaactccagtagagctgaactgggtccctgtggccagaggctgcagagctggaagagctgatcctgtatgtcagggaaggagaaaagcacagtgtgtgccctggaaaccagaggaagtgtgatgtttcgccccccaagtgggcatcaaggtcgctcgtcatccttctgtcgtctgtcctgcatgaagttaggagcctccgattggtgcccttgcgcctggtcatgccctcttcctcccagtctttccacccacagccatcagagtagccattctaaaatgtacatgtgatattgtcaccccaccatttgacatcctctggccccctccccacagttgatcttgagataaaggtcaaatgtctgatgtggtttccagggcccaacttgactgctgtcatctcccggcggcctcactcttgagcctcttctttctccactctccacccgtgcactctgtacttagccatcaggtgttccttcatttcctctaagggaagctttgctctgctctcacttgcccaaatctttgcctcggcttagagcactagcctctactgtcctttgctgagctaactcatcccacagatctcagtgtggccgtttcttcccttcctttgggaagttttgctgacctccaacattctagaagtctgtccacagtacttccactgcccactcctcctttcctgtcgctgcacttaccacactggacagctccctgttgcctgctatcctccccactagactttaagctctgtgaggtcaaggggcatgtccatcttgctcatgtagaactccagtgctctcagagtaaatatcatcagatgaaaatggtaagccatgtttgcgtctgcattttaaaggtatttggcaaagttggctgaaaagtgaaataggcaacaaaatgaaaccattatcactggacccgagaagctgaggccaaaatacgtggttctcctgtttttccagtggtctcttagaagcctgagggaaccatctggtgttcctgaccaacccaagtccccaggtctgtgtgtccacagggactaattatacttcacttcagaaattagttaaccatggaactccctgtactatcaacaaacatagaagaccaaaatattcctagtctctaagatggatttgtacaagactgaaacaccttccagtatttacagtttattttgtgatttttgaacaatggaaagatggtgtttccacattaagtaatggaaaaaggtattcagagttttgtttttgttcaagcgttgcacatttcctgccaaaaatattaattaactacagcgctttttaatgtgttgatcaagtttggcatttattcctatttggagaaaaatgaaaggtggggttgagttgaatctctgtctactagaagtgggtatttttgaccaactccataaaatatgtttttttttttaggattctagatgataaaaaagattttttaatctagcttttttaaggtagttgtctcccatttttagccccctttattatacaaagcaagttttttgtttgtttgttttgtgttaaactggtatggtgtatatcaggtgggtacttgccagttagtctgagagctaataagaaacgagtatttggatttaattcagttccattaggacagatttaaatttttgtgatacaaggactattattctcacagttgtaagggatttttgtgctaggaagcagtgctgacaaagacagcactgtgcacgctccgtctagaactgagcactttcacactgcgatttaggaggtgtgcagttcaggaaattgctggctttggctggagcatacttttactgcaaggaaaattttattcgtcactcaagtaattggcagttttaataccttgttcataattaccttata

SEQ ID NO: 69962 - DNA, 1034 bp, Homo sapiens
atatttcttttttcatttttaacatgtgttatgactggtgcatgaataagacactgattattgcaggacctctatattaaaatattaatacatggccatctttattatgtttgtgatccaaaggataattatattttatgttgacctgactttttgctgaaagaactgattctttgcttcttacaccaacactcgtttgctggttagtgtccttaattcttcatcaagaatctgtctccttacacaagtttcctcagttggctttattctttgatgctgcagtaccaatggaccagtctaaacatgtgttcttttaatgaaacctcttaattatctttttagaaaagagatgagcagtttattttttatctatatgagaggagttctttgcttgccaaacttctgttaaaagttgcctgatattatggggtgttagttattccagtcaagatagttttcaaggaagcttttcggagggagtgggggttattgttggaaatataagtgacctttaatgtgtttgcagaatgtagtgttttctttaacagtttgtaattcctttataaatggtgctaagctggttgtttgcaagttatatatagaaattagtatttccttggggccaggcttgactgtaccagtccatacatttaatctgcttgctcgatggttgtttgtatggaatgaccacagattcagcaatttgttagttgcaatcactgaattggacttaggggatgtggttagagtgatgcattctaaggaaagacggtattgcaaacataaaaaatggcttcacattaaatttcagtgcacacatcctctaaaaggcaaatgctgcatgcagataccttctctaaattgcctagattgcatgtccttacacatcacagctgcaaggtcttaagctgcctgttatccgtgtactaggtaggagacagctaaaactattgacagatatacattattcaacaggaagctacacttttgttggtttaggaattccagtgtgagaaaacctgatattctggttc

SEQ ID NO: 69963 - DNA, 1067 bp, Homo sapiens
acagcaggggactgcagccttcaccagtacatacaaaccagatattacgtttagtggaaataaacttatgcagctcaagtcttacaaaataaacacataaacgtcttaatatgataagttgtaatcttttattggattttaaatgtttatagatgacttacacataaaagagagtttactatacacagagctgtatttgtgacaaacactgtaagtttatcttcacatttaaatataaactggcccccagaattcaaggttgctaggtttttgaattctcaatttagaatgactgtatttgacacataaatttgtaattgctgcatgattccttaaacccttcaacagttcccattgctctgaggtgaagaaaaaaatccttctcaagacgtacaatgctctgcatgatctgcatcctgttggcccattgagcagtctctggagtcactcctcagttctccagatgtgccaggttgttccagccctgtgttcttttgcatacgtatttcccactgcctagaatactcaccctgcctgcactgtttaaatcagactcttaggtttccccttatacatttttatatcttctttattataatgtctactttatcatcatataagtaattgtattttttactcatctatttgttattcttttaaaagaagtttcccccaccaaaatgaaattttacagcagctgagatcatgtcttttattttctccattgcaaccctggcatgtagcatagtgcctggcccatggtggatgctcagtacatgtgtgttggatgaatgaatggatggcttagtccagattaatatatatgggtaacttttctgttcctgtgtctccattgttttccttaataagacttgttttttccaaggtaatgacaattttagatttgacaatgacccattttgggcaacctttctgtggtgtttcttgaagcccgtaaaattcattcccacctgcatgacttgacttttcagtatagcttgccacaaaaactcttgtattaccgatacttatcctgaacccacactattccctcatgccctctctca

SEQ ID NO: 69964 - DNA, 1719 bp, Homo sapiens
aaacaaatatgtatgcaaagcaatttctgttttccttgactgcaataaggacattgatgcttaaatgtatgacaataaaaagatttctatagaggctttagtttcagcaacctgcctaattagctccttttcttaaaccatgatgtcatcatatcaggttaggagtggggagatgggagggtgaagcagacctgccagttcacaaaagatctgttcaccacgtgccaaaaaaacatctcttaaaacatttgtgggcttaaagtatttgaatctgccagtctccctaaactaattttgtccttggagcttgtatttttgagtttggcattttggttgccatctagtttgtggacagaatagaccaattatttctcctgctctcactggtgttcatagagatacttcataagcccagttagcactattagtgatttttagaaatgacttataattttatttttgttttcttatagggacttaagtcacaacagattatctttcatcaaggcaagttccatgagccaccttcaaagccttcgagaagtgtgagtcttcgttattttgtttttaaggtttgagtaaaatacgttaccccttatactatttaaccgtaaggaatacttggattatagtgagttattcaaaacttttaacttgggtggtatcttgaaataatatgtaaagttttcacctctgtgaattacagattacctaatcagcttttctttttctttttttttttggcatttgtaggaaactgaacaacaatgaattggagaccattccaaatctgggaccagtctcggcaaatattacacttctctccttgtaagtgaatatcagcagaattcctcatgtatgtttgcaggaaccttgagtgggagttccatagggactagcatagagatcttagaagaaaaaaatggaatatttttttcagggcatagtaaagatacgcgctttaaattggttaacttgttttctagcctctaactctctcactgctaaatttcatgtattcttataacaacacactttacactttgctgttgttgccgaactggtcttcgagattcaaagaggccagctttacaccatagaaatgtgtattttatcgtattctgtagactaggactttaattttagtatcgctcaatggttggcatggggatctgtgggttatgtattacgtagttcctagtggagaatgatcagagttgctttgtgaggagaaaccggagttgagaataagccattggagtatcctgttttaagtgtggtacctgcagtgtaaatcagagttcagagacatcaactcaaaaaaagtaaatatgtgactgaagacagaaataactttgcaggttgttttgcaaatatgagttttcaaatacaattaaggttgtaccaagttttctgtatttttagtgtaggtaacgttgtatatacatgcactgacgtaggttttggaataattctgactttcagcatttaaaggtagcatttagaatgcctgtggtttaatttctaaaatctaattagcttaccaccttaatcttaaataatttaaaaatatatttaagctactgatgttaaaaaatgtttttctttaagcaacttaaggaaaaaaccaccattgttagttgcttctgagagaggtgttgggagggttgaaattatacagtaaatttcaggaaagctgttcaattaatagagtgatca

SEQ ID NO: 69965 - DNA, 1226 bp, Homo sapiens
gcacttttcagaaaaagttcagtgtctatcttttgtttcatttgttgaatttgcaagtttaagaaaaattacgtgtgtatgtattttttccactttatttggttgtgatttattactataggagtcccatgtgtgaaaagtcgaatagtttgagctgtaaaataataatactgtatcagtactccttttagaaaataacctctaatgctttaatgaaagtggctcttaaagagtaactatgtgagcgagactttgtctaaaaaaaaacaacccagtaactacgccaagccttgctcacaactgccattaaaggcaagctagagtttatgtcaagagtttgcgcttaaacagttctcaacctaaagaggaatgcttgttagaatgttatttagcccagagacggaaaagttgctaaattgccaatgagaacttccagtattattaaattctcactggcatttcagaattatttgtcttatgtagaaatgtttgagttctcaacaggacccaggcgaaagtcccaaaggtagtttctgctggtgtgacttctttagtgttgacctgttataaatcttatggtccggaccacagttgggggtggggtgggggtaatagtccttatggttttcacagctgtttttctgtattttccagactaaaacttgaatatagcaggctgatttatgagtcactttggatcagtgtcttaaaacagctatagcctggctttttgtttttcagctttccagatttgtgctgaattagcagctctgcaggccccagtgggattgcttaagaagctgtgctggatttgcatttaaaatttgacttggaagtcagatttccaaatgctaaaaggaagaaaatgacagcttgaaccaaatgttgcaaattgattattttcatatatatttattcatttgctaatattcaggaagagagaagtctgtctaaccatatagaaagagtttgactttcaagtgttggccagctgagctctgggtacagttaacacttccgtaccttactacctttcccattcattaaccccactacaaaaagtttttgtaaaagttttgtggggaagatgctattaatggaactctaaacatgaagaatctgcctttcttattgaatgttttatgatctgggtttaagaaaacatcgacgttgtacaacttgaatctgtttttaatggtctagccataaaaacaatgtaaggaaga

SEQ ID NO: 69966 - DNA, 1042 bp, Homo sapiens
ctacatcaacacaacacatgagaaggttaaatttagcagttcaaattgccagacttggccaccttctttgacccatgatataatttaagccaagcttactttagactctgaaaagtatgaactaatagtgcacgtcaaagcaggttcttgaaaaagagaaataactaactttgccctatttgagagaagagagaggggagggcaaagcagagtctctggagatatgtatgtaagtttgcttgtggctaaaagttaatgatcagttgcctctcttcttagccctgagcctggagaaaagtgtcaaacgcaggttctctctctattcaggtaactttaaaaattatacaaatcgtattcgtgttcattgtagtttagattatagagatgtgattttttttcctttagtgtcatgtgatttcatactctaagcatattggaataacaatgagaaactttatatatgctggctaatgtaaaaatattttacttttgaagtacaccaagttaaggctaaggagagattctgtattgtattagatgggaagagaatttttacaagtttttatgaaactatcaattgtggttcttaatctaccagctgaaagatgtattaatcataattatttaaaataatgtacattatatagtgtgccaagtcttggctagtaaggaaaattaaaaacttttttaacattgacattctgaaaataagactaaatgtttaatcactaaaattatttgtatttcatattataatgccaaaagtaacctatttttcctattctaaatcattatatttgtaactatgtatgtgtactttgttgaaaaaaaatagtaaaaattaatagatttttattataggacttaggtaatttcatccaaaacatttaggatagtataatattatggtatgatatgaagttattgtacagttatatttcagggatgctatatgtataattatctgtaattaaagacattgctcactaagttttaaagtcttcacagctggtgtctaaaaataaaaatattgtatacattt

SEQ ID NO: 69967 - DNA, 1046 bp, Homo sapiens
catttaaatctggattgaaactcacataattgatagtaataaccattaaaatttggggttagaaaacaccttaaatgatttttaccatccacttatttctcaggaaataaaaaccaggtgagttgacctgcctagaattacacagctaatggcagttctgtggctaacccataggcaaccctgtgggcttttcaccagttgactctactgcaagaaaagtgacatgggtcactgtgtatgaccaaatatcacatgtcacagaaccaacttctgttaagagaagtagaacatttagtaattatatagctgtggtgtatggagaattgggttcaaatagggctcctctgtttgctaacaatgatttctggcaagtcacctctatcctctgaacaatggtctccataacaccccctttggataactgttgcttcaattagattagaaaaaaattagtgaataaacttagcactgtgttttaaacatagagtgttcagtaaataaatatttgaaatttggatccattttgtgaattaatttaatgtatcctgacaacctagctaatttagattacaaaacaaagtttgcctcagatgatcttttccttaaattgtctaaacatccttttaactctgtggttcttgaggcttctggaagcttagccatgatggattaggatagttaactttcttcacatttccataacaaaaattgaattgcagctgccaagttttgacacagtttccctacataatctcttacttgtgattatggaactttacagtattcttttcaccctagttactcattccactgccagccagagaaggctaagagttgtttttttgtggtgttgttactattatttttcttcccccgaccttagccataagataggcagatctgcctgcctgtcttattttaaggccaaagtgacctacaaaaggggattgcctttaattggatctatttatattctcctttatttctgctagggcactgacccatgccaggagctcttctgcccagtggccgccccaaattgatac

SEQ ID NO: 69968 - DNA, 1039 bp, Homo sapiens
ctcacatgaaaataggatgtcttgctgtcctggtaggatcatgatttggtgactctttgagaaaattctctttatttctttattcaatgttcatttagaggagtgccatggagggtggagaaggggttctggggcagcttgccaggatgtatggctcattcagtaaatccatacccacctccctagaagacatattacctttgtgactttgacatatccactggaggttgtactccacctaatgagacttatcaaagtattctttcatatatctcctccttaagaggacattgtttaatataattttctccatcttattatatttcaactgatagcttagcaacatgaacagctgcatgggtagtctgcctcttagtgtggctctgtctacagatattttgtctaaattgtttaatctttggatgacatattcctctcctttggtctatctatgtcctatatatgcagtactcagctgaaatacacactgctggtcgtgctgtcatttgctatgcagtaactaaattgtgatagcaaagtgtaggccttgggttatgcagaatcatttatttctccattttattaatctattaacaattttcacattaagcttacttatcataaggcttatttgtaataataaaatgacactagtgggggcaaagtaataatgaatttgatataacaacattatgatcaaaggttgaacagtaaatagagtaaatggtgacaaatgaagatttgaaaattggggaaatataatcaggaaaaaaatgagctgctaagtgaggattttaatttccagtattccatgagtattgatatggttaggctttgtgtgcccacccaaatctcatcttgaattaaaatccccagaatcctgataatccccacatgtcaaaggagagaccaggtggaggtaattgaatcatgggggcagttttctccatgctgttctagtgatagtgagttctcacgagatctgatagttttataagaggctcttcccactttgcttggtacgtctcctccctgcttc

SEQ ID NO: 69969 - DNA, 1050 bp, Homo sapiens
tgggttctcccactcgtaacgaaaagcccagtcactgagctgctacattttctgccatatcttagccgtccccacgcccccacaccaccgccccaccctacctcaccctcaagcgtgagtgaatgcgcaaataagggttttcaaggcgtcagtgggaaagagggaggggaaggcaacgctgaggacgggaggacagggcggtggcatccctctagcgagagagagccagagccctcggcggcgaggaaagctaaaacccggcagtcccgggccagaggaggccaaggcaagatgctggacgggcggggaccgatggggggcagcagaccatggccgcgcacccagtgcgcccccggggcctcctcttgtcccgaggagcacccccgctcccggtgtcttttggtttcgaccggccgactgggaggggccgtgggacgccattcccataatgctctggggcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtaagagaaaggggttgagatgcccgcggttgcccgaggatagtggagaagtgggcgggagccgcgagctggttctttcgctagtgacaggtgcgggcaggtccggcggcggccgccggggcagcgggattttggccgcttctgaaatgttggggcaaaggttggactctagatgagggtcagggttcttggcttgccagggcatgctgaaaggtatccggggagcggcggcggcggcggttctgactcgtgcggttctcttcgtcctccttccttccgtagtgccgctcccacctcaggccttcccgaatgataggttatagtggtttggtttgagtcttatatacgccgttttgacaggtcccggtgccgcggcttatcacgatctcaccggctttacttctctgttcatttcctttcctagaattgtcggcgtccaagttcccttttattct

SEQ ID NO: 69970 - DNA, 1019 bp, Homo sapiens
tggagacgggatcttactgtgttgcctagactggtttgaaactcctgacctcaaatgatcctctgacttcagcctcgcaagtattaatagctgggattacaggtgtgaacccctatgcccagcctctgtctcttattttaaagattcattttttaaaaagtagattcactttaaaaagaaaagaacctatttttctttttaaaggaagtctattttatatttagtagcagaattctaccatttgcctcttgtgactgttcagtttagatatgatagaacatgtaggaaatcttaacaccttgcttctggatattaaaacatgcttaaagattgataggtgaataattgaatgtacagagcaaatgtcattttgatccacaagtacattcagacaaaaaaatttgaggtcatttactattgagcttttgaattttaattgtctatcaataatcataagctcttattagagatgatatggccccttcacatatagttttacagaaataacccatgaagcatatagtaagatcttgtaggctattttgtttcggtacttggtccatattttaaaagtatggtattggtttactataagccacaaatacatacggctttcttcttggacttaaatccatatgaaccactcagcacagaaaatgcaaatatgaatgcattattatgttcaccaactgattttttccctagagataactcttaaagaatttttgaagtgaaagaacatttaaattaagatagtggaagatacaatgataataaaacagtcaattttgctatcttagtcttgaatttatcttatgatgtgagtttagagtgattcttctttttttcactgaaaatcacttcattaataagtcatgattattgacaaaagtaaattgaaaccattgggcatattggtagggaaataaggggaagatagagaacaactgataaaggttgattatgtgcattacgagatttgatcctcaaaagaaggaccaaaatatatatatttatat

SEQ ID NO: 69971 - DNA, 1631 bp, Homo sapiens
aacaattactaaatactttttttcttccctgagtaatgtcagtctagcttgtttcttttaatttcctcacttaccactgtaattcacattctgtgtctcatattcattcctctgaagccacttcgccagactcgttctcccatttatcctttaaacaggggaatgtagatcctttagattttatcacccagtttacacaaaagtcactattcaagaaatctagcataagcctagtaagtagcctcagttttggatacagattaaaattatttgagggaagggtcaaaaatggctccttacaaagaaggaaataagttccaattataatataaaacagaaaacccctgtaggattaacctgcatttgattatgtctagactgcctttactacttccatcactaagattctacatggtttccttatagctctccaaaaagaaaagagtaatgatgcctttttttcctccaaggaatggagaactaagaatgctaactgtcccttccattctccctttagttttgagaagacccagatattagcgtggtaattccccaccataagagaaaatcatttagcagaagtaccagtagcaaggacttctttgtgaaggaagtcaaagatctcacaaagaagttcaagggtggctctgaggccagggtattctaagtttagagccagttaaatcaagacctgagaacatttagagacaaagttacttaactgaaaagagcatcaagttccttgttccaggtagaaaacacctggtaatctggattgatttctgttatttacccatatgtttttacagcttaacaaagtttaacaggttagtcaagagatttgcctttgataaaaagatgggaaatttatattcatacatttgaatggatttcaagctgaagaactttttaattctcaggagagatgtagctaagtatttatatgtaccacatagttgtggctatggtttacaataacttattactcatttactatgttaagagcattttaaaagttctctagatacaggttccatatataatgtaatatatttattccaaatatattacatatatgaaatacatggtagtattctcattttaccagtacagaaactgggatagttaaatgtatatggtcataacacttagtcagtggtagagcaggaggtctaacttaaagcttgcattttaaattctaagtgtactgcctgcctatgtgtgatagagccatacccagattatggaagcaactttttgaaagacaaatacttgaaagtattaaaatcaagaaatgacagctttgtaatacttgttaaacacattttcatttgttattaatatcaagagcctctagaattttgtgagtcttcttgttttagccttgtagtctcagcagtctcatttctaattaacatatctctgttttgatacagatagtgtctcccatttcctgcaaattatttgctttttcctgcttttggggcctttatgccccatttctgttgtttcagatacttcttaaaaattactgactttcatttcaaaacctagttcaaagtcagtctctaaaaccacctctaatctcatccaaatttgtggcccctccattctttgcttttaaaatatat

SEQ ID NO: 69972 - DNA, 1034 bp, Homo sapiens
tgtatttcattactccgtataaatgacacactcatctttttgcagcctgtcttcttaccttctctcattcgaaatctaccccatctctttatttcttagaggtatgtggtatagtagtatttgcagtgaatgttttgtgtcatttaacccatggatctctcttccactcctaatctcatgccccaaaagcacaaacaatgcgctgtcttaagaacatagataagtgtgctaattatcaaaaacacatttacagtacctggaaaatgtaagacaacaccctcagcagatgaaaatgacctggcatcctaaaaggaggctaaactcacattaatccttcaaatgaaaaaatcgtcacatcataccctttaaataatgctttaaaacattcaaaattatttatgaataattatttatgagtctttgtggaaatgcagttatgcaagaaaagtataaaaatattcatggaatgataaatgctaaatcagagtaagggtattccaagagaggggcccacaaggggctatattaatatttatgataattttctttaggtgcttgttttgatggtatgtatatagatgctcgttattattcgaagtttaatgtatgcctttatatgatacaaaatacttttaaaaagcgaagttgattgtaagagctttttattttgaggaagtcccaatttttcttagttttttctgtttattatttttatattgttaataccaaacctaattctcccggtgtagaaaagttacacagagctgagagaatttatgtagagtcaagcattattaattatcatttccttcttgcttcatatatgcttatcacgcttatatgtcacatatggttacaagatatctttagtatggagagacatacacatttaagatattaatggtcatgtatgtgtattctggatgaatagtttaaaaacaatcttacttggcctccttgagtttcttatttgtcttagtttagatctaaaaagagatcataaaaattatttattgctaggtgatggatttaat

SEQ ID NO: 69973 - DNA, 1056 bp, Homo sapiens
ggttatcaggttgactgttgcagtatcacaatccttatgttcaagtatcccttattttatttaataatgacccaaaatgcaagagtagtgagagtaccacagttgacagttaacccgcagaaagtgaaactgcagataaaaggaggctactgtataactgtaaaggatttattaagtactttgggagataaaactctatatcttaaaaatgtctaagtaactataaatagaatttctatacttttccacaaattgtttttaatgtgttttataaatgatatttgtaactgtagtattaatgttatctcaagtccatattctatttttaatggatatggcattagctttttaagaaaactaacgggaaattttgcatttccattttaaagggaaaaatcagtaactaagaaaaattaactgaagatcagagtctaccctcccaaatgatactatactccccagtagtttttcatacaagtaaatcattaaggggcagataacccgttacaaactacttttgtagatagtagaagagtaaaagctattccaggtttgttcagaagagtacaggagaaaaagcttggcaagtgcagaaaattttcatcacctttaacacttagtcatgatagtctaaacaaatgttgaatagaaaggaacttctctaagttcataagcagtatttatcaaaaacctacagcaagctaataagcagcatttatcaaaaatctacctagtggtgaaactttaaatgttgtcataaaaaaaaagacaaaaatgtttgctgtctcttcacctatattttaggagccctagccaagaaaaataggcaatagacaagaacaataggaatacaattagaaaggaatgattaaacacattatttgcagcaacagtatgagtttttacatagaaaaatctaagggaacctacaaccaggtaaaactactaagagttcaggatgctggtggatatcagattaatcacttaaaaaaattaggctgagcacagtggttcatgcttgttatcctagcactttgagaggccgaggcaggcgga

SEQ ID NO: 69974 - DNA, 1112 bp, Homo sapiens
ctggaacttgatgtctttagtcagccatcttgaacctctctctctgattatgattattataattaaccttgcaacccttgataactggtttcctttacctccgaaacacacaataaagtacataaaattatttgcaagcttcttgtaaaagaaccattttttctatttaccatattgcatttttaaatttattttgacaaattcttacggttatttccatttttattcaatgagaagcattttcttgaatacgtatatttgtatttttatgtcagtatttgtcattaagtagtatatatttatagaacaataggaataatactttatacaaatgaagtcttgtctttctaatactaaggggcattacagttttcaaatatcctttgaagtagatatgtcttttaatataaaaggaaatatcaaaaaatagatggctgttctactgttcctgtattttcaggtattttccttaaccaatttcttttattttttaggtacctagtcgatagtcgctggttcaaacagtggaaaaaatatgttggctttgacagttgggacaaataccagatgggagatcaaaatgtgtatcctggacccattgataactctggacttctcaaaggtcattattttcttccttcagtcaagttgtaaatgtgttaaatttcattatataaatgtcagtgggttgaatttggaaaatgttagcgcaaataagttgataaagttttgcattacagattttacctaatgaactcattattctaataagttattaaaaattttattagttattattctgtatgacaagttttgtttttcatttatgatgtaataaggttttattgttgtttaaacccttaaatgaagaactgatttcttcatttaaagatttcattattaagtaatcattatttaatgattatttattactaaataataagactcattatttgttattaaataattaaacactgattattttgagaaatgctatgtcacatattgtttttcctagtggacacatgacattttttaaaatttgaggaataatcatatatgcttaagttcttaaatttttgcattagctttctacaaccctcactacttgc

SEQ ID NO: 69975 - DNA, 1073 bp, Homo sapiens
ataatatagccattaagttcaaattgtataaacaactttttaaaggttttctgcttgggatcactactaaaagctaagaagtatgtttgtatcttcaatcagaactctgtttatttgtattataatgtataaacagagaacgtacatatatatttgcacatagtcattttgggtaatctttctcattataaatactgaatattaattatttatggtgtactagtgtatcttcatagatcaatagaatgcctttccaaactgtcacttaatgttttaaaatcatgattatttctttcttttaaatatcaaaatttccaaaaagttttcttgcttttgaagttttaactatccaatatctttttttatatatattggcaggctttaatagtgactggtttttcactggagatctgcagttttctaaagtctctttaaatgtattgttattagagtgaaatatattgatataggtgacactgatttgttttgtttcattattttaggtggttgaacagggtatgtttgtaaagcactgcaaagtagaagtatatctcacagaattgaagctatgtgaaaatggaaacatgaataatgttgtaactcgaagatttagcaaagctgacacaataggtaatgcaagatcctgtcttgtttttaatccattgctattagatatttaattagaattatctttgtatatgctacttggatgataaccattttaaggatttatatatagacatttgatttccagctttgatacaatgtcttagagttaaattatttattgtttcttgtatgcttttgcatttattaaatgaattttaacatttgtgctgttttgcttttttataaaacatcaaataattattgtttttatttagcaactggtgtgtcatttgtaacatagacctttaaataaaaacttaattaaaacttggtaaggtagcatggaaaatgacaattggttatttccttttttctcttagtttattctttggtactataaatacagtcaagtagccaaggcagcaggcttagcgttattttgacacattgatttttcaaattaa

SEQ ID NO: 69976 - DNA, 1050 bp, Homo sapiens
aagttaaacaagcaggtatcttcctcttatagataatgaagctgagatttagaatctacttcaattcaccctggtaccaagtggtagagctagtactttaacttcataagcagagctcttaaactagagtctcatctctcaattgctgccttacacaatctgtgtatgctaaaggaatattcgttttggagatattaactgggctgattttgtttttctaaaggaagtgggttttgaaacacagaatttacataaggaacttaagatggatatgtatttttcccttatggtcttttaagaaatcttgattgaaaatgattaaaatagctatgtatgtgaaatacagctgtataaattttatgaacagatttaggaaatataagtgtctgttttctcttgttaccaaattaataaaatattctgttttcagctagtactacctacactgatatatagtaaaaatgatagcaggccataggccatatctaaatgatttacctatcagggccaaaatcttctgccttcaaatgttttctgccaaaattgatatatttgagcattgagcatgtttaagtaagagataaaataatagttttattttcctttaagattaactaccaaaaacataaaacttcttgaaaaatatgatttaatttctatgacctgtattaatattttttaatttctaatttttgtgagtaacctgtattatttttctacctctgtatgcttttcattaactggctagtacagttgaattaatatgtggaaaaataagcacacactgtcagtcctttgaccattctcaacttcagtgatctcaaccatcagccaagctcagccaccaattattacagttaaaccctaggctgttgttatctgtaactgcacttgccagatctcaattttagcatcctgcattctggccaccactttctctgctcccattttctcttgagcccactacatgagacatcgaaacctaccactctgttggtactactactgtcatagtctctcatgaccttgccattgacaaatccagtggta

SEQ ID NO: 69977 - DNA, 1267 bp, Homo sapiens
caaggcactttcttttttattgtgtccatatattctagtgagctgttcagtttaatataaattatttttaaattgcttatgtggtacttaaaaaattttgcacactaaaaaaaatctgtaacatctcttaatcatactttaatttctaattcctacatctcctcagaaaatatttgaattatagtatgttaaaatttaaagtttatcctgtgtagcataaattgtattttagtgttaggtgattgaactcttaccttttgagattttaaattccccaagtaatttgttggagtacaaataccattttttccataaaaacttggtcttaaaaacccttttgttggtttgtgttttatagatttattacatatttagtcttgattttctattagtattttaaagaatttttgtgctggtaacatttagctgtatgtggtatattttgaaatacatactatatttatatatctttcctccttaaatctagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattgtttattttaagcatactgtattatacatgaaggtttttggattcacaaactttaataattatcctggcaatatataatgggctgtactgtttctggcttcctctttctaaactcatctcttgtctttccttgctggttactgactctgacttttgattccctccttgagcttgggaataatctacttgttaaaaagaaatcatttttaattagaaaaaaatcccagctaatattataaggtgggtcagcaaactttctgtgaaagaccaaatagtaaacatatatggagcatctcttatttacacagttctttattacaaattacagttctctgcaggccataaagtagcatctaaaacattgccattgtagtacacaaaaacaagcatagatgatacatgaataaatgagtatggctatgttctaataaagctatttatataaatgtgcagcaggctaagtgaactctagtttgccagcccttgttgaaaggtgtcagctcccaatttggcttttttgtttgtttgtttgagacggagtctcactctgttgcccaggctggagtgcagtgatgcaatctcggctcactgcaacctctgcttcccaagttgaagtgattctcctgcct

SEQ ID NO: 69978 - DNA, 1022 bp, Homo sapiens
aatttttgtgtttatagtagagatggggtttcatcatgttggccaggatgggccagaatggtctcgatctcttgacctcttgatctgcccgcctcagcctcccaaagtgctgggattacaggtgtgcgccaccgtgcccggccggtatttttttaataaagtattgagaaatgaagaggtttagtcactgtcagcaagtcctactgattctatcttctaactgtgtcttgaagtaatctctgtgctccattctcagcccttatctttcatagtctctttacaaattcctgtatctccaggctcttgtatgtctgttcaatctttcttcctttgtttttttgttattagcagataaccataggacagtcttgtttttgcaagaatactcattctaaaatgtaaacttcactgtcttcctttcataaacttttcctggttccttaataattaagtccaggcactttaagccagcatgcaagttatggtttaaccttgtacctactcttccaccatctctagattatctttgttttgtggtttatactcaagcagtaccaaactgagctgcttatagttccctgaacacactatgctattccatattcttgtgctttctgatgtgttattccatctgcctgatgatgtaaacgtctttggagtccctgtattcatccagcaaaaagtccttttaaccatccatataataaaattaaccatcccataccatcatgtaggccagccgtatcagattattcatccttcaggttctagctcaactgtcacatcatctattcagccttccctatttctctcaatgtccattgaggtataggatgtttctactttggagaaaagaattgcttccttaacttccacaaagatgtatgtatatttgttttgtatcgttcattatatgctttagttatttgtattttaatctccccagactatgaggtccttgttttggttagactttgtaccctatttttattttcagaacctaacatgcccggtgctctgat

SEQ ID NO: 69979 - DNA, 1196 bp, Homo sapiens
tgtgtattgcagaaattcatgccttgtttatatttgagtattttgttcttagtatacaagctatctaaatttgctcttaattaatatgttactattttaaaagcctccaattcaaatatcttaaggcatagtataaatgtatggtataaatgagaaagttgcgttgtctgatacagtcaaatcattaaacatttgtttaatttcttgaagctttttcgtggtttttaaaagtatcttaaaatatttctttatcaaaatgaatctgatgtgaaagtaatatatttattcaaatgaaaagttttagaataaaaaagaacaaatagaggtagaggagtatatgaggtatttttgagggtaaatgaaagaagaattaggaatctttttatctgttttagaactaatagatctacactccattatcaaaacacaaggccagttgtgtttaaatatacagacttctcaaagctctaagaagtaatatggtacatgtccctccattactgtaatgtttctgtttctgcaaaaggacacttctttataatcaaacacattaatattttttcagcaaatattcacactaagtgggataaataaggactataaatagcattatatcagttcaggttaggttgccaccaaatgaactgtgaaaaaatttttaagtttttggagctttggaatttcacatgttctgataagggattgtgaacatatattttgaaattcttaaaataatgatatttttaaaaaactaataacaatttagtacattttaaccaagtgaataaaaaaatctgctactttatttgatttaaaactacaatgccctccgggtgcagtggcacatccctgtaatcccagcactttgggaggcgaagacaggcagatcaagaggtcaggagtttaagaccagcctggccaacatggtgaaaccccatctctactaaaaatacaaaaattagccaggagtgatgatgcatccctgtaatcccagctactcgggaggctgatgcatgagaatcacttgaacccaggaggcagaggttgcagtgagctgagatcgtgctgctgtacttccagcctggccaacagaatgcgactttctccaaaaaataaataaatataaataaataaaataaaactacaatgtaccttttataagtggttttctatccttttttatcttacgtgaaatt

SEQ ID NO: 69980 - DNA, 1106 bp, Homo sapiens
actgtaatacagaaaaagatctgcacctatgtatgaaaagattctcagaaaactaagaataaagggaaattctaacttgatacatcctgtgcacctcaagtctatagcaaaagttacatttcattgagaaattttgagcacaatttaagtaagaggagaagataagaaagaagaaataaagttcactattcgtatatgatatagtcatttgtataaaatccaaaacagcaaactactagaactgagaaaattcagcaaggttgtctaatataagattaatttataaaaagcagttgttttttctataccgagagatcagcaatcttttttaaatgttttcagctttgtgggccatatggtctctgtcataactataactgctgatgtagtatgaaagcagccttagacatcatgtcaagacatggcaatgcctgtgttccaataaagctttctttgtaagtagatggcaagcttggatttggcctgtgagccataaatttctaacccctgccatttatcatgagaaacccacttagaaaatagtctaacaaaaattaacttaattaaaaacgcataaaaccttcatgggaaaaaaaaaatctaagtttattagaaaataaaagattgttatgtgatatatggcttaacctagtaatgcctgttttctttaaagcacatcagtgtctcctgttcaaaattttttttttcctagaaacttgacaaattcattttaaagttagcatagaccaatacaggtccagaattagctgagtcagttttgacagaaagaggaaggaaggaacactagacctacaaggtaaatgagagttactgtaaaattatactaataaaaacaacataatgctagcaaaagaaaggcaaatagattggtataaactagtaatctcagaaagattcatgtatatttgacaacttggtatatgatgtggcacaactaggtagtgaggttgcttaaagaagatgattatttagatttagtaggagtactggctatttggaaaaaaaagctagatccctactttcaactttatatgcaaaggctaactcttgaaggattaaagacctaaataagaaatataacactt

SEQ ID NO: 69981 - DNA, 1025 bp, Homo sapiens
tataaaaatctttaaataactgttttgctgtctcaacgttcagacttaacttctctgtattttggttgcttaatatggtggtagatttccatgagtgttaaatgtttagttgacttactaaaagcaagttatgtttttctattgaagtaagaggctcaacttagccttgaattgcatgtttttagttgaaacatattgggcatagggaaattcagatactacaaacttccatttgtcaggagtaaggctgaattttctgtcttcatgaaaccacttcagctaaatggaagtcttacctttttctgtctgagggcacgatatgttacacctagcccaaactggccaaaattagtttaattctaggtaagtggtttgatgtctagttaatgtatgatattcttagcacttttttttctcctttttctagaaagccactagagcagagttgctagtgaacagtttaatttccacatacgtcacagaaagagagctaaagggctctggttatcatccacagactgaccagtcaacccctaaataacctgatattaactccacaaatgttagctagattggaccatgtgtaatctgagtcagaagtcggaatcagaagagataaatgatgcgttatcactcaacagtaatgtctgcaacagtattgtaaaattgttgtactttacctgtcgaccacatccatccttagctctctgatcaccttactatttaaggacagtccctctactctacctgtagtatttatctcaatgcttcctggtccttgctttttcttttattatctcctctctcctacatatataaatgcctagcatagtgccacacatatggtaaacaccagtttattatttttatttcttttctaatgtcatcttccccctcagcctatgaatataaacacatcttcatctttaaaaccaaaaaccatatacttcctccatttaccatccttaagcttttttttctttgacagccacctacatttaaaaggctatacttaatgttgcttg

SEQ ID NO: 69982 - DNA, 1169 bp, Homo sapiens
tttcctgtattgcctatttcaagtaccatccaagagccatcctgagttcctcctccagcctttcttctcttgtctagttagtcagcaagtcttgcagattctgcctcctcacctgaagttttcaaacagtacccctttacattcttgaaaattattaaagatccaaagaacttctgttatatgggttatagctgttaatatttgtcatattcgaaattgaaataagattttaaggtattttaaaataacagtacaaaaccattgtattttgacatgaataacacttttatgaaaataactatattccaaaacaataaaattaccaaaaagttgcattgttttttatttttgaaatttctttactatctgactgaatagaggacagctaaattcttgtatattcttctgcatttaatttattgtaatacaatgtttgggttgaagtacatgaagcaaaatcagcctcacacagatacatagttgaaaaggagtattttcagatcattaatactacatcaaaacttgactagtggtggtttaagtcttaaagttaaatgatagaatctgaaaccatatcaatgaaccttttatagtattaaaatctttcaaatgtaaatttcatgcattttggtcatttgggaaatattcacggagttatgcagatcttccaaatgttgacacattttattctacaatttttttcaaatcacattttttaaaacatcacctatcttatgagaaacgcctaagtattgggaagctgtcaactttgtggtgtcagagtcaagttttccaagattctaattcttcatcgaaagcccaaattttatcattggctgcaaatacattgttttccttaaagacacagccttccttcattcatttttcagaaaacctctgcttgatagctgtattagtccattttcatgctgctgataaagacatataggagacggggcaatttacaaaagaaagaggtttattggatttacagttccacatggctagcgaggcctcacaatcatggtggaaggcaaggaggagcaagtcacgtctcagagcttgtgcagagaaactcccgttttgttttgttttgttttttgtcttttttaaattttattttattttaagttctgggatacacgtgcagaatgtgcaggtttgttaca

SEQ ID NO: 69983 - DNA, 2217 bp, Homo sapiens
aactgtaatactcttttacttcccacctatccctctaattgtacgtcatttttaaatcaccttatgtcaccacctacaaaattttatattagaatttgttatcatacttgtattgtattatagtcattttgcttatatgtcattttttcctattgtgagctgtttgaggtcaggaactgtgtctttctttgtattcccagtacttatcaagggtgaggcatacagtagtcatttaataaatgtttgagtgtttaaatgaactccataaaaactgaaaatacaaattaattccatggtatttcattttcttttccaatatagttctcagagttgctaattaataataaaaaaggccacagatgagaagaaaaagaaaaaagtgtgtgtgtgtacatatatatatgtacacagacatacacagtgtgtgtgtatatacacaaagtgtatacactgtgcatatatattatatataatatatatgtctcagtcactttattggatgaagcaatggatctttatttccataatttttactataagattcaggggaacattcgatttatatatgtttttgaaaagttgtaatgaattacattttaaaaaattaacctccttaatttattataactcagtctctaatcaatttagacgttttttcctaatttagaattcttaatgtggaggcaaaaatgccaggatatttccatttttattaatattttaaaactactatctgggaatattaggattattaaaattactttttaagtgtgttctatacattgttttatgagaaaacttggttgattctattttgtttttgagtttagtacagtaaaataaaatcttgttaaagggacttctatcagaagggtacgtaactagaaatcccacttaacagaatccagtaatatatatcatttatcagctaaaacaacctcgttgaaaagaaaacatttttttctaagattttataatgtataaaactttaaaagttaaattaggcctggtgcagcctgtaatcacacctgtagtcccagtgctttgggaggctgaggcaagaggatcacttgaggccaggagtttgagactaggctgggcaatatggtgagatctctgtctctgcaaaaaaaatttgtttttaaattagctgggcacggtggcacacgcctatagtttcagtttctcagtaggctgagatggaggagctcttgagcctgggaggtcaaggctgcagtgagctgtgattgtgtcactgccccccagcctgggcaacagaacgaaaccctgtctctaaaaaagtaaataaaaatgaaatttaaaatgtacatttttttatatttaaaaaattttattgcccaccatttgttctgcataatgcattgtagatatatatatttagataaatccaaatcacctaaaagcaaattttgtagattatgcttttctgcctgttgaccatttcattgttcgttagcataatatttaaaagtgaatcattcggggcctcactgatttaaaatttacaatgactgagtcactggactgaagcctagctttttacagccccttgcctagatgttgcctagtaaattaaaataacatgtttacaaaattacaaggggaaataaaacttttagtgacctttatgtacttaaattattgctgtattatagatttgttgattataagtcatgcctttaatacatacttgttgattaaaaaccaatagtaattgcagtttcttcaaaaagattctgaattaataaggtatgtatactatagtcagatttatgacttttccctttggccaaatatagcatattgggattatgcttggaattattttatctattttgtccccattgccttaaatttttaaaaattggaatgttctctgatctctgtgtcagtgttgtacataattagaatgccatggtgtaccagtgagaaacaaagtagaatagtttaattccattgactgatggaaattgatcgtaaaatgttaaaaatggttacctaaactcggaaatgggtatatgtagttagtagatttataggaataatagcaagtcgcatatttaatttgataaattttatttgaaaatagttcccttttgtacttttatgtttttataaggaataatacattcaaaattgaaaaccaaaggataatagtgattttgctcataaatctatttttcagcattcatttac

SEQ ID NO: 69984 - DNA, 1040 bp, Homo sapiens
ttgatttaatacatatactgaaagaaataaaacacttaaattttatatactaaacactaatcattaaaatatatttagaagtttgttagaacacaactttttaggaagaatttaaattcagatgtcattttagaactagatgtgtaatcacatataataaagtatttttaaaaagtgtgtatcagtgattctcaagtggaaagcacacaataaatttttgtttatgaaaaaggcaatcactttttcttgagaagttcagaaaaacaatttccttacctcttgccaaataaaatttagaatcatggaatttataaaaattttattgaagtgtgtgttatattgctataagaaaaacagttgaaagtcaaggttacacagcttcactctgagtgtattatcttgtattgactcttagtgtattaccttgaacattgacatgtttttttaattcaaaaaggaaaaaagaaaacctttattatttgtaattagcccaaattgtgggaagaacattgatctagagatgattatccttttatttttttttgacatgtatagtgccttttatggattagattgaaagtatttagatatttgcactaacatattagtattagatatttatctaatacttatactaattatgtattactattatactaatcaaaaattttagtatttagatttttttcagtttctaaatggcatctgattatctcagtgagtaaattctaaaagactaaagctatttgtgaaataatctttaaaattaaaacaccaataattaaattaaaacaccaataattaaaacaccaatagttaaatttattttctaacagctcagaaacagatctttgtataaaaagaatttaatatgatcaggaggcattgtagactaatacgaatgggcagattatccaggaaatatggttgagaaaattggctcatatctgagaattcttctctggaattttaaatccaagataattgttaagcatatttaaaaaggaaaaataaatggaaaaaagaacttgttacaaatg

SEQ ID NO: 69985 - DNA, 1608 bp, Homo sapiens
caaaggaagagggatcgtttaacttattttcttctttctaaaaattatactgattttgtaacttttagaatattacagttttttaatattaacatttaaaatatcttgaggttatatttatctgattaaataaactacattgttctgagaaaccaaaagaaagaaaaggcaaataacactgggatatacttgcgtggaatcatttttgcattcctgttcacccaggcttttttctgcatttgaatactagtttttgctggtctcgcatagaaactataaatggaatcttcagtgcatcataacagtgaggtcacagtggccttggaaatctctgctcttacctgtaactttttaaagcataactcttactgtttctaccatttttactctattacaataacagaatgcaaagggtcataaaggagatgatttgttgctgcgggtggtatttaaaatctgaatgttttaaatttgatggagcaatggggaatggagcaaactgtaaagctgctctagttaatcaaaggtaggaagatataatagtgctttgtattggttggtgtggtatatgagagttattttgttgattggataaggagtatcttaattcagggtgagttatttttttgaggttcaagtctttaaaaaagtatctgagttgagtactttataaaagaaatgtaatgatcaaccacatatctcataaataggcctaaagtactctttattataaatatgttgtaatataattggctgcattatgaaaattttttttcttccagtgtgaaaaactcaaattactgtcttccatcatataccgcttataagaactatgattattcggaacctggaagaaacaatgaacagccaggcctctgtggcctaagtaacttgggaaatacgtgtttcatgaactcagctattcaggtaggtctttgtaaacaaaatgaaactcatgtttcatggaaatctgtaatacaagaagataaagttgggtttttcatgccagaacatgagtatatgttttgaaagttcatttttcatggaagatttaagcatacatatttgacttattcattctactactggtagtggaatatatgtttctcaattaggtgacctgtgattgattaacataatgtacaagattatatatcactttgcaaaaatataatatcagacagaaaacttaagctgtctaaaaagggagggaaaaaaaagcaaaactaatgagttccctccattattcagtagaagtctgttgcactttttttttcttttttttttttttttgtcttaatgggaaattaaaattttaaaaaggaaaatcttgggaacttctttttgtatacatactttaacaaatcactttcccttaaaggtcttttaatttggggatataagagataactacttttcccctgcccccaccccctttttcttttctttctgctctagtctatatcctcaacttgttaaatatttatgtctttgattgattctgaagtaatgagagagatatattttttaatatcactgttactgtgtataaacttagggctggttattttattccccttttacagataaaatttctgtgtttataaa

SEQ ID NO: 69986 - DNA, 2436 bp, Homo sapiens
ggctgaagtatcttgtatcaattattataattatttcaaggattttttttgtaattaaaagcaaaacaaaagaaatgtcaatctgtagtctgtaatgggaactacagatttgctccctccctccaagaaaataaaaggaaagaaaaacctatttcagatttacttctcttacttaaaatcaagcagctcatttttttgatgtcaaaatgttttctaaaagtttaccatttacttctttacaatgatttataaactattctgggcaggggagagggtcagtgagttggttacttaaaccattgttcgattaatagtaatatctaaatcaattactagttctcatataaacccatattaaaacattaacagccctgtattgaacctgcagcctctgttaagagtggtacccttctttgcataatgcaggttatttttttatattgtttttcacttaattttctcttcacagaggtctgtgagttagggcataagaatctctattccactaatgaggaaattgaagcaaggaaagtttgatttccagtcactaagacaagttattatgagttgttattcagtacattttgagataatgtatttttttgaaattatgccaatcaacctataagaaatgcttatgttttgttttttgtggtaaaatataacaatttgccagtttaaccattttaagtgtatagtaacattaagtatattcacatgttgtacaattattaaaaatgtttttatgtttagttcaaatgattggcccccataatacaagatgctctcattaagtagcattaatgttgtgccatttaaaacagtttccctaggaggtgatatacacacttactcattcaatgttcagaatgttaaaaactattcaagtactccttttggaattgcttttattcttctgagtatcactggtggatatttttcatccttcaatgacaaagttgatttttgaaagccagaagttattcagagcactattttcagaatattgtagattatcaagctgggtaatttttttcaagtaattcataagtaatgaatgactgatgaagtcatttactcagcaaatatttattgaaggtctattaggtgactctcactctcataatcactaattatgccatgatgaacaaaacagttttttcccatggagtttacagtctaatgagggagacaaatattaaatcaatcatgaattatgataagtatcatgaaagagaaagtagagtgctaacaggaacttggagagcacctgttttaagctgggtgtcatatttacgaaaagtaacatgagctttgaccaaagaatatgtatgagtttggcaggtgaagttagaaggaccaaaaacatgtgcaaagccactaagaagggcaagtttgaggaatcagaagtgtagtttgtggaataatgtatgaaggggagtgagacaaaatgagtttgaaggagtaggcaaaagccagatcatatagggagaatttagattttaatgttacaaaggcactaaaggtttcaggctactatcttcttaactggttcattccatttgtctgctagctggtttctttgcttctatccttaccctccacaatctgttcttaaaagaacagccagcaattcgtttcaaacctaaggcattttctattacttaggcaataacacaaaatgccttctcatttcactcaacgatcaatgaaagccagagtccttaaaaaaaagtacaaagccctgtaggatctggccccatgctagcttatttcctatcacttacctccatgcttaccttgttccatcctcaccctcacatgtgccaagagcgtgcctgccttagggtctgtgaacttgcagtttcctatacctgtaatgttcttcctctaaatatatatattcttgcactctcacttccattaggtcgctattatctatcagtgaggtgcttcttcagtcaccctgtaaaaaataatgactgccccacattccacacagtactcataaccatctggcatgttttatttctattagggttttttgcttgtctgtgtatcttcccctactcccaacacagacaccctctccccgcgtccccaccccgtgctctctctctccctctctccctctctcccatgactgctggaattttgttttagtcactgttgtagccccattgcctggaatagtgtctggcatgtagaaggcactcaaattaatgaaaggtgaagggaatcacaagtgtctctctagtttttggcttatatatcataatgatagatgtaaccatttaatgaaattccagagtagtaggaagaagaacatagtaggagaagtaaatttggggtggggaggagattatgagttaattttaggcatgttcagtttgtgatgtctgtgaaacatccaagcagatagatcatagacagttg

SEQ ID NO: 69987 - DNA, 2975 bp, Homo sapiens
aatcttgatggatttatagaagttagtaaggccaaaaaaaaaaaaaaagtacatttccaagtagatgaagtaatgttgcagactttcagattgagagagtatgtggaggaatgactaattaaataaagctggaacagttgaaaagaaaagggtattgacaaaggatgaggctacatagatgagcaaaagacagacccttctaagaatttgggcttccaatctgtaagcagggagagccgttaaaggatttatagcaaggaagcaacatgatgagatgtacattttagggagagcactctggatactactggaaagctaaaaaatgttcagttatacctttaagctctttccaagataagagtatatgtgaataattaagttataacaaagtttaagaattactcaggtttgtgcaacttggttcttttgagatatttgtaaattaggttctttatataattgcattaacagacaataatggaatgttacattcttagcataaccctgagctgatcaaatataagaagcggaaaactattgataattgttggaaattcctatctgacctgtcctttgtctgactatttaatgttgatcttattttgtactaaatcagatgatactaagtgatggcatttaccctctgtgtagctatgatgcattctaaattgcctggatctccctttagtgctgggtttataattaaaaggacatataatacaaaggaagaagagaaactgaaactcaaaaggagtataagattatgagagaggttgagatctaagaggtaaaaagttagggaagcatcctttctcttaattgcctcctacactgtagcatacctctctttctcctgctcacatatattaaaaagttctactgctgaaaatatgtatatgactctaaaggcctatatagctcactccaaacattttagctgtttttattattttcgttgcctaagaattatataatcgtaaattccatgatattataaccagttgtcccttttgccttgaggtaggggccaggctagcaatttataataaataatattatttttattatatagaaagtttctaaatagatattattgactacttcagtaaacatgttgatttataattgaaaccacaaaattgagtaccagaattattctaaaaaactaagtaaatgttgactctgcttattttggaattttagctaaacaatgcatagtatatagtcgtagtttatggcatgtaagttatctgtgtgaattcaacaggctgaacctttcatagctaccaaacctgtctaacttaatacaaatgactataagcaagcttcgaaaaactctgatttccattaatgtgaatccaggctctcataagagtgagtttctactattttccatgcaagcaactagcttccttgcagcactttgccacttaattccaacacaaatatcatcctacagcaaaaaaaatttacttatgtgaccatatgtctgtgttagtcgttgcatattatagacatctaattgataatgtaatactgggtttgtattgaggtcaaattatatggatcatcaccttaaaattattccaacttgagataaaatgttgaaaaattgtacgtctgccatgttttattttaaatatgaaattttttaattcggaattggaaagagttggaaaattaacttatttatagtttttattttgccataaaggaaaattgtatcgtttatgaaattaaagagctggaagtgagaacacacttaccagagttcacatactaaagtttgttctctcaggctcaagtaatctgtactgtctcttctaaaaatggttgaccatatggaaggtttaaaggctgctctttcatgataaataattgacaatggaagcagtaaatacctctattaagttaatttcttgcttgcactctatctcagtttttacctactcaggctaatttgcaggtgcctgggatgagtagacaatccataatttctaccaatcaagtaaaagaaggaaagaaaactgagcttctctcccagttaccaggtagtttgctgtggttaaaattaatgcagattttacagcagcggatattagcatttttatttattataagtaattattttgaaatttgggaaatgaatagttgagtacatcatttgagtgtttatttgaccagttattagtgcaagaaaccatcatttaaatgttctctgtgttatagcaaatcaatttgtttctctcttcatattaatgtgttttaagaaaaattcattatgattacttttacttgaaaatatattttattttttgcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaaggttagtgtggtaaatgcattttagcaagggtacctgcaagggtacaaaagttggttcttggggatagggggagtgaaaaatagtagctattacaatggtttgtggccctccaaaggaacacagtacataaatagatatacagtacatctgtgatataaaatttaggtgggagggatatggaacagtttatctgttttgtttttgtttttgtttttgttttacatctaaatctggaatggagagaataatgaaaaaaagttgaaaaacactggtgtggtacaagaatgagtatagagacagcaatgagcgtttgtatagttgttttggaatatagtacatctctggaaaacctatgtgaatattctatacaaatgtaaaagactaaatttgggcatgttactgaactctaagaacccattttactttgagagtcattatgaatttgaaaaattatcaaaatgaaaatagtctgcaaaccaa

SEQ ID NO: 69988 - DNA, 1757 bp, Homo sapiens
cagctttcttgcatttaggaacactagctggcatgtttgtacttcatttagtgaccattttaaacactgaaattaacaacaaaacaaacaaaaatgtgaaaaaacataacactaaataaactacaaaggacacttgtttatagattcagagctgaaacaacaagccaaagcatcaccttgttcaaccccagctggtaacatgcatatcaggtgactcaaattttttgccactctgaaaatatctacaaatgaccatgaattgattttggggttacaaatacattttagaaagcaggcaaattcacaaatgtggaatccatgaataatgagaatctattgtacatatgtttaaaaatcaaccctgttcctagaactgatttgatggttttgcatttcttacagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtaaatttcatgatcctattgtcaccattgttataattttgtgatacctctttctaatttgtgtctattatccttgtaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccacttaccaaacctatgcaggtaaatcatgggttggtttgttttgtttttttttttttttttttgcatttgttatttttattaaaaaattagtgttgagtccttattataaaaattaagtattgaattatcaagcccaatcaataatgtttatttgtataagagattttataagctgaatactttggaaatcagtgtaactttttacagtcttgaaagagcaacgtgtgtcttataaaaaattctcaaaaggctttttatagaggtttatttttataatattggggtgaatattagcttatgaagatcaacataatatttttaatttttttaaacttcaactttctttagtgttaattgtaatttttttttactagtggctattggaagtaaagctaatacttttaattcatagtgtgatagtagtgtatttaaatacctgtaatttttaggcattttaggaacttaaaagaaagtagaaattcagttagactaaaaatattttgttcagtgatgttctctaatttctaatactttgaagtatcacatattgtttattctgtgcaaaagtcctgtggtaagtcttactgtcaaattgtctgcctgattccgttacctagtgttataattggattatttatattttgtgggtaaagcactatcttttctcccttatttattaatcagttaatcctcttctgacacttgacccatcccagtgaaagtaacttcttctttttctacctctctttccctaaattctaacacttaactaattttgttataacttttggcttacttttatcttttatccctagactacaagtctttgaagacagagaccttgtaaacctttgtatttccagcttttgtggctggtaaatattaatgcacaagaagtattcaaaaattt

SEQ ID NO: 69989 - DNA, 1050 bp, Homo sapiens
taaaaattagccagtcatggtgtcacacgcatgtagtcctagctacgcaagaggctgaattcggaagatggcttgagcccgggaggttgaggctgcggtgagccaagatcatgccactgcactccagcctgggcaacagagtgagtgagagcctgtctctaaacaacaaacaaaaaaagatagcaaaagtgggagcagtttcaagtaatgacaggatctaataagttgactgaggttgaattaatgcaagtgtctttgaattgaggagccaaggaatgataaaactaggacaaattatccatgtgggcattgtcacacaggacccaggatagtggcaagattggagacaaacactaatccaaatgccaaatgaatgtgagatagcaaccatgaggtcactctcatttactgaattttttttccaaaataataaattcattacaattttttttgttttttagtacaaagtggttgtccccaaaattggaaacatattagatctttgtacagcattgtctgctttgtcaggaatacctgcagataaggtaagatgtttctggggttgaagtatataagttggtatttagtttctcagtgctgtaaaaccagcttaatagaaattcgtttccttttagatgatagttactgatatatacaatcatagatttcacagaatattcgctatggatgaaaaccttagtagtattatggaacgggatgatatttatgtgtaagtataaaactcattgtgcaaaatattacttgaaaaaaaattaatagaagtaacataaaattttgagagtttatggtcagttttgtccttgtaggtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtggtaagtgccagacaattctacattgacaaaa

SEQ ID NO: 69990 - DNA, 2009 bp, Homo sapiens
ttcatgattaatagtattgtaaggcagcctattttttgccttcctgaataaatcccttgatttgaattatgaagttatcaagaatgtcatttgatcccttttatccttgaaagctggtatatttagtattctttcttgcatatctaattattatagtttcataacccatatataaagatcacattatacaaatataagtgtttttagcaacaatatataccatctaaatagggtaagttgagaaattatttgcaacaaacatttaacatttaacctaaaaggtaacatattaattatttttataaagatgagcaaaacaaattactagtcagttatacttatggtactaaaagtttgaatttatctttgaatctactaagtgaccactgttactgcattaaaaagttttgttttactgatagaaggaaaactttttaaaagtttttatctttgtagtactgaacttgtttgatttttgattttacttaagccgatatgtcaaaatatctactgaaactgaagaaactgaaggatccctacactgctgtaaggaccaaaatattaatgggaatggcccaaatggcatacatgaagaaggctcaccaagtaagacttttctgttaaattgtacaaatgtttcacttagataattgcctcagagaaaaagttaagaaaatgggaattaaagaactaaaaaatacctggaaacctaggattaataatattaataatttaaaaatatagcattgggtttatttaaagctctctaatatctaaaattaggtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatggtaagtatttgtgaaaaatggcttgaacattaaacaagccgagcatgttattttttttttaggtgaaaaccatgaaattcagctctgtcaagaaatataccatttacttttctatctcaaattttacatgaaaggacttaatatctaagtagactaaaatgtgtgtttgtgtttcataaatggagattgaactcatgcttcagttttctatctttttttaaactcttaaattatttcaatggcttggaaactgctgtttgccctaatcaccagtacaagtagaaaagattgctgtttgtttattctggtgtatatcctaacattaaaatatactttaatactaagacatattaaattttaaagaaaaaatatgttttccaccttagaaagatcttttcttgctttggattgggatcctgatttgaaaaaaagatattttgatgaaaatgctgctgaggtaagtcatcactcactcacttatttacctttccttgatttactttatgtgattaccagagataatcatactgttgtgttacactctttgcttccaccaaatatgtttattttgccagtaaaaaattggtcatgaactagaaaaaaaagtctttgcaaaaataccttttttttttaaaggttcagagttcattttgaacgtgttttggtcatccatatagaagtgtacaggaattatttagaagtatataaatctcaactgaaataagctttatgattcttttgagaaagtttaggagttttcattattattcatagtaagatggtatcactaaaatgagttttgtttcatttgttctcttaactcaagaaatacttctctttaggactttgaaaaacatgaaagtgtggagtataaacctcctaaaaaaccctttgtgaaattaaaagattgcattgaactttttacaacaaaagaaaagctaggtgctgaagat

SEQ ID NO: 69991 - DNA, 1016 bp, Homo sapiens
tcatggtgtttgaagaactccagacttttttctttaagatatttattacttcttaaggataaaatatcagatgtgtcttgcatatagtagttcagtattgattaatgaatgagtcagcttttgaaccttttttttttcacatagggtatagagaattgagttcatcatactcctcagttcaaggcctagtagggaatgttgtcccatttagagtgcatttccctccacgttctccttcccctttgctttctaacatgtttgatgcatatactcttgtaaatcattaatatttattcatttatataattggtactgtgctgtagatatcactaggtctcgacacttatgaagacttatctgtgttgctttgtgtccatttagtcagttgtttctcactgcttatgatttacatctgccatattttatctctccacttacctcatgatagacatctaaattccctttcacttcctaccactgtaagactgataaaccattgtttatggtatcgtatgtaagaatttatttgggctgcgtgcccaaaagtgaaattgctgagtttaagtgagtaagtgttgccagattgccccccaccccccaggatggctctaacactcgacactctgcaagcagttgatttttctgttgaacagtatttacattccttggatatatcctacttatcattatatatttttagacacacagttggattcagtcagatttatttagggttgttacaatttcattcataagtgaaatggttttgtaagttttttatattttcattatcttagtttggaataaagattagagtcataaaacaagctgagatgctttatcctttttctggtttttggaacagctagtacaatataggaattaactgttcatcaaagtctagtagaattaacctgtaaagccatctaggctttgcagccataattgtttttatttatgtcatgcatattggtctattcagttttctttttccttttctgtatattttgatgttc

SEQ ID NO: 69992 - DNA, 1058 bp, Homo sapiens
gaaagttgtaacatgtcttaatacatggtcagttccttaaacgtgtgtatgcttggaaaaaaatatacattccccatttagatacagagttctttatatctctgataatttaagcttatcaagtgtattcaaaccattactatccctggttattttttgtgttcattttattcctgagaggaatttgtcaggactcctactaaagtgttgattgacctgcttctcccagcagttttattagttgttattaatattttgcataattatacttatgttcataatgggtagctcttctttctctgttccttttaacaccaggatttgacattctttgcccctttttttttaggtattacaagtgttactctagctttctttttggtatcatttaatttacaaactctgtgcctttttgttgaatgtgtctcttatagatcacacagatctaagtgcagcatctgctctgcactgatcttgggttgagatcaacaaactcacagcacgcaaaagcattcacccagcaccaggtttacttagatttaagaaaggatacaggtcaagaaacaatacagcatgcacagcaacagcttagcagaggtcctgtgtagctggaaggagagaaaatagggaaaagtgtgctcaaaggaagctgttcatcccatggctatttccttccactcctcaccaaggctgatttttaaccagagttcatggggtacagtcatattagttgtcaaatattttgttagcccaacaggacttttaaacagcaataagactctgattcaggtagcctgagtattgctgatttctgtgacaaaaattgaagcaagaaatttaaacgctttcttctagattgttttctcatttctgcctccatccattctgtcgcattcttcagccatgttgcatgcacacaaatattcttgagttcatatattgagaacagggttctcaatttttttttgttagttcctttgactctaacttccatctctttctacggtttctctccatggttgatatttgaggagagggaaccaacaacagatagaata

SEQ ID NO: 69993 - DNA, 1066 bp, Homo sapiens
tttaaatcctaactgctagctaacagtatagtaccttgagtaaattatccttcttttgatgccttaatttcccatctctcaggtggggagaataataatgataataccttctttatgagacaatacatgtaaagtgcataacactatgcctggtacacagtaagcactacatgaatgttaattaccatttattatcattagtgttattatgtgaatttaaaaataatctgttttttcctgagatgaaaaaagaatgtttcaacttacatgaaaattatttttggcatctaattgtagaaattagaaatcatttgaatcaattgaatatgtaataaataagcctcatagatgattatcagtgttaatagatattccttatatagatgattatagagttttgaggagtccccagaaaaccaagatcattttcgtcacagtgattatatttttttcattagatactgcttttgcaaaaaataaagatgatggaaaatggtactattttgatgacagtagtgtctccactgcatctgaagaccaaattgtggtaagtttgtcttatatttcctgagaactatgggattcactgtcttaaggagtgaatataaattaataaaaggggctcatggaacactgtagtctatattctagcagcttgagtagctaaaagacactaactcttatttaaagaaatgtcaaattgtcccctaaatggaaatttgtcttctaaatttgcccactaacaaaagcataaattgcaaggtgaaaaaatttttggtagttttcaacatggagtttctaataaaaataattaagttttgctttggaaagtagattcagctcttaactttctagacattgagtacttaaagccagaatgtttaaacaagagaaaaaaaatccttgaagtaccttaccgtacctgtgatctttaaagtcatatcctgccttatgaaaattaactaaactcaaaatgacataattagataaaacaaattacagatttataaaagattaatacttgtgtacttactactttgatattttctgaatagtaaaaaaaatg

SEQ ID NO: 69994 - DNA, 1694 bp, Homo sapiens
tggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggccttatttagtcttttatttcttactcttaatcttttaataaaaatcccctactttatggttagatgactatatgctagactttttagttataaatagttaatactagaaaggaaattatgtcagagcaaaatgaatcctactattaaggacgttttaaagttgatttttgtccactttaatatttattcattaaacatatgtttgtgtaccaatcactgttgtagagtctggagatacagcagtaaacaaatatccttaccttcacagagcttacattctttctgccatctaccaactaatgaactatatttccatttttctgaagatttaaagaaaagtcaaagctaaatcttttaaacctatattgtggtctccatcctaattcttcagagaccactttctttttaatgcctgtcattaacttctgttcccactaaaagaagtgatgttaataatgccattgaaactgccaaactcaaatgtcatttttcagctgcaagaagtatactttaaaaatagtgcaaaagga

SEQ ID NO: 69995 - DNA, 1077 bp, Homo sapiens
taataaagtgaagcagaataaaacaaggtatgcctggtttttgttttgttttgttttgagacaaggtctttctctgtcacccaggctggagtgcagtggcacaatctcatctcactgcagcctccagcctctgggctcaagtggtcctcccacctcagcctccgaagtagctgggtctacaggcatgtgccaccacaccacacctggctaatttttgtagagaccaggtttcaccatgttacccaggctggttttgaagtcttgaactcaggcgatccatccacctcggcctcccaaagtgctgggattacaggcatgaaccacagcacctggccatgtattttcatttaaccagtactaaataactacatgtctttggcagcctataatgtagcatcccatttttaaaaatagaagtgtgtattcagggtgcactcaataggattacatctggctggcagtcccttcctacttcagtccattatcctgctaccagaatgatcttcatggtttcatttaaaaaaaaaaaaaatgagatcctgtttctgtcttaaagttctcttctaattccttgtattaatcaggattctccagagaaacaagaccaataggatgcatatgtgtatacacatatatgtatagctctctccctcatatatacacatatcatgtatatacatatatatcatatatgtacatatatatatatatatatgagggagagaaagatttataaggaattagttcatgcacttaggctgagaagtctcatgatcttcagtcagcaggctggagacccaggaatgccaatggtgtagttcaagtccgagtccaaagggttgagaaccaggaaaaccaatgataaaagttccagtccacaagctacctggctaaagacccaggaagactgaatgtttcagttttagtgcaaaggcaggaaaagactgatgtcccagttcaatcaggcaagagaaattatccttacttgagccttttttgttctattcaggccttcaattcatgagagccaccaacattagagagggcaatctgccttactcagtctactgacttaaa

SEQ ID NO: 69996 - DNA, 1049 bp, Homo sapiens
accataggctcaggagttaaaccacctctgagcctaccacttttgtgcaactcacctcacctctctgcctttcacctctctgtaaactagagcagctcccgaatgtccatctaggaaggcttggggtgagcaacctgattagaagggaacaatgtgacttaaaactgcatatttgcttagcaaacctatgacttttctcagaatatacagtttgcttgtgatggagggctattaatatttataaggaaaccaaatccccattcacttaagccatccactcctaccactgtaattgaatattacctacctttcagaataattgcaaggttttgtgtcttgatcattatgaaaaatgtggcaggtattattactaataaagaagtacccaactatgggaatgattgttccttccttatgaatgagagcagctctctgttcaatacgattcatactcaagttctaataaactttctttagcaagagagcaaagagtatggtacagtcagtccacccaggttgcctgttaacctggtgcttgaaggaaaaaaagtaagaatttgccctcatctaattcctcacttgccctcaaacatgtcatactacttgacaatggggctttcccacatttgtcccacatttgcatggtctgccttatctcttacctggcgaactcctacactccttcaagacttgctccaaaatgcacttgctagatcttctgacatcaactgccaccttgggctataagttacgtgtgtctcttcccccactagacaattacctgatggaagaatattgttcttaagatgttaagatggtgtatgtgtggcatagtatttgttcctaaatgtaaaagttattaaacaagttttctgaaagtctgaagctttattgtgtttattgtgattgtgttgtattcctgacatgttgctggctacatattttaacagctttaaaagtaatttaccttatgaatgtgcactaaaaacgtacattttagatatactaacattttaagttcggtatttatgaatttggaatattcaaga

SEQ ID NO: 69997 - DNA, 1039 bp, Homo sapiens
aagagaccctttctttccttcaaaatggtgtcatatgaaatttgaggtgtggaatggctgcagccgttgttgccaaggttggatgtagcctgaggatgaacctactcatggaacagggcagaaccaagagaatggcagataagtgaaactgcaaccctgatgacattgtaaatctctggatcagacttcctctgcatgtttcaatttgtgatacagtaaagtccatccctctctctcccctttttaagtgagttagaattggcacttgtagatataatttgtgtgtgtgtgtgtgtgtgtgtgtataaaataccaacaagtttttctggtacatttagaactttccatttcttcccttgggaacatttattatatagctactgtatgaaaggcactgggatagacaataatatagagctatgaatgagatctatttcttatctttattattcttataggtagtatgaagaaacagacataatgagatgaataagataaagtgttacaggtacaagccatagacagtactaaaggtagaaagacttttcagtagttaccgtagaagaaagtgatggaagaaaagatttccgtcactgcttatgacactaggagggtgacaaaatcagaaggacctgcaccataagtctatagctatcatcttgttgttactaatggtttaatttcagcaaagcattatttgtcacattaaattagtacaatttgggtttgtatttcatttgtgaatatgttggcattataatttaagacctataaagagtatattcctgattgtatttatatatacatgtaaatttgtcaatgactgggtaggtccatagtttgtttcttccttttaaaagatgtccttacactactgtactaaattttgagaaacactggtaggagtgggcactagggaatcattgaagaattgagacagtggatggatggaggacatgattgtaggtagagacatttcttcatttaggttgataatgagtgttgaactaaagtgtgggagtgagatttgagaaaaagg

SEQ ID NO: 69998 - DNA, 2281 bp, Homo sapiens
tgtgtggtggagagagaggaggcttgaaatggggaaaaggagcctaattattttcagtagattttgtttttgtttgttatttttattctcggaaaatttaactttgcaggggattgaggtattccagataatgccttaaggcagaggaaggcaacatgttgtagtgcattcagagtttgcatgtgaataatcaaattaatcatgttttattacatttaacgtatatgtcactactgggcttagtatctgatggtttgaaaattaaaaaggtggtagggtagtgactgactttgtgcttgatattttgtctatcacatatgacttattttccatagataattcattttggcagtaaattttgtgttctaattatttttattcttgcaggctgctgaatcaggaataataaaagttaaaacaattgctgcacgaaacactgaaattttggcaggtaattttttgtattaaaaatttaataataaacaaaaatttgactaatagtaaaagtagaatctttattgtaaaagccatcagttttctgtaacatctcttcctcatgccctaacatatgctattcataatgaaacagaatgggcaaaagtccataacttatgaactgactgtatttcccagagacgaatgctacaaaaattctctgaaatcagaaagcttaacactactgactccttaaaggcaaggaattttttcttactcatcttcgcattctcctccacttcctgctaatcacctgagacacaccataaaaagcattcagtaatatttgttccattgtattgaatgaaagatttgttctcagtccaccttctgtgatctactttctctttaatataatacgaacagttcataacatagtcttctgtatttagttgtaccgtatgaattttgagtcttgggattaaggcagtatgatcatgaaaaaagaatgagagtgaagtagagaaaagaaaacaaaaatgttttcttaccttctcttgattgaacctgattttcaaggaggaattttcaggagtttctctttggcatccttcttttctacccagtccactcctttctcttccttggtgccttttgttcttgcctcaataatgaacatggaaaagaggtaaactggcttttttttttttttttttttaagaatctgttatatgcaaggcacttgtgtcattctatcttacataacaaccttgtggggaaatattatcttatttgatagtagagctaattgagatgtgaagaggttaagttacttgcccaaggtcacaggaaaggtgatagaaccagattaaaatccaggagtgttcaggagcccatgttcttcctgctacagtgtgctaccatggtatcaccaggtttccacgttagccacttactcccaagtattacatatgtaaccagtgcttgcttcagtgatcctttaatctgcatttccagttccagtagtgctgttgatctcagctaatctatgaggaaagtagtcctattaaattaatttacagagtccaaatagtaaataatctctttaactttcatatactttacattttttaaaagggataccagtaaatctgtaactggtgggatttcagagtgttatgaaatgaaattaagatttttggggtcagattaaggatcgggggcaagagtggatttcacttaggctatccagctttgctggaaatttgcccttagcataagcgctcctcaattacatctgtttcccacagctttttccctgattttgaacagtcttatcaaaacacccaatagttttataacattatgcacagaagtaaataatgctctgtgtgcatattgagaagtggtatagtgaaagtggtgggtaaaggcagaggtgcacatggtagggttaggaaggctggcaagtgggttttttttgtttgtctgtttgtttttcctgagatggacttttgctcttgttatcccagctggagtgcaatggtgtggtctcggcttactgcaacctctgcctcctgggttcaagcgattctcctgcctcagccacccgagtagctgagatttcaggtgcccaacaccacatctggctaatttttgtatttttagtagagacagggtttcatcatgttggctaggctggtctcgaactcctgacctcggggttctcccgcctcggcctctccaagtgttgggattacaggcgtgagccactgcgcccggccagcatgtgggttttaatgggagatgtacattaggcagattagctactgtggggaaattggtg

SEQ ID NO: 69999 - DNA, 1598 bp, Homo sapiens
gggaggctgaggcaggagaatcacttgaaccggggagtcggaggttgcagtgagccaagatcgtgccactgctctccagcctggggacagaacaagattccatctcagaaaaacaaaacaaaaaaaaccaaaaagacacacacagacacacacacacatacacacatacacacacacaaacacacaaaacaaataatcgcttatgagtttaatgttctcttgacttggaattccgtgttatttattcaaattctgtaaggatgacaaacttgtcttatccatctttgtgtagcctttcagtaaatgtgtgtagatttaatttcattttgtaaatttaattatgtgtaattcagtttgtgcattttctaacctcgtgcattttctaacctcttacatttttattgccacttaaaaacttctgagtgagctggcttggtagaagaagttaaattaaggttcggaattatagcatgtgtacccaattaatttaaagtgctgtttcagtaataagaggagtaatgttattgtttttaatgaaatgtgtttatttcttgaagaaattagggctgtttaaattcaaggcatataataaaattctaggaaatttcttaatattcatttacaagtattgtggggatgatgtatgtactatttttaatgattctattctagggtgggaattcttatttatgttttccctcctgtagtatatgaagaaatagagtgcttttttgaggtgggaaagaagttttgaaaatccatgtcctaatagagtttgtagcagaagatggaggagaaccaaaggacagagtgttaggagaaaagcatgggaaagcagtagttaaggcgtatagcttagatacagagtctggagtgtctgtccaaggtattttaactcttggtacttgatttttgttttggtgtttattttacgtaaagtggattttttttgagatcgctattactggttgtaattatataaaaatgcattcttaattatagattaattttaataatttactttatatgtgttctaaatgaagcactgaaagagaacagctcagaggttgtacagccttttttaatgggttgtggaaccaaggaaccgaagatcactcagctatgtttggctgctattcagagactcatgtcacatgaagtcgtgtctgaggtaatatgaagattttatctaaacttcacctaagagttgaatcagaagttttcatgaaaggagaatgaaacatacctgatatttaatataaaacttttacaaatagcaatgtgctcggagaaaatggctttatttaaaaatattgccaaattttctcctcattaaacactcacaaacaagtatttttgcaagtcatttgtaatctaagaagtcacagttcagtaatgtagatgaaaattttgagactcaagcaagttttcaatttaattggttatttaatttttcttttataaaaagaggagggaagagcgtgactctctttcctagattatatggagtaataatttgtttttcattaacttaaacgtattgttcatatctaaccttatgatggaaaaatgagaaaaaatatttcttaaccatgaat

SEQ ID NO: 70000 - DNA, 2612 bp, Homo sapiens
ttgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggcctgttgtggggttgggggaggggggaggggggagggatagcattaggagatatacctaatgctaaatgacgagttaatgggtgcagcacaccagcatggcacatgtacacatatgtaactaacctgcacattgtgcacatgtaccctaaaacttaaagtataataaaaaaaattcattcataacacagacaacccaattaagtatggacaaatggtttcaacagacacttcattaaaataatatattcaaatgggtgacaaacacatgaaaagaagtttagtgttattattagggacacaaattaaaaccataaggaaatagtattatgcttccattagaatagttacgatgaaaaaagaccgtaccaagtgttatggaggctgtagggatagttctaaattcacgtatactgctggcagaagtgtaaaattgtaaaaccactggggaaactggcggtttctttcttttcttttctttttttgagatagtgtcttgctctgttgcctgggctggagtgcagtggcgcaattttggctcactgcaaccttccacctcccaggctcaaggaattctcgtgcctcaggctcccaagtagctgagattacaggtgtgcaccaccacacccaactaatttttgtatttttagtagagacagggtttcaccatgttggccgggctggccttcaaatcctggcctcaagtgaactgcccacctcagcctcccaaagtgctgggtttacaggcgtgagccaccatgcccagccaactggcggtttcttaaaaagttaaacctattcttaccagatgacccatccatttcacttccagatatttacccaagataaatgaaaacatatgtcctcacagtgacttatatatatgaatgttcatagcagcttttttttttttttaacaatagtcagaacctggaaaattcaccagcaggtaaatggataagcaaaatatggtgtactcgtacaatagaatactgcttggtaataaaaggtacaaactactgataaacagaacaaagtggatgaatttcacaaatattattctaagtggaagaaggtgggcccaaatgagcacatactgaattaatctgttcatataaaaatcatagaaaatgtccattgatctgcagtgaataaagcacatgggtgtttgcctggggccacgggtagaggaagagatgggtggcaaaggagcacaagaaaacttttggggtgatggaaatattttgtttgtcaattgtggccatagtttcatgggcccacatgtttgtcagaactcatcaaattatataagtttaagggattctataatttattgtatataaattacatctcaataaacttgagttttaaaagaaaaaaatgactccttttaaaagtttcataattttatttatttatgtgcttagcaatcacatagcttctccagatcattaagtgatacaacaaactttgagttcatgttatttgcaaagcacgtcattctggggaaataaaagcataacacattgttatatagatgttaaaaaaccaaattttaaaaggtatgtttcacattaccatagctaatcttctgtggctatatatttactgacaacttggattacatcaaaatctgaggattttatattttattgtaaatggtgggactttccataatggtgattgaaacaaccaaacataaattattcaataaagataatggctttgcttttcaatcttatttcacactaaatgaaaattgtgttttcaggcaatcgttctttgttttcgactacacttcacaaaagataatattacaaataatacagctgctgctacagtgcgacaagttgttactgttgtttttgagaggatggttgctgaagatgaacgacacagaggtaaagtgctagaagttgttttactttgtgggtggttcttggatgatttcatttgtattaactttcggcctttgctcagatgatcaacattattatgtctataatggcaacttaaaaaataaattcctcacaatttgatcccctgaggaataggctccttgttttccttgtttatttctagtgtatgcataattttgtattaaatatgataatttcacattttaaaccaagtattgcattatatgtattttttaaccaaacattacattctatgaatttttcatgttattgcttcgtcctcataatttaaattttaatgattgcattatatttcatggccattctgtaatttaactgaactagtctcctattggacacttgcattctgttcagtgttttataactgttttgggtggtttcctacgtatct

SEQ ID NO: 70001 - DNA, 1050 bp, Homo sapiens
gggaaacaccatcctagctgattcttagctggtgagtatctgtaactgacatggtaacagcagcagatcaagcagtaattctcttgaaaatagtgaaatggtagaggagttaaccatatggtaaacgtttatgtttgtttgatatttaaaagcacatttaaagatcatgtgaattttaaatccatgaaaaaaaggggctgaagaatgggagactgggaaaccaaatgtatgaacaaagatacccagcttattagagtgaatgtaaggtagcaaagagtgatttttatggtatttggtgtaaaaacagattcccatttttttttgttttggaggcatatgttaacattggaaattttaattctgaaattataacttcaacttatataaacaaatatttattttaaacattatcttttaaacagaatatataatttattaaaggctattatgaactcctaaaacccatcctgttttgattgcagatattatagaacaaccagtactggtacaaggaaatagtaacagaagatctgtcagtaccctcaaaccttgtgctaaagatgcatatatgcttttccaggtattttagttgataaaagtaatttttattctaaaatatagttttgtgtgaattttttagttggggattttatgtctaatttttttaatgtgaatttttttgaaaatatgtcaaaggtagtattaagatagttctaaagaacaacttttatatttactttatagctaattaacatgataaaacgttattactcactttaagaaaatgaaataaatgcagaactagaaaacaggtatatcagaaacaactagtcatacaaaaaaaagtttctttaaaaaaggaaaatttaagtaataaatttggtctgtgtagtataatttgatacatagatacctgatttttacatcacttgtcatgaataaataattttaggtaaaacaagattaatctgtactgaaaatattattacttcggattaaaagcttagtttttcatttgaaataatgttagattaatcatttatctgtcta

SEQ ID NO: 70002 - DNA, 1033 bp, Homo sapiens
tcaagtgttccttccacctcagcctcccaaattgctgggactactggtgcgtgccaccatacctggctaattttttaattttttttgtagagatggagtctcactgttttgccaaggctcatcttgaactcctgggctcaagctatcctcccaccttgggctcccaaaatgctaagattacaggcatgagccactatgctgggctctgatgactgttctgaccttagactctctaagtgcaatacgaatttcaaaattgtgcgtaaactataaaataataaaacatataaacttatagtaaagctaaattattaatactggttattaagaagttttgtttcctagtgagactgtgtttttggaagtattaagtacaaataaagttaattatttttttctttcttttttccttgcaaatagcaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaagtgctaatttccttatgtatttgtgtatatagttgcatgttgtgccctttgtaaaaagtggtctgttgtagcgcatttagttttttcaattcagttcaacagaatttttttgagtacctacgtgtagtctaggtactctaaaggtttgttctatcctttcttgaatcttgcttatgtttatagagtattcataatgtgtgaagcagagtcattgcctgttgtctgaagccagcataggaattgtcgttttggaactcagcttcttagctaattgtctgtatctcatttgaaggattattaaaattatagtctcttcagtttattctgctttcatttatactgtttcatatgtcttaacagattaaagcaaagacattaaagatttggtcaaatctaagattagaaaccaattat

SEQ ID NO: 70003 - DNA, 1131 bp, Homo sapiens
agggttcagatatctccacatcctcagcaatgcttgttaatcttttttatcgtagtcatcccagtgagtatgaaatgatatcttaccatgctttgatttgcattccctaattactggtgacaagcatctttttgtgtgcttcttggccatttatatgtcatgttgggcgaaatgtctattcagattcattgctcctttttaattggattgtctttttcttatttaattttaagagttatatattctagatgcctgtctcttatcagatatgtgatttgcaaaagttttctttcattctgtgggtcttttcattttcttgattgctgctttttgaagtacaattgtttttaattttgatgaatctaatttatcaattttttcctttgttgcttgtgcttttggtgttatatctaacaaacctttgcctaatccgaggtagtgaagatttttacccatgttttcttctaagagtttttatagatttagctcttacatttagatcattgattcattttggagttaattttgcatatggtgtgagataggaccatcactcttctgcatgtgaatatccagttgttccagaatcattagttctttgtcaattgaattactcttttttccaggaattattttgccagatgtcaattttaagaggtttagaaccatagttcactacctgccatgatttaaaacagatttattgtccttccttctgaaaactttctcctaactatggggtaaaaaattgctccgcagtttgaacttgacacactgatgctcttattctcaccttgttggcagattgtatttgaaatgataggtgagctgggcatctcacagcatgaaaagcatcttcctcttcataggagtgatttgatttgatggcatcttattttttttttattttttattttttttgagacagagtgtcactctgttgcccaggctggagtgcagcggcgcaatctcggctcactgcaagctctgcctccttggttcatgccattctcctgcctcagcctcccgagtagctgagactacaggcacctgccaccacgcctggctaattttttatatttttagtagagacagggtttcactgtgttagccaggatgatcttgatctcc

SEQ ID NO: 70004 - DNA, 1101 bp, Homo sapiens
aggtctcattcaaattttgccagttgccctagtgatgtccttttatgtgttgaatttagttgccatgtctcaacttggaagtttcttagtttttccttgttttatatgaccttacttttttgagtacaagtcagtcagtttgagtttgtgttgtgttccttcataattacattcagcttattcatttttgacaggactggcacagaaatgttgctgtgctgtacttactgtatcattacattaggaagcatactacagtatcaatttgtgtcattattggagatgctcacttctatgagttggttaatacaatgtcagcctggtttcttcagtgtacagttaattattaactttttgtggaaaaatactttcagattgctactacaaaagagtgctttcccttctgcatttttttattttttaaaaattattcacttatattagtgtagattcatggattcctattttattcagaggattatagtctttattattatttggtttgatgctcagattgttcccaacatggccaatgggacctctttcaagatgacccgtgtgtcctttggacatgtcccatgcccttttgacattctctgagcacttcctatttgatagaacaagatgttccaggctgatcttggatgattcttgtccatcccaggtgtcagtcatttctccaggaagtcctggttccttttagtggagaatagtattgaaacgaacacaggtatactaggtatgcttttcaccacttggataggaaatacatagccacatacacacacccccacacacaagcacacgtctctgtacatttctaaaatgtctgtttctctatattgaattaccatgacatcacactagtttcttcagttccagttcagtaccacaaggtttatttttaactttctgtatttgtaattcccttctccaacagtgttggaacctgctcacattttgctcagtgtatttacttatttgcttgattctcagtgtatgtaatcagtctcctggctgagccagtttgttacactgcgccctgccctcactccaactggtcacacaggctgagaaagtttgggttgatgaaggcaaagg

SEQ ID NO: 70005 - DNA, 1073 bp, Homo sapiens
aatacagtcctaaaattacagaatgcctttttcatttcaagacttacaactacttttgcaattatgattatatttaatttctttgttctttttctttaggatttaaaaatttactggtttcaaaatgcttgatattttaagctaaatctttatgttcttggtcattttcttcagtaataaatacatgtattattattcattgcttttacccagttcaaatttttgaggttatgttaatagattaaaattccttcttaagtatattggtaatattttgacaatatttttgtatagattttcttaaaatgtcactgaatacttaattccacatcatgctttacaatgtaattaaaaataagttaatcagattaaataaaatactttcttttcagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatgtaagacaggcttactcaaaattctctctatgtagtgggatgatatggtgtagacagaagattataaacatctgagtttaagtctctgctttttcacatactgactgtgtgaccttggggaaattaatgtccctgagagctctttaaaaatatggggtggggggtggggggtgggcatgggatatccaaaaatccagaatctaaaatgctgcaaaatctaaaacttgttgagcaccaacatgacaaaggaaaggctcattggataagtatataatgtgaataggtatataatgcaaacataagtatttacaaatatattatgcaaataaatgcataagtatatataatataaatattcaaaaatctgaaatcggaaacagttgtgatcctaagcatttcggataagggatactcaacttgtaataccaattttaaacaataattgtgagaggaaaataagataaatctggaagtcctttgtaaactatgagatacc

SEQ ID NO: 70006 - DNA, 1625 bp, Homo sapiens
gacagtagcaagctgtacaggtttgtagcccaggagcaataatataccatatagccccggtgtgtagtaggttatatcatctaggtttgtgtcagtaaactctgtgatgttcatacagcaacagaatcgccgaatgacacatttctcagatcatatcctcatcagtaagcaacacatgactgtagtttgttatgccacaaaataagaaaccttcagcaggaggaggacagaggcaaaattatgaaggagatcttatatggttatataaatgatttgaatttatccaaaattcatgtgggagacattttgggattttaagcagaggaatgacttaatcacatatgaattttatagatatcactgtgacagcagcatggaagggaaggtaggaaatgagaatggctacaagtgctcactagaaataagagatggatttgagctacttaacggattgactgtagcgaggcataggggaaaatagcaatcaggagtgacttctagatttctgacttaggcagtttagtgggggatggtagtatcattaactaaatagggaaaagacaaggaagagcaaatttggaggggacatatggacttgtttaacttttggggtaggagattgcagtggagagattaagcagacagacattggatagatttttctgtaattctgcagtatcacacttttgttttgatgactagttcggaagttgtagacgaccaagatgcttgagaatattatggaaagttaatttttcttaaatatttatagtaataaaattctttactacaaaatattgagatgcttaaattgaagaatcagcttagatcaagcttaagtgtcttctcccaacctataatgtggtgtactaaatagggcattgtagtaagggtataatgaattaatgggtgtaaaacagttagaaagtatgtgacatactaagcactcagagtattagcaattatacttatcattttcattactattttttaccaccaggatttttctccaaaactaaatacttcttattatctttatttgaaattcaaaatttactcttttctcactgactggatgtgggtttttatatttctttggagatttaaataagatacagtacggatataaaagaatgaggagctctttttcagtaaattgtgtgtatttacatgtactggacactgtactagatatcagggatacagtgaggagaaaaataactgtagcaaacttgccattctcatttattgtctaagttttctttggttagttggtatgaaatacaaatagaagtaatatgatgttaatactttatttttaaatttgtttttatttcttattgcctgtaagcttctttctttgtttttgttaatttgtttaagtaagcatgtcttttttacatttatgtaaatgttaaaatactttatgatcaatattaggagtttcttgtttaaattctgaaataaaattttacttcaaattattgtaagatatgtatttttacacatttcttttaaatgcataagtaaggctgggtgtggtagctcatgcctgtaatcgtagcactttgggaggctaaggcaggaggatcacttgagcccaggaaattgagaccagccaaggc

SEQ ID NO: 70007 - DNA, 1026 bp, Homo sapiens
ttcaaatactacaccattttatataacagacttgaggatttgtggatttgggtatgcagtgggaggtcctgaaaccaatcccccacggataccgagggacaactgtattttactattactattatttttcccatttttacatgggaaaaaatgtaagcatgttgcatatatgattgcaagtgggtggctagtgcaacattgcttaaattactgctggatagcacctcctttattttacatttatgttcacagtactggattctctacattttaaccattggcataattatcattaatataagatatgtttggaaacagtaattgctcgtgtatgaaattacaaacttattaaacaatattaaggaattgttaacattgttagggtgataatgatattatagtttttttttatagttaacagttgttatatttaggtggtagatacatcaatatgttcaagttccttatactattcttggttttttgtatgttcttgacattttttataataaaaaagtaaaaaaaaaaaagttagctcaagattgtttccccactttctcctgaaataatgtagagacactgacagaagaagagatgttttcattgaatctattctactaggaaagagatttttgaagtaatgtttttaaagttttactctgaaaggtaaaacagccacatgttgcatatttatgtgtttaaaacaaaaccttggatgaactaatatttttctactttgctttttagtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcac

SEQ ID NO: 70008 - DNA, 1050 bp, Homo sapiens
ggaggtcgaggcgggcagttcacctcaggtcagaagttcgagaccagcctggccaacatgatgaaaccccatctctactaaaaatacaaaaattagctggtgtggtggtggacacctgtaatcccagctactcaggagtctgaggcaggagaatcacttggacctgggaggcagaggttgcagtgaggcgagattgtgccattgcactccagcctggatgatagagtgagactccatctaaaaaaaaaaaaaaaaaaagaatgtataattactctattggtcagtttcctccaatatatagggattgataagactgtcaagtatattttttgtaacaatttgtagattcttatgctgttgctcctatgctattacttaagctatattatcaatgcattttaaatgacattttaataaatatttaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggtatacgtacatttttttctgattatacaagtaattaatgttaaaagaaatttggaaaatacagacgattcttttagagtctatcttaacttagtctttatgtgtggtgtgtgtgtaagcatctgtgttttcattcgtttgtacctactgtgggctagcctctagaggatacaatgaaaggcaaaatacacgtcattcttgctatcatgggcatgaggaagtacccataattacataaataaaggcgaaatttctacaatgatgtgttacaaggagtggtactttgtgagcttcggtaagtatttgacctggccagtgaattccagatggactttcctgagaaagcaatagttttcctgagatctgtagggtaagtaggagttcatcaggcaagagtaagacgaagtgtggagagccttatagtca

SEQ ID NO: 70009 - DNA, 1078 bp, Homo sapiens
catatattttccagttctgtaggattttaagcagaaaaattaagcaaatatgctttcaagtgtctaatatgaagagaaaatttgatcgcttttatgataatagtttttttttctcttcctaatataggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggtaatataattttagtggctaagtaatactgcatatagttctctgaaattttttttattttgctatatatttgcggggataaattttagatcatcaagattgttttatatgtatactttgggataaactgaggattgtcaagatctaggtattttgaaaacttgtggatttctgttgcattttgaaaggtaattcatgtatgttttgaatcttaaagaagctgcctgcatcctaatgtttcacttcaccaggatttttggtttgtccacgcaagtcttcacaagaggatataatatttggaataaaagttttagtaaagtacttttat

SEQ ID NO: 70010 - DNA, 2354 bp, Homo sapiens
aaataattaaaatctgcagtatcatgatatgcattttattctttcttcctatcaaattatttgaagtaagaaacctagagaaactagttactatttattaaaatgttttcttatattaaaatattttattttaaatcaaatcgatatatttagatacatttcacattaaatatacacagccctgtcaaaaattaatccatacatttcttttagaaacaaattttcgtagatgacttattttcccaactgtaacacacatgattatttgtttaagttggtggaccaggcatggtgcagaaatcagatgtcatttcaatgaactgatatcacagaatttgaagtcagtgtcatcgtggtcagtcacacattcttaatggcctaatggctgtattactgaacaaatgatcagattgtagaacctgaggactgcctgggacttcactttgttggccctttttctattcttttaagaaataaatcacactgtaaaaaagaacattttttagctgattaacagtttcagcctatactttattctataacagtttaaaatagtttgtgtcctttagggctcagaaaagatggtataatacataaaataagacagtttttaagattctgtggttaaacaaatatatacacagtaaagaacttaatggagttcagattatgcattctaatgttcttattttgcttttataggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcaggtaatttactgtaaattttatttactttgtaagatttcatggcttataaatacagatagttccacttaagatggactttgattatctcggaaaaggatacttttcactcacaaatatatttatacatgtctgttagcagtttaagctgaacagaaatattgtttgggaaactagttctgtgttctttttctcctcatttatgactttcctcttccaactgattcttcagaaagtttggcctttcatattactctccagtacatctttcttgaaaaatataagttcctttgtacctctttcttggttgccccatcccaatacaaaacagcttctaaatccctaagtctaatcttacttaaaacagatacctgccatgcaagatgaagaaactgtttgtactaaataagaagttgtacactactggtgtgaagtttagttggattttatataaaatatttttatagccatagttggcaaattttaactttgtttaagtaaatttctgaatgcatgcccatgctgattttgttcactcaacataaaaattataattttatatcgtccgaaagtagtttaaatatgtattaacttttctcattctatttgtcttgcaacacaatggaatcacaatagatccaactatttgcaccggtgagttaaatttcctaaaattgtcctaacctcttggcaacaaataaagtacatctttcccggttcttggtagaatgctgtatgtgctttttccaatagttttaatttttgcctggctgaaaattatttttttcatgaagtacatatctctttgaaaactttgcatgtaatataatctgacctaaaaccaaggcctgaactttaagacaaagatgctttctctttgaaaacaatatgattaatttaatctcagtttatttttaactgcatgtgaaaatattactttctaggcggaatgggtagccttgaattatgtgccgtttgctgaaaggtctttagaagtagttgtggatttataccaaaaaacagcgtgtcacaaagcagtggtgaatgagaaagtgctccagaatattattaaggtatctttttttcatttctacactttcattagatggtgtgaacattattgaaattattccttaggtaatacattatcattatattgggataaatagaaaatacaatttgtagtattatttgtaatgacttttctccaatattcatgaattgtatttagcaagccatttttctaaaagttctttttagtgaaaaatattttaacataaatatgcattaaatttgttacagttcttaatgagaacacatggacacaggaaggggagcatcacacaccggggcctgttgtggggtggggggagggggagggatagcattaggagagatacctaatgtaaatgatgagttaatgggtgcagcacaccaacatggcacatgtatacatatgtaacaaacctgcatgttgtgcacatgtaccctaaaacttaaagtataattaa

SEQ ID NO: 70011 - DNA, 1047 bp, Homo sapiens
gatctcttgacctcgtgatccacccaccttggcctcccaaagtgctgcgattacaggcgtgagccaccacgcttggccagaattttctaatccataacatcgggttaagaaaaggtacagaattgtgtttccttctcttaacttttcagataatatccctattatttatgatgaaaaactgaggttcaaaaatgttatttatgtaggctcattgtttataagatagagataggatttaaaagtatatctttccaggcagtatttgaggactacgtctgagaattggcctttctgcgaaataacatcctttttaaatgaaaataccatcctttttaagatgaaaatacctatgctattttttctctgctgtagtttttcttaattaaaattgtgtgtgtatgttttaattaatgcttatattaaactgtctttattttcagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaaggtcagctcattcatttttaaaattaagacaagaagtggcacattatatcttcagttgctctaaaaacagttgtctttattcattaacaaagtaattgattataaaggttgctagattgtattaaaaacacacctgaattagccatttatccattgggtacattatccatgaacaatggagatttttgctttttgtatttttgcttataagacaggaatattatatataaaacaatacaaatgcatcatatttaagaattttaacttaataaaactaagaagattcagtttttaatttgatgcccattgggcattgcaagagaaaaacaatgttagaaaatcagtgtattaccagaataaataggatgagtggcaatataatgatcagctctttaagatgtttagatttgtcaaaga

SEQ ID NO: 70012 - DNA, 1069 bp, Homo sapiens
tcaactcatccttagttacctccaccatcatcacaaatcttttaatattactaaacccttaccttccttggttataaattaaaattaaacacaacttttgtctctagagatgcagatatagtctgtgaagctgctttgatggcagtgattgtgaaattcctctgattggttcaggtttgggtaaatttctttcagtttttttactctagttcctactaccaatttatagttagcttaggacttggacaccagaatctaagttctatgagaaatggactgagtctgtcctgttcacagctagatcttgaacacccaagaatataatacctgatgcaaagtagttggtactcagtagatatttgttgaatgaaaaatgtccaaatcaaagaaaccacagtctgatgcccatatattcctatatacaaaattgtacattatacttaatatacagaagtgtatattaaacctaaatgttctaatactatttttacatctacaacataaaaaagaataatgtaggctcaaatatcagataaatctaggttgagattgtggcctcatcatttacttaaagtgtgttcttgggcatattagtaggcattctaagtttcagttccctcttctcttgattatataataattactacatggaattgctatgggagattaatacaaataaagctcatagtactgtggctgtctaactttttagctgtcattattctaacagttattactatcctattctcaactgtttttaaatagtatcttgctgttttttaactttatgtccattttactgttcactcttatgagccacagagtctggaatccaccttggttctctcagaactattgattttctttgttcttgttggaacaattttctgctttagaaaatctgcatcagtcttcttctttacagattttccctctttattgtaaagatctttaatccattgtatttattacaaattaatgattaatggactgtctctgagtgaataattcagcagctgaactaaggctgtcttaaataaccaccaatataagtgaattcaggtaacac

SEQ ID NO: 70013 - DNA, 1050 bp, Homo sapiens
tgtattaaagctcttgtggactttaaagggcaaaataacatactacatgttagagataaactatttgacaaaaatgaatataactttaatttctcttacagctgatagtttttggttataaaaagtgatttaaatgttattcttaatcctattttgaatattttaattctaacatgggtaaatttcatatgctatttttctctagagccctatttgcagttatcatgctgaagatcaacatttgtccaaatggttggcatagtaaacagttatggtactgactattttgtattaaagttactaggacagatgagagaaacagattagtagtcattctgtatgttaacattaaaatgtttgtgtacttctttaaaggagagttctttaactgattttcatttaaagtaaaatttaaattttactctagaaattattttagtctctttcaaagaaaacaatacatttgcatttgcctcttttgttttaggtagttcaacttatcagcaatgagatactaccttatgccaattttattcctaaggaatttgttggtcaaataatgacaatgcttaacaagggctcaatacattctcagtcatcttcatttacaggtatgttaatttttttaagtattaaaaagtattgaagtacttttgaagaaactgtcagtagaaatgtttaatcctatgattttggtaatgtaaactggagaatggtaaggtgatttttaggattgtaatatagaactaagctttatgaggagaaatgttatgacatgactattctgtggaatagaatgtttttattccatgtttctattctgtgaaatactgtgtttctgatcatatatcagaaacactgaactaaattttttaaatatcataactgcaaactgtgaagaattaaattgcaaagcactttatggaatccatggatgtcactgcaggctgacagaagttaccagttttgtgaagtcatagattggaaaggaatataaaaatatgaatgtatattctgccacttagcagtcaattaacttttgagtctcag

SEQ ID NO: 70014 - DNA, 1016 bp, Homo sapiens
ttgttatggggtgcttttttagatccctcatggagattatgtaacatatgatacataggtaccaaattacctttttgaattaaaaaaaaataaactgaattccaaaatatatcttcttccagagatttctggataagtacttgtggatctctatgagcacatgatattatttctctaaagtgaaaatcataaatcatattttaggaatatcctagtttgttttacagtcatttgcaggtttctctctgtgtcagctagcctgatcttaggtcttcttttcatccaatctgcttagttaagcccatggacctaaactgatttatttctcatctgttcagcctgtgtcagtggaaggtgcactaggcttttctgatcagccaaggctaatcagagttggagtacagaccagaattcaacaaaggatacagtcataaattagggttaggtttgcaaatacttttataatgtggaaattagagtttaaggcataactaatgaagcaaacagaaaataacatgggaaaacaaagttatcaaagtcaggaaagacgaaaatcattgttcccgtctcataaggtaggactggagaggcaaatcaccagtgttaaatctttgtgcacattttaatttacttataataaatttctgaagttggaattgacctgtcaaaaggcacagacattttatagcttttgatatgcattaaccaaatttcccaacagagatttataccaatttacattctcccaggaatgtgtgaatgtccctttcctcaatttttagcatttttaaattatttgccagtttatcatttatctttttctaatttgatgaatgaaaaatagtcatgtggtactttgctttcattttttaattaccaatgcatattagctatttgtatttcttcttttaggatccagtgtattttgaatttctagaacttaaattataactccttatactcaaatttatacacaaaaacactccaaagacagatgttagtaatttggctatggg

SEQ ID NO: 70015 - DNA, 1004 bp, Homo sapiens
ggcgcggccaccacggaaaccgttagtttcacattttcctagaaggaattgaggggagtggggtggaccgcgatgcattttaaaggttgggaaagagctaagccattggattccttttcttgaaggaaggagtggaattgtgtaagataattgatacagataactttttcaccctaaaaaattctaacacttctttcagcagttaaatgccaaatttagtgtgtacctgttttacttcattctttagctgtaggttggagtggtgtgagcgatctgcagaactggcattagaggggcagaagaagtagacctgataattaaagtttatgccttaacattttagatctggtttctgatatgctctcttagtaaatctgagtgtgtctttaaaaacgtaaacccaaagcaatttaaagtttctctttaaactttgcaactcgcgaatgagaagattgaaattatttgtaggtaattgcactattccgattttttaatgtatgaggcaaacaaataaattctatgtacagtgtgctgtgaatggttttgttttttgttttttctttttagtttaaccttggggctcagattctgctggtgtggtgggttggttttttggtttttatggcctttgattctaatgttatgtggtacttacatctttgaggttttgtatgggagaagaggactaggaattgaaagtggtttctagatttgagtttaaaatctactaacactcattttgattcctgagtggccactactcctaataggaaaatacctttgcatagagaaaaaaggtagtttggataactaatgaaaatactcagtgctctaataccctgaagtctgcgtggaaaacaagatacttgtatttttattttattttcactgagggaagtaagtggtcagttttagtacttttcgttgaaaactgatctgtatttgtacagaataagtagttttgaatataatgtaatcgcagttttctatggttttctgatgct

SEQ ID NO: 70016 - DNA, 1069 bp, Homo sapiens
gtcctatacagataaactattcatactttatatcttgtgtttttaaagtaaattttatccacaactacatattgcccaaatagtagtaacatttttgagttattggatgtaaaggtactttgagaggttaactgtttcctaagttacaagagaaaatactgccaccagctgacttgttttaatcccatagctatatttctgctctaatctccagttttaaaaatgatctgctaattacatttctctacacaccaactgaaaattaccaactgaacattttccttgttgacagtttcccacaagatgaatttgatttatcaaaaatacagctttctgaacttagtattattgacatttacttggtgcagttaacttttttgttaaaggtctgttgtcaagcatttaagtaatttgtagttgtaaaaagccactggtggaaagtaataaggcagtattttgagtgcccttctcaataagtacatactaaaccaaaggaaagctgggttatggtaataacattttaataaatgtcatcctcaattggaaatggagactgtgttatggtatataggacacaccatatggagaagattcttggagaacacagttttgcttcatactttaaaattcctgattgctaatcttacatagaaaagctttgtttacaagctattttaaaataaccttttggcaggtaggcaagactgactggcaagggtgcactcaagacattgtgtcttgtggagtggtccccaaagaattcctgacagaggcacctgacagcacaaattagctcttcagtgtataagcacaaagcaccaaaaaggctgagatttcttcctagctacatgctctctcccgctattgtttattacactccacccgctccatggtgaagctgacaaaggagatactattaatttcctttcccactgaataatcccctctgtaatttctacaacaaaaggtaaataggacaatcatcttcgaaaatgaattaggccagattggtagtacccaaaaggagaattaatgaccattgtcataaactctgaaaagctgttggcgc

SEQ ID NO: 70017 - DNA, 1055 bp, Homo sapiens
gaagggttttccatttaacaagagcactagtatgaaaacattagggacaaatctcccatgtctttgaaattcggattctcctcttgagatccccttcctcacctgccaatcaactttataaggccacaagtggtcactggttttccttccacaggtttgaggttctcagctttccttaagcgacccagcagctccgctgttttcagagtgaatatgttaagctttgatgagattctattttcagtaagttagtgcttctgggacacttggagaaagctgtgagagtcattgtctacgcaaagaacaacgaagctgatcctaaaagtgatccaatctaagaaaatggtaaaacgagctctggccacagcacagaattttatgtgaggaactcagatttttgaagacttaacaattgcagagaaaggttgcagcctgcacaccatagcccacctctctgagcagactttggttttgtgtggtgacgtggcacatgtttgtacactgggatttttcaaaggacgctacgcgagcagactgacttgcctcttctgtgagcactgtggcttttgtcagatggagtgccggtctgcagaggactgctctttcgaatccacagtgttatctgtgtaaatagctttaatttttcttctgtgtcttaggtgaagttttgttcatgtagcaaccaggtagacagtgaccaaataaggctgtaaatgtgctgtagttttctactgtgatgtacttgaaggagaacctgtgtcctctacttttctgatctcccacaagtattttgtgtttgtttcctgagtcctgaggttattattttactcctgttttgcccccagttttctttgttttttttctggagacccagggaggcccatggtggagatcatttgtaaggaatggatcatggtctgggtttccaaaactaccctagtacagtgaatgagagaaatctgcctggaaattgtttcagaaccatgtacctttatgctttgtgattgtgaaacattgacttttttgtaaccccaaaatgaaaactgtttagtaaa

SEQ ID NO: 70018 - DNA, 1029 bp, Homo sapiens
tatttatacaactgtagtgatgcctcccccttcccagcctcacttgaccctggcttctgtctgatgctctactgactgtctcgttcctggttctcctgtgtaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtcatgaaaatggcccaggggattgggaggacagaggggaagaaagctgggatgcctcttggcaggacggaactgggaagtgccccagctgagttccaagtgatgcagtctcttcccagcccaagcggggagttcatggccaaaagactatgcttcaagatgaccctttggtttccatttcttctttagtaacaggtcaactcaacaagagcaaaacacaaaggctgctaccaagtgttgttgtatttcagttcctttcataggcctccgaggtggccattgactatttggggtatatatgtcatatttattttatctagagtagctggggcagccattttcaggtgtaaatggcagaggactcttcagcctgtcaagctgccagcttatctacgggttaaaaagtgctgcattggaaagtagggggtcatgcctcaaaatgtaagtaagtgcccaccttctaggaagcctgaggtttatttcagggattgccgtctgccccccgccccccttctctttttttcttctctgtttctattcttttatggcagtggtggagtgaggcagggatttttttttttttttttcgtgtttttgacattccttgaatctgttttttattccccttccacagaacaggcctgggactttccaacaccctgctaaggaagttctgtgtccaagtcccacccaggctgggttgtccccacctcctccagcccacacagcccaggcagcatccgggccagtgccctgcatgacagagggtctttgttgtgtaatgt

SEQ ID NO: 70019 - DNA, 1058 bp, Homo sapiens
ctcaaaaagagtagaagtcagaagtaagcagaataatgtcttcaaactgctgagggaaaataacagacaatctagaattgcataacaataaagctatcagccaaaatcaaaggtaaaaataaagattttcttaatccaaagactaggtgagcttaccactcacagaccattgttaaaaaaattactaaaaatgtaattcaatggaaggaaattaaatccagaagcaaggagtagtttcataaaaagcaaagaagttagtatgttggtttatttatgtaagtgtagattgtaaatgataatgattaaggcaggctcaaaaaaaggtgaattaaaataataggcagtaacatggaaaatgaaagaaggcattctaaggtccttttattttcaggaggacagaaatacgattaacttatatactaaaaatttaacataactgataatagaaataacacttccaatccagttgggggaggggaatattaaagctatccacctgacagaaaacaagaaagaaggaaagaagcacataataaattaaaaacacaaaataagttttcatatgtgtgtgtatatatgactgcaaaatataggtacaggtctaccagtttttgcaataaacaaaattatcatcttagtgactatatggattttgttttaattagccatgtgctactaataaaatacacttaaaataatgcaaagtttattagctgggcatggtggaatatgccttagtcctagctacttgggaagctgaggtgagaggatcacttgaccccaagacttcaaggttacagtgagctatgattatgccactgcactccagcctggatgacagagcgaggccctgtctctgaataataataatgcaaagtttagaagtcctacactgccctgtggatttcataattgaacaatatcagggtgtgaaagtggcattgaaaaacactatgatttcttgcctaagagaccaggataccattaactaaggatgatagctggggatgttccactttggaagtaaaaagaaattaatgatcattgagttcttccta

SEQ ID NO: 70020 - DNA, 1050 bp, Homo sapiens
atttctacagggtgtgctcaggtaagaaaaggaaatgatcccacaggaaatatctgagaagtaaaatggattattaagctaaggtattagtaaacatgtggtcatatttaaatataccttgactatataaaacagtaataagaatgtctaatgtgtgggttaaaaatgatagaactaaaatattgcataaaaatagcgtacaaattgtcaagggaggggtgttagctcacatgctatgcttcttttgagaagttaatggtgtttaactttaggctttaagtaaacaagttgaaatagctaagaaaactgttaaaataatagaaagggtaacttctaaactagtaaaggagaggaaactcacatggaatagaaaccaaacttctaaacaacttatgaatcaaaggaaaaaattataatgaaaattagaaagtacctgggcctgaataataatacatatcaaaactgtaaaggctgaaattttagcctttttttctaatttaataaactaagcatagatgaagactccattcacctctgacctgccagaaatgactattatccctctatgccatgagctaactttatccaaatgtccccctgtgtcacagggaacctctggccacaagatcctgatttctggaaacagagaagaaaagaaagatacccttaaccacagagaaagatatttctgagtgaggccctaagggctgacttgtgttacttggctagttcggtctatattcttcgcataaatgtacacagaataatttttttttttttttttgagatggagtttcgctcttgttgcccaggctggagtgcaatggcgcaaatctcagctcaccgcaacctccgcctgccaggttcaagcaattctcctgcctcagcctccctagtagctgggattacaggcatgtgccaccacgcccagctaattttgtatttttagtagagatggggtttctccatgttggtcaggctggtctcgagctcccaacctcaggtgatgcgcccacctcggcctcccaaagtgctgggattacaggcatg

SEQ ID NO: 70021 - DNA, 1049 bp, Homo sapiens
tggggggccaaggcgggtgaatcatgaggtcaggagttctagaccagcctggccaacatggtgaaaccctgtctctactaaaaatacaaaaattagctgggcatggtggtgggcacctgtaatcccagttactcgggaggcagaggcaggagaattgcttgaacctgggaggtagaggttgcagtgagctgagactgcaccactgcactctagcctgggtgacagagcgaccctctgtcacaaaacaaaaaaaaagaggtactttctctgccaaataaaaatcccccttaagttgaacgtagatacaagtggtaaagaatttgagtgtttgtttaggcatttcagcggcatacctttctcacatttttacttcctctaagctatcctctaaagtagaaataatcccatttctgatcctgttgatgagagtgatggcaaatgcaccccagcactgatagtcatccattggagaattgtttcttttgagaaatacttggtaagaagagaaagatccaagttaagtatttcttacagtctagcagcagtgtaaataacctaaatatccttagaagactctcagaaataaacagaaactacctctcgagaaaggcagctttatctagaacacaagtcaccatgagtaaaagccagcaggaataacagaggcatcagaattggacctgtaaatacttctttattggatttagcagtcaaaaatataaatatttttagctgggcatagtgatgcatacctgtagtctcagctgcttgagaggctaaggcatgagaatcgcttgaaccccggagacagaggttgcagtgagccaagatcgcgccactgcactccagcctgggtgacagaggaagactcggtctcaaaacacaaacaaaagaaagccaacaataatataaaatattttaacatgcttcagaaatttttttttagccaagcatggtggctcacacctgtaatcccaacactttgggagataacgcaggaggatcacttgagccacaggagtttaagacaagcctgggaaacatggtga

SEQ ID NO: 70022 - DNA, 1049 bp, Homo sapiens
cacacctgtcccctccagggctgcaaagactcttccagatgtctgagtcctggggagcttcagagcccattagtttgatgtgaggcttccaggaacattaagaagctatttaaggaattgaacaggggaactttgaggatgtgggtatggttcgattgagtaaggccaacaacagcttcagggagggaaggtcaggactccggagcccagtggaatcctttgaagcctttgctgctggggaggataagcacacagtgggatgacttgcgcggcagtccaattcttctgaaaacatttttgcaaaatgttctgcatcacaggttaatgtataggacacgagttgtaagtggaaagttagcaaagatttttggaaattggctaaagggcaggaaacagagggtggttgtaaaaacctcaaaagatgttaattggggagtgcttcacagaccagggttgtgaccagctttttattattttcatacaaattacatgaagaacggtcttgagaaggattttcatgttggctaattaaactacattagggagccgagcatagaaatgggaacggtagaattagggaaagattacatttattgatggaattgaagagtagcattttataacgtgtgtatgtatcaacccacacccattctgttggccagatttccatttgagtgtggacaagacaacttcagcttgaataacacaacctgtcacatttcttgggtcagcaggaagcactttaaagagggtttggcaccctactcatagggcagactctgaaattaaatggatgttatctgcagacctgaaccctctcttttagaagaagctgcaaggcaaatggaatctcctgtttaactgcaagcataagattgagacatccacatctcaccacctcttatgactcaatattgtctatcataaagagttcaaattatcccaaaaatttattgtaggtataacccaataagaagctaggaatcggccaggcgcggtggctcatgcctgtaatcccagtactttgggaggccgaggtgggtggatca

SEQ ID NO: 70023 - DNA, 1004 bp, Homo sapiens
ggtgtctggcatgtagaagatgctcagtaaatcatagctgctgtgattactattagctattattaatttatacagactctaatcaagttgccagttttaactcttgagtactatattttatactttattactcaaggctttgtaactatggatggaagtccacttaactttatatgatgatctgtgcttaggattcagaaagatggagggggagaaggtgttgtacttttcctcctcattggtgctattcccccttgtcgttagttgctgggggagagggagtgctcatagttgattgaaaaccaacactggcggggcagaataaaccttccttttccaccattgtttctatttctaatgttttgttgttcctgaagataagcagaagctaacatataatattaaaatttgcatttggtttggtcctgtgggtaacaactctaagtgtgtgtctttcagagttgtgggacatggacttcgtgctcctgcaacactctgccatgtgagaattcaatgacccggcttgtgatagagcagttttcttactacttctctaagcctgttaagagtgctcttcgcctgtctctattaagctctaggtaatacccagtcattggttctagagctgcagccttctgcctctatttaattctagccttctagctctatttaattcctgtgaatgtctagtcatagacccaactcttctacaccagatccaggctcctcctgtgcctggatctcaaggcccagcccctttctacatctggtctccactgctgcatcctctctgtgcgggcctgtctcctcactctccacatggggtcttcaatccctgttcacgctcatctcagggcctttctcaggccattttcctcctctcccttgagccatgtagtctgttgtcttaagggtcaagctgataaggggctaattgctgaatcattttgaatggtagttaattgatgcttgatgtatagtagtggatctcaaccttggctgca

SEQ ID NO: 70024 - DNA, 1218 bp, Homo sapiens
ttttggatggaaggatctgagttcaggaagttgtcagtgagttggaacaatggactaaaactaacaagataaaattaataagggcaatggagtcctcccttcagggtaaaatatctattgtgtgtgtcattataaactagaggagaccatgagccaaaaaaaacattctcaggtcttttttcttgtggactagggtttttcatttgttttcattcagagtctccatatgtaaccctaaaaaaaaatacacataatggaaatagctttgttaatttttaaaaaatgcaaggcccaaatcaaaagaagtaataattttttttcttatttggaccacatcttaagtgttttcagttccgggtaccattttttgaggacactggccaaccagaaagaccctagagggccaccaccacagtattcagtgctcagttactgtttgttggatgcatggggactagagtggttaggatcctccaggtcctgtgaagaacagttgaaagaactaaggaaaaggaaactttgagatagttctctttaaacaattgaagagctctcaagcagaaaatagtctggatttatttcatgtttttccagatgggccagcgggtttgggtcagtttaagaaagaatttcccagagctgttctccaatggaatgggctgacattaagtaccgttaaactcctaggacagtgactttctgtggcagtccattcaggagaggccaggaaccaaggttaggtgtattgtagaagggattcctacacttggggtacagctgtcttggtggcatttcagtcttattgctgaactgctccttccaggaagtccaaaccaacagtggcttttttttttacagctttgcacaatcaacattacaaaggaaactattactttaaaaaagtatttaatggaaacttctgagaataatgcctctcagtttgggaaagccaagaatttagcaacccttttaagccttgcattttttttctcatctaaaaaaatgattcagttggcctcataaatactcattaaggaattggcccaaaatattaataagagtttgtctagaaaatctttcctaagcctttcagttttgctatctcgtaacaaataatataatctctggtcagtcatattattgtaaaactagcgagtgatttgtttggggcgctagttcttaaaaatttaattaggatttcaaaaatcttaggatgtg

SEQ ID NO: 70025 - DNA, 1040 bp, Homo sapiens
aagcctgagctcctaatttggaagctacttagagcaggttctgttcttctaccaaactttgagctgtgggtagggacccattcacaggattgtgaaatcagtttagtatatggagagcagcattttaaacaaattgaatagcacaggatagaaagaaaatatcggtgtatatcacatagttagggtaaatattgttttttgccgtgtgtttgtgcatatgttgggttaacaggattgatatatttcttaccaccggtgaaacctctgctgtaacccagtagagtctcccaaagaacattgaccagcaaaatgagagcaatctctgttgcctcttgctattttccataggcctggtgagaagaagaatctttaggccaaaagagagaaatgtttactactctcagaactccaggcagggtctggctcaggcgtgctgatagggagaagtggggaggtaggcattttcctagggactgttggttaaacctaccaatcaggtgatttcctccagggcagctgcattgtcggggaccagagcttgggccccattatggagagttttcatggaggaaaaaaagccagcagcctttcttgtggctaaggagatgagcaggtggtagccaggtatgcacaagctaggctgctaccagccctcttctgtttatcaccaaatattaatcacactcacaattcaaaggtactatttgtgcctgaatctaacttgcactatattagcagaagtctatcaggttgttcacagcttaaggcctataggcttcaactaatttaaagaacactccaaggaccaaagaaagaaaacaaggtagcatttgtttggagagcttccatcccacagggtaactttcccagggatcatatcattcagatacctactgaaaatatcttccaacacataaattcaggaacccaatgagccaaaatatgacccccaaaactagatttatacatacttaaagcctgctatacaatgatgagcctggggcgagatgttgggtccatctccaaacattctaagcccc

SEQ ID NO: 70026 - DNA, 1037 bp, Homo sapiens
gtgttttttctttttctttttgctattaggcattcatgcagcctcacttgctgggaaatgagttcacacatttggagtttccaaggagagtacagagaaaggagcttggaaagaagatgctctacagggactttaatatgacaggctggtaagaacatgccttcctctgcctcggaaccacacagtgtgtgtgaaggaagcatcaccaccataaacagccagttacacagtttggatcaggaagcacagccagagaccagggtttgtggtaaaagacaagggggtacacctgcctctgctatgtttgcttaggaccaaatcacgagccttggtttgcctctctgcttcttcgaggccctccttggggatattggaccccaggaaactgacctgatttctcacttcacatgtagcaaatatttgagggctttaaaaacacatgaagctttatgtgtttaggtcagggttattaaagaggtagaatggccaaaggtttattgagccagactgacttgggtttgaatcctgactctgattcttctaaatgagcaaagttggttaaattgcttaacctctagagcccatttttccatggataaagtgataaaaagatatatcctttgaagattcattatcaaggctaaagttaatgagctattctcattaatatcacattcaaattgaaataagaactcttgtcaggggggttgtcgtattccgaaaacacaactgtgtaagcatcaagaacatttctaggatggagcagtggctaatgttgactaagacctcagctatttcttttatctgactgatagatatgataagtacttatacactatagggttaatgtaaggattaaatgagagcgcagtgcctggcactgtgtgggtgaagatttgctcttgtgccctggggtcctaacgagcgagcctcctgccagtctggagaccatatgagaatgagaccatggaccctttcttccccatatctccaaaagagtcaaagaagtagattaagtagattttcttatctcttcc

SEQ ID NO: 70027 - DNA, 1041 bp, Homo sapiens
tgtttgatgacctgcttttttacacttaacgcaactctgtgtcattgcatattctctgtagtgtcattgtaagtgacaccatagaattcttttgtttgggtttatgctagtttatttaatgagttattcattcaatgatttcttctagttatttaatgttataaataatgtcagagacatttttgtgcccatactgtgtgtggctctgtgtgtgtgagttcttttaacaaggtttactgattcagactttgcttggtctaagtgcaaaggatcacaggcctcttatggcccctttactatcttttgtaaaaatgtgtgtgtaggttaaaggcccaaaatatggttaggatgagggttataaccatgatattaagctcaggctcaagatccacccagtcttgggcgaatgacctcgggctaggtcttaacctctccaggatgtagtgttctcatttgtaaatcaaatcgactcctgctttgtaaaattgttggggagtaagatcaggtgtatgaagtacctggtatggggctggcacatggtaacccctaagcccatgttagtccagcttgggtagtggattgtattcatgctgatacaatctgaaagttctgaaagatcataaagggcttataacagatggtgctgtccgttgaccacttatgcctttgttccttagttttcatgggcggactaaaataaaaagaataaaatagtatgtacccagtaggcatgacgagcttcatgggcctgtgacttgtgcggtcgcggagggtgccgtgcttagtttagtgctctgcttagtttaatgctctgctgtccctgtcttgaaattcttgattttgaacacaggctccctgtttctgtttttcaccgggccccacaaatgatgtagccagtgttgtccagaagattgttaagagggtgaaattagaactctcaaagcactgagtgtagtactcaggatataataggattcaataatcactaggtgactataataattttttgtaagcagaaacaactaagtatattaatagaca

SEQ ID NO: 70028 - DNA, 1082 bp, Homo sapiens
ttacagacatgagccactgcgcccggcctgagttttttaaactattaatgtccttgctttacctccttttctcccattcttgcggttgactcataagaacaccctaaaccttactgttcattgtatcgcaaataacgccccatcgattttactggaattaatgtcatataaatttcagctgtagtctttaaaggaaaggctaaccttaatattggataatatgctgaaaacccatcccctctgtatgggaatggttattgggtgggaggtgattgccaatggattaaatcacctcaaccccggcaactttctcgtttaacctctggaatgttactcagattctggtcatggtggtatccacaagtccaggcctgaggccccagaaggaaggtcagagtgtatacgtagctctcctgcaccctcgcagccacggcatttggtttttgtttttttcttaattttccttaggaaaagcatctcataaaataatgaaatagaagctaggaagtacaggggtcctgtgatgacagactgtagctttaaaggcatttctctactttattgattgtttagtatgaggtttgtcagctttcacatgcatttcgttccgtttgaaacccctttcgtctcattgccctactccagattggagaccagcactctgacaaattgatcccaagatcagagtgatgaaagagagaaagatcaaaaggaagccaaggatcacataggaagaggcatcgtgatgtaggcactgggaaggttggcagtcgaacatgctgtcatctttaatccatggatgcctcttaaaggaagagcttggtagttcaaacggaagtgaaaaaatgttctgtacatagatggatttggatataattatctatttaagaaagtaataaactaggcttgccctggcagtcatattgtaatggaacgcagatacctcattgtgtgtgaatttgaaattaaaaaacaaagtaaacatggtgagctgctaccattgctgccccctccctgccttgcccactaaggagagaggcactgccttgtttccctttgtatttcaaggagcttctcggtgg

SEQ ID NO: 70029 - DNA, 1044 bp, Homo sapiens
ataaggctggggcaatgagaagcactaaacaggcctatctccacctggtgttttgtggtagagatctctaccttagtacaaaacatagaccaattttagcaggaaaattcaaggattttttacacagtttttgctgtagatatatgtcatgtttcttgtagaaaatataaacaggcaaaaaagaaaaattgcctataatctcctcccctccccaaccactgttaccaattaggggtatatctttccagccttttttcatacataatcccatttgccccccagggaaattacactctgcatacaggtttgaaacagcttttccccttcctcctcaaatacagagtaatggaaaataatctaaacatttcttaatgcttccaaataatggatatgaacttctgatcccttattcctccgtaactgtggagtccttaggaccttactttatagtattaatatttattgttggctgtagtcttctttgagattacggctttttatttagtttttttctaaagcctcctgtgttgtggttttgttatctcttgctgctgtcaaggagcctgcatgaaacagaattccttctcctttctggattagtccttatcttttttgacttgaaaatcatgtacaccctggtgtttgcactgtatgtaaactgaaagtaaacaacatctaagttagggacagaaggtcacaagtacttaaggtttttcccggagcagagtatgactggtgtgtggttagaatgtaatctttaacctgggactcagtgcttacccttcagagctagtctaggtcatttggccatttactcaccttttataggaaaagttatttttctttagtcattctgggaattggcctaactattaggatgacatttaagtcgctccaggttaaattgtaggacagagttagatattggaattcctgtatatatttagtggggtctgatgagaaagagcctaaacactggctgatttgggaaaggtctgatagagaaaaaggcacatgtaccctgactatgccttcagctccagc

SEQ ID NO: 70030 - DNA, 1049 bp, Homo sapiens
taataagcttaatgataaaatactacctctaaaacctcataagcttaattatgcttacagtattctagtcccagtatccagatataaatttggggttttgtagttgattatttgggttttctgttcacatatgggtcatacttcaggaaacctgagaacaatgtgagttggtatttttatgtgctatccaaaggatcgtttatgcgacacttactagagtgctatttgcagctcttttacaaacaatagatactgatatcatcttctaggattgttgtctagtttgccatactaataatataggtatttgagcttacagaaatattcagttattcccaagaaaccacagctaagtgagctttgatcatatctgtggaaatgtaggtccattatcactgattgacgagcagtcaggaatcccagggctcagtttaaaacaaatgcttagagccgcagaaggttctggcaacagagccctgattaatgaagggctaagttttctttattgctagatattagctgtcatgtgctttttttttacatcttgacagtttcgagagtaaaaaatatttgttatatgttcactgcccccataattattcacgctcaggaaaagagaagctttgccctggtttgatttggaagctgccaatggtcaggaactaagctgtgtatcatctgatttaccatcagacatctgcacacttaggggttgtattcaggaaatgttgcctgatgctgtttgtggctttatgggtttttgagtcaacgaccatcccattcagaggacataggaccattcatgtaggatggtccacagtgacgcgagtacctgatccatgtggtctggtccgtgccctgatagaacttgcccttctactctgccgagctaaccagccacagaggcacatgcagtaactgcttgatgcatgccagttgctttatttttccccggcagagtcagccaactcaacacctaggggatcataagggaccaggaaagaagcagatggtgggcggattttcacttcaagcaaaaaatgaaccag

SEQ ID NO: 70031 - DNA, 1039 bp, Homo sapiens
ggcagttttatgccagtgtcctctccagaaatgctcatcaggtggtaggaaagcaagcactaaagatttttctagtcccttcttgaagcacattcagagtctggggactgtcaagagaatgaaagtgagaaagcttttgctacacatcctgcacaatccaacactaactctgttttattctccaggacctacagatagaacgagagaggagttcatataatatatctggtggctgcacggccctcattgtgatttgccttttggggaagctgtatgttgcaaatgctggggatagcaggtaagcagatgagctgtctgattcttgctaatttctaatgccttctgatgtttttattttgtctcaaaaattaaatgattagaaataattaaagacaggccttctacatcagaatgaaaatgcatttaaggacaatcaggttgatattacaaggtaaaggcagtctcttacttatgcatatagcatttcatgtacacgtctgtgataaatctaaaccagtagtattcaaacgttttttgacttcagaatctgtttctcagtgaaaacttagcaggagcataatatgtgagagtgatgaggaggaaggaaagggattcgagtgccctgggtgtttggaagggggcctgggatgactccccagttgactccacttttacttagtgactttgcactgttctctcccagaagcttctccttttatgcacattcccttagaagctgcagttgcctcacgtccgggttcaactgaaggaaatttgagccaagagatcattgttaacccttcctttatccagcattgccagggaataagatacatttatgtttttatttcatttattttttaaaaattagacacagggtctcactatgttgcccaagctagacccaaattcctgggctcaaacaatcctcccacctcagcagcctgagtagctgggattacaggttgcaccaccacctggcagttgtgattttcttttaaataactgatgcttcttcacttttggtgtggggaatttt

SEQ ID NO: 70032 - DNA, 1127 bp, Homo sapiens
cccctagagcaaagcagttgctggtaaatgctggggtcttgacttctctcccccttttccatgaggagtctggttgaagcagctgagctctaactctgtgggattctcaggattacaatagtggcctgaccctagatctgccaacaacagcatcaacgtcaccgtttcttcctcttcctgtaatttttagccagccctcattttccttccctctgcaccaaaagtagtagattaccactggaagatttggcattattttagccaggcattcaatgtatcttactaacacagatttttctgaggtaacagaacctttgcttctatcgctaacacagaatttcacaggtatctgtcttgatgatgccagtgttggtctatttttaatatcaattccttggggaggcctcattaggtggcaggtaacaacacaaactttggaagagaagcaggttggaatccagactctagccaggtaaatatgggcaggctaccccacttctctgcaactaaacaatgaggttcatagtgatggtcttgaggacgatatgagagtttgagtataaagtgctcagcacactacgtgacgtagagaaagttctcaatgaatgtttctaattattataaacgttttaccattgtaaattggtggctgtgggaagaggaaaagtcaggtcagagttcagaagccctataagtcatttgaagtcatttaagtcattataagtcatttataatttatttaagtcattttaagtcatttataagtcattgtaagtctttgccctataagtcatggcttgactcctgcctgtgttgaatagaagacatctttctgtaatttatctgtaaaagagactatttatccaagactttggagtttaaaacattgatcatatctgggctgggtatggtggcccagtgctttgggaggctgagacaggattgtttgaggccaagagtttgagaccagcctgggcaacatagtgagaccctgtccccacaaaaaatggaggagttagctgggtgtggtggctgcacagacctgtagtcccagctactcaggaggctaaggcaggaggcttgagcccaggaggtcaaggctgcagtgagctatgatcataccactg

SEQ ID NO: 70033 - DNA, 1063 bp, Homo sapiens
aaattgactagagtatttcacaaatagaagaaaaatgagttttccaagtgtgtgtatcatggtaacacagaatgaatcatttgctccttttaagtagattctgctattgctatgatctcatgcatgttcattcctgagatttaggttataatttcaaggtgtatctgatacacatacaggattttttactttcaagtttgtaaaggtctgtgtttacctacttttacaaagggaaaaatcttaggggttttggttcagttgaaggtaggctggtaggttaaagcagtatataaataaatttaactttgccatgtgtctctcccagggcagatgtgtcttgttcttctaagagttgaataaactgggtataaactttccatattgaggagacagtagctgtgcttcactttcaacctctaacatttttcctacttgaatttaaacctaacttcaaaattacccatgtgtttaattatgatgactaaaacacccctccccaacacacacacacacaatcttaataagtcatagaatttaatccatgaagtacagctaaggaactgagatttgcaaaagttaagtaacttgaccaaactactctgccagtcactagctgtgacttcgtttaaaaagggagtaacagtggcagctaccttatagagttgacaagaggatgaaatgagttaattactttctacaaaatattaacagcagtctctggctcatacatagttctcaacaaatgtgagatactgttatccacacctaggaagtagcagagttgatttctgtcagattcattcattcagtaaacatttgttgagcacctgctatgtgctgtattctagggagatagtttttgttaagaaccaccatgacttattacctccagtttaatttccagaaaaatactttccctctttgtaaactggaaaataatgtgaccaaaggtatgatgattcgtggtccaccagcatttctttaaagccttcaaaataagcatcatgcgtaagtattgtttaggccaagaatgtagatagcatagtcgtttttcctgttgacc

SEQ ID NO: 70034 - DNA, 1053 bp, Homo sapiens
ttatgtctcatggttagatttattgctttgccagtttttatcaagagcctcgataatggaaaaagcattgggaatgaaattaggatacctgaattctgctgacaaattgggcagtggtcttagtcatatttagtgactgtgtttcctgtgtctgtcaaatgagaaaatatccctgaacccttttccagctttaaaattaaacccacttttttcctgaaattcagttctcccttttcattcaccttgatggtacggtgtaagacaatagcaaccctatagtgcctatagtaagagtcagattaactcttacttaacaagcaaatttaaaaatttccaaacttaggcttatggagaatgacagtattgcctctacacatttgctttcttttggggaacactaattgttatattaccttatgtgtgaaagtgagtccattgaaaattcacttgtgggaaatggaatataggtgatcaacaatttagccatagtattagacacccttttgcattttgaatgagtatctctgaataggaatatgtggcctataaagtccacatttgtgaataatggggtgtggttaaagttataatcatttttacttaaacagctctgggccaggcacagtcgctcatgcctgtaatcccaacactttgggaggtgagagcagggggattgcttgagcccaggagtttgagaccagtcttggcaacatggtgagacccccatctctacaaaaaaaaaaagtcagaaaaattagccaggtgtagtggcacgcacctgcggtcccagctatgctggaggctgaggtggaaggatcacttgggcccaggaggtggaggttgcagtgaattgagatcacgccactgcactccagcctgggtgatggagtgagcctctgtctaaaaacaaaaacaaacaaaaacagctctgtaagtggaagcaatgctgtataatataatttctgtgaatttaaaactttgagtgattcttagggttatttgatattattctaccttggagagcaaaaatctccatttaaaaatgtattgaat

SEQ ID NO: 70035 - DNA, 1009 bp, Homo sapiens
taccaatgttcatttcttcctttctatctaaagaaaattttctttaaagaagctgaatggaagtttccttaaccccaagcaccagaaatactccatccttgatttgctatatagaaaaatattcatggtattttaacgagcccattcctaaagcctaattttgttgtctgaatgatttctgtaatcctcagttcattcttgtctttgggtttctgagtgaatgtacctttcctcgccatcctctttcttacattcaccctgtaagggtgaatcgaagtatttccttcaatttgccttcctaaggtttagtgtgaccttttaagatcagagcaagctcactggtttccatagcaacactcacttttcttctgattaggatttttggggggaattgcctagtaagaacttctaagcttcgtgaacactcttgttttagaatttcatgtcccagaaccatgtccctgttgcctgagaacttccaacctaagctttaccactcactggttgtgtgacccaagatggtttcctctaagcaaggaacaataagacttctcccaggcttgaatccatgtataaatataaaagagggtcctactaatgcttacgtactgaatggccatctgctgccctggaggcagtgcctgttggaactcagctttggccaagagaacccttgccctttggcagaagacaggcatcagaatagttgcaatttggtggtgagttttgcgactctctcctatgtgtcccttccactccttggttctcatgttatagaaacccaagggtgagtgttcagtgttacacaatttggtattgagactgaaaatggcgagacagtttgtttttcattcttacattaacataaagcacggaagctatataaacgtgtctgggctgttcttaagacaatgccatctgaatttcctttgaaagaaaaagacatttgaaatcatgcctatatggatgagaatgtttatcactttgggtcttggactttcctaagcag

SEQ ID NO: 70036 - DNA, 1067 bp, Homo sapiens
ttggtggggtcaaacaaacaaaccctatgcaaaccgtagcagtagggcagtagaatttgctttctaatgagtcccaggtgctgctgctgctgttggtctaagcactacacattgagaaccactaccctgtgcccctggccttcaaacataggcacttataggtttgggcagtgattgtcattgaacttgtccatttagggtcatctttccaaaatgaaccaataccaccattgagttgcatgtaaaaatcacattaaaggggatatctccttaattctttctgagactattggcttgccctctcttctatgttcagtaaatattcagtatctcttttataccaagcccagtgctaagtcccgctggtgataaagaggacacatagtggaactgctctggggatgccccgctaaatagacgggggtgttgctgaaacacaaaaaaagaatggagttatgaagttcctcctatcttcattttccttcttcagatcctgtgctgaccttcctttctgaagatggagatgaataactagaataaacaactgatgctggtaactttaacagtaactatataaaaacaattatgcagatatacttaagttttacaaagttgccatgcagcccccaacaataaaaattgtattttaatatattgcaatcgtattatttggtagggcttaatacctttcaaaccatttttgtgtgttttattgaatctgaactcctgggctcaattgagccttcctctttggcctcccaacatgtggagattaaaggcgtgagccacggcgcctagcaaatttgaacttatgaataagcctttcaaataggataggcattacatcttttggaaagactgaaacacagacaaggtggtatgcctaccatttgtccagtgctatgctaaggactgcatacttttatgtctaatatttttaaatctgggaggtaggttgtattgtccctgttttatagatgaggacacggaacagctaagagtataagtatcttaccaaagctaatttgaggcagaacctggatgtttcctgggatttgttttggggc

SEQ ID NO: 70037 - DNA, 1009 bp, Homo sapiens
gggtcagtttctttgtccagtccttcctgctggtgataggctgtttctttctgcatctctgcactattccccacttgtgatggactggcttttccccactccattacaccttctgttccccacatcacttcagtttggcagtagcccatcatggcttctcatggtgctccccgagaattcactgctctcttggtttagttcccatagttagttggcaagaccctcctgtatttcttggtttagagtcttgaaagagatcttctgcttgacccagctgaaatctttcagccaagccacaaagtcataggtagattgccatgccaaggctgggtgtccttcattgggatcccacaccattccagctattggggctgtcacacacaaggtgtacccatacatgcttcatcagaggctgaagtgtggacaaggttcttacagggtatggacacctgcttgataggtcattgtagacattgtattgtcttaatcaaaggctccaataactgtctatttcagactgttcaccaaaatcattaagtggtgtgtcttaaagatttggtgttgaattttcctttattcttccacgaaaataaaatttaaatgagtcccacagatactgcttgcctgaggctgttattagtgtatgtggcgtgaattgcaaagggctgtggttttattttatttgatttttataatgggggagggcacaagggagtagggaaaaaacactggcaatttttttttattatactttaagttctagggtacatgtgcacaatgtgcaggtttgtcacatatgtatacatgtgccatgtttgtgtgctgcacccattaactcgtcatttacattaggtatttttcctaatgttatccctcccccctccccccaccccgcaacaggccccggtgtgtgatgttccccaccctgtgtccaagtgttctcattgttcaattcccacctgcgagtgagaatatgtgatacttggttttctgtccttgtgatagtttg

SEQ ID NO: 70038 - DNA, 1069 bp, Homo sapiens
ctggaatgatacagccttctgtgtaacaagtacttactggataaacaaaggagacttagactagaacatttttatgttgcttttttgggaactgagtttcagagttgaggtttttgacttggcaattcatttgagaaagaaccgctgacaggtagtcccagtaaaaagagtggggcagagaacccaaaggcagcatgggacagtggaagagcctgcagggtttggtggcaaacctgaacacaggtctgaacactcaaactgcactgatgtccttgtgcaatttgctcatttctgcagaactccattttctccattactaaaagtagggtaataatatccagctcccaagactcgtgatgatgaaatgtaatgatcatgggaatctccctctgcagtgcctggcacatgctggtgctcagtgagtgccatttgctttgttgcctttctcccatgagtgagcatttagattgcatgtcttagatggagggtgggaagaacagggagaaagaattgtagaaataataatatcagcctttcaaaaagaaaaacattaaatttgccaggagagtagttgtcaggtataaacccaaagatttggaggtgatcgatcttgtttgatttaatccctgtaggggaaatgggtcagtggaatcttgagagtatttctcagctccattttcacccctctccacatctgaaacttcaccattgtatttcattgttctagacacatttatattcttcatcatttcagattcattttatttcaaagctataacagaaggaacgtgttgttacgctatacatgtctgattggatttatacaacaaactgaagccaggttctattgtagttcatttcccattatccccctgtcctacttttaatacggaagaactcttatcaactgtgtagcatttttatctcatatcttcttctattgttgcctctaccttttgtttcccttggggtcatggtgatggaagaagtggataactgtgcttctgaatagtcttttatgtggagaaatacagtttactcctctggacatcatgttggtgacccactt

SEQ ID NO: 70039 - DNA, 2148 bp, Homo sapiens
gtagcccgcaagttttatcagtacttagaaaagtaaagttaatggttgtttggggaatgaaggtggttctagattttactgtcctaggcagtaagttgggactgtgaagaaataattttttctgctaaatgaatgttgttagcttcataagtagtttttcactatgttatctgaatttctaattagagtcctttcatataatcaccacttttttgcgttgtaggctcaagagtattgtgaaatggatgccatctttttcttttttaattgaaagggggaaacaggtgagttcctcaaagatttaataaggaatatcagcaaatgttgccaactgttgtgaagactctgggatttaacaagaaccaagacaagacctgaggctttgagaattaaatctagcaaaggagataagcaacctaaggatcaggcgataaggggtgtcattggagtacacatgtgtgagggacaggatgagagggctaaccaaccagtgttctggtttgggggaagttttcttggggagatgacagtggttcatttcttcaaacaaaatttgttagacatctgtcctactttgtgacaggtgatggagtagatgatgggcatgcagtagagggaaagcgtggtgcctgcccttgcagagtgcacaggcaaagctaggacctgaaggatgagtgattagcaggaatcagccaacccattctctgaaagtagaaactgatgtgcaaagactcagaaataagtaaatgctggggttgaaagatgaggctcaagaggagctggggactggaggatgggtgccctcacacactgtaagatctccaaacggacttgtcaggtaatgctgactcgtacatttaggtaattaaggtcagtaaatgaattgtacaagataacaaacatatttcttggaaatctgatatgcaagaaaaactaacagttttgagctctacctttaatttaaaaatgtgttaaagtaaaaattgccttttgggacattaaggagaacttttacatcgtagggtttaaaaatttgacaaactcgtataatttcagatcttgtcatattgttgggggaaatatctttctgatgatcacagtgccactctgctcaatttttgctagccccactcagactttggagtgccgtgtagggaccacatatctgatacagatatcattagaccccctgaagaataccagtaatttacattacttctagcttttcaggtttttagctgatttgctttctaggccttgggaagtaggtagtggtggtgagatttcatggccactggagattttctgtcccacattctcttgtttttgttcccagtttgcggagcctgccacattgtaggtgctcaaatatttacataatttttttagtttttatcatggatctttatttaaaccttccattattatttaacagttcacctgtgagtactttgtattctgaactagagtaagcttccttgcgggcagctgctttgtatacctcagatttgctggctggtgctccaatggcttggtctgattcttcagataaaatgagtattgctagagggagataacagttgttaatgcatgggacaggcaggaggtggtgaccgtttttcttatcaagagatatcgctaagcaactgctaagcccttccttcgtcagctaattctctcagtcatggtgtgttagcctggataaagtgccataagtcaaaaggatatagacataaaaggaattttctctaaaaattgtcatcacaggcatcagatttctgaatccaatgtgctaaattatttttatacaattgacttaaatatattgcttcattaaaaaaaaagaaatagagaaaatgtccaaagaattagtatctttctctctttgaatgccctcctgccaatacctgcccctggttatgttactgaaaagttcttttgagggactgataatctttaggttattcaaacttttcctgaactacaaaagaatatgaataggcacatcttaaactgattaatataaatagacataagcatcccaatgtattcacttaatcacaatttgataatgtggcccacagcacctcgtatggtcttgtctctttctgattcccttccatcctcccctctctcctgtgctccatc

SEQ ID NO: 70040 - DNA, 1032 bp, Homo sapiens
tgaggctctgtcccaccaaaaaagaaccccccaaaaaaccagtatattgaatgcttactttgtcaaaaacttgtctgggtgccaagtacacaaagacaagacaaacctcttttcctgaagttgtctagcaggagtcccatccagccgaacaagccactgtaggaaggcttccccaggacatgagtcaggagctgaaccataaagcagccagccagacagtggagagctggaaaggaaagcgagtgtgggtgcatggaagggcagagtaggatgcgcctgggaaactgtggggtgctctccatgcattgcttccacttcagtgctacttaggaaaacgctcacctgtagtgaccttctaggtgcagatggtcactttgaaaatgtgcgcatcttccacatcctcaccgcaacagtaattgtcgctgctcactctctagtccacgaagtcttttatcctgtaacttctggggactccttcaggttctttttctagttttctcaccacattcccttttcttctcaaatctcccttaaatactgatgttccccaagctttctagaacatttcctccctttcttccccatcttcattaacaattttatccatatcactttctttggaacttgaagaatttacctatagccttgcttctcccttaagctctccatggggtcccttctgctgtgatctttccttcactctgcctgcccataccatatgctttgcatgagcctgcatttatatttgttcaaaatgtgagtataaattatagtagccgtaaaggacatggtggatactccgtgcctgtggaatcatctacaaactaatggtttttgacagtgccaggtggaagcagttggataatgctgaggcttcactgtgtcaatacctaggaacagctggggaacaaatctgcttttagtttctagagctacgtcagtctgttaataaaattctcttgtaggtactctgggagtatggatatgttcccttgtccaattacattgtggtggattctttttttggttaat

SEQ ID NO: 70041 - DNA, 1103 bp, Homo sapiens
tgcttcagcatccatttctatagtagagttcttctgatttaagtacaattcatttaaaacagtatgctcaagtaatttttttgtcaccaaaaaaaaaaatactcttggtgtttgcacttaagtacatatcttttcctgagatatatttatttttactatatctcaaagcagtgatttacctcatcagtaaagccagttttgcagctctgttaggaatctaaatagtttattctattcagtaaatatcattggttaggtacttatagacttaaagatgaaccatctctacctaacattcacacttttcagactatattatgagacagataccaaaacagaagatgtttagattgtgttatgttattaaatggtttgatagttaagattgtttattaaagaagatgatgtatgatcaacaatgcccatatttagcaagccatattagttacaagtaaaacttaagactatttcagctcggttgacagaaaaccattcagttaactcagttttcagtcagctaacatttattaaacctcctcatggagtgtaaggaaggctctgaaggttaaaaaatatattttctattttcaaggggctcacaagttagcaggggagacattgtgtgtataactataatataataagctactgtgatgaaggcattgatcacatgtgctgggaacccagcaaatgggcacaggctggttaattctaagtttggagaaaatgggaaggggtgagcaaagctgactgactgttcgaaccctggaagaacaggttttgtgtagaggaggcacatgagggagacagcagcatgaggaaggtcatgacggtttgaaagcggctatttctgggaattagaaaaatcttttgtgactatttgtaggcctgtcagaatccccacgtggagcctgaaccacctgacactagacatacaatggttcttccttcttacagaaagagtgggtgctggtaacatttgactgctctttaggtctgccaggcatgtcctctggaacctctctgtaggattggtgattcccttcaatcatgtctgaatgatgcctctgtatttaggactcttgctgggctgctcttgggta

SEQ ID NO: 70042 - DNA, 1033 bp, Homo sapiens
tgtataagtataggaaggaaaaaaatcttgtgataaattgattttttttaaaatgaaaatatgaacgggcgtggtggctcatgcctgtaatcctaggactttgggaggccgaggcgggcgggtggatcacctgagatcaggagtttgagaccagcctggccaacatggcaaaaccccatctctactaaaaatacaaaaactagctgggtgtggtagcaggtgcctgtaatcccagctacttgggaggctgaggcaggagaattgcttgaacccgggaagtggaggttgcagtgaatcaggatcactctactccactccagcctgggcgacagagtgagactctgtctcaatacataaataaataaataaattaattaattacataaaaatgctatagattattgagtttctatatttaagtggtctgctatggtgtactaatagtcattatatgcctttttgaaaaggtgaatgttgacaaattatgttacacgcagtcagtaaaaataaaagatggagtgtaaatgttcagtaggaagcaaattgtaaggtacagtgactatgaatagcctataagagggtgccagtgaaagcaggaatgggaaaccaaactgacattaataaagaagggactattaagaattttttctttcttttttttttttttgatgccgggtgccatggctcatgcctataatcccagcactttgggaggccaatgcaggtggatcacttgagattaggagttcaagaccagcctgagcaacatagcaagacccagtctccacaaaaaaaaaaaaaaaaacctcattcaggtgcacctgtggtaccagctacttgggaggctgaggtgggaggatcacctgaactaggcaggtcaaggctgcagtgagctgtgatcacactaccacactccagcttgggtgacagagtgagaccctgtctcaacaacaaaaaaaagcaattttaaaaagaggattttttgtaacataaaagaggaaatagctataatattttgttgtaaataagtaac

SEQ ID NO: 70043 - DNA, 1050 bp, Homo sapiens
tgctatgctcccatttaattaaattaggaaatctgcctaaaacttgaatcactcctcttttcagctggtggccaggcaggaatgctccctgaagagtactctttcaatagacttcagaatgtgttacctgaaaagtgctcatgatgaatcaagacatcactgtgttttccatacttctgaagtagagattgtccactaacagcttagggaaagcagagtacccgctcagctgctctttttctggtgtggtcagaccagctgggtcctctgaaacatgaatccatagtgcttcctttgttatactatttctgactcagttttctctaaacggctgtaaaatttaactgcctagctgtattttctttctgtggactttatgctctcatatttaggagaaagaataagagaacaccaacttacatctctgtagctctggatgattattaaggccctggtctaatgcttaaaggtaagcatctgttatctatattcaataaaagaggaaaatgaaccccagagagaaatcaagttactttagaatcgcaggctgtcccatgaccctggtgaccatcactgaattattaaacctgaccattcattgtgtgaaattattaaaaaaaaaaagacatcctatccccataaacaaaatgccacataagggaattaaatgcattttattaactcaaaggaaactaattttcaagaggctttacatggaataaaggcatgttggcacatcaagttttgtataaaaggatacatttaacagtactttaaaatagttctattgagtatagtagtctcttaaaattatacttccttactatatgtgcgttcctaagtataacagtccaaaccttgtcaaaattactatatttttggactacaactgctattttaaaatattttaatgtttttggaaagcctgtatgtcttaaaaaccaatctgtacattttatgtagtgatgtttcttttttctaaagttaataaatacagcatgtgttttaacatcagtagctacttagaagtaaggaaatgtacttaggaat

SEQ ID NO: 70044 - DNA, 1038 bp, Homo sapiens
acccatttagagatctttttacggttttcctgtttatattcatttttctgttgagataatgtttcatatttataagagctctttatattttaaggctgttcacccttggcctattatgttgtgatattttttctaacatgttcattttttaacttcattttttttctttgcaatgcaaaatttaatatttgggtggtcatacctaatctcctctatggcttctatttcatatcaggcttagaacatgtaaagtactagaataaccatcctactccttttagctacttactgcccttggttgcaactcatagaaatgcctttgagctaactttggggtggtggggggaaggaaatggtgattagataccaactgtcttatagaacccaagtataggaataacttggattttacaagggactggaaccctgaactagaaagctattcagcaacaaagtggccattctttcagtctttcaccagggcacgggtgacttctccatgccaccaacaagcaaccagaccacatcaactgtggcttcaattccaattttgaatttttgggagagagactccaataggttcagtttgtctcagatgtccaccttctccacaggtgattatggctgccaggacccacccctgaaaatgggcagttctttaaaaaggaggtggtggtagttagggctgggcagatagtttcgaagattctactactatagataactcagtcaacaaatatttgagtaccttatttgtttcaggcacatattagaagacagatgaaatgaccaaatagacaaatgtgtcaacaggcaaatagtgtttgtgtctgaatgtgcctgctgccctgccttgcagaccttggggagctgtctaggctaggaattcaaaactgccccaaaaatgccatagaagggataaagactcaggccagctttggaactaaatatggctatatggcttgaaggtttgtaccaataaatgagtattacatgttaatataagatgatgtagctcttcagccacaggggtataaa

SEQ ID NO: 70045 - DNA, 1950 bp, Homo sapiens
ctaattgcttattaccaataaatggcattagttggctgggtggtggtgaagacacaaaaaccgctatttctttcttgccccaaagctcggaaatcccctggcctttctttttcccttctaacttttcctggcatacctgcccctcttactgactgatacctctttgcagaactcctgcttggaaacttcctgtttgacttttgcaactgaagaaacttgaggttctctactcttatgtaaggataaaaaggagtgggtgagggtatctgcagatgagttacaagtccagagtagcctgagctatttcagctacctttctggtgacttgcaaaaggtattaatttcctattttaaagcagacagctaagcgttccttcatatttcagatatagcattataaagaaatcatcccccttaggtggagctcctggggatgtctcttttcttaggaaaatgcatcagcttctttcaaggactggtgatgcttcaggcaaagggtttaaccatgcaggggggtgtttactatatgtttcagtcccagtttaggtagacatccgcatctctgctatgaccccactatacagtgctttcaattaaggttacagcagtactagttgaaaatgtaaaactgcatactggaattgttgtctaaaaatacattaatgttcaagagttatttttaattctcaatgtttggtagaaataaactctggtgcctttatagttctgtgatttgcctaatttaaagggaggattagttagcttgtccccttgaatttttgctatcatttttcaggaaataatcattcatctgcttccattatttctctcaattgatgaaatcattgcactcctactatgtgtccagcattggtcccatgctggattcataatataataagacatagtcattatcctcaagaaaattttatagcataatctttccccttttgtactttctttgaaattaaattaaaatgaaatagactattaaggttcaaagggaccagcaccaggagttttgttttgattttaatgtcttaatgcttctgggtaattttaaatctcagtatttggagcctttaagtcacattagggaagcaaacttgttttttccaaccagcttatgattagctttgtacctgaaggcccaagaccttccctgctgttagagaaaaaaaattattctgacacttgttacaatgctggggaagactttactcaagtctgttgcaatataggaaaacaacccagctcaataccacgttgacagctggtacttgtaggcaaagagtagagtgtgaggggtcagtggaatggaaagttactcagcggggacattaaaccaaactcaactgacctagcaggattcttgctgaaagcagaccaaagacttgtaacatcaaaggtggggaatgaggaacttgagcaggtatcaagtttgggggattcttgctaacctgacttaacaggattcttgcttaaggaacaggattggcgccaacgttgtgacttagtagagaagagaggcctgactcaagtttggtggaggagagaatctttgtcatccttgcagatgggggagaagggggagagagtaggtgggactgcagttatttaactgtgattttcattctgacttatctgcattacttctgtgaccctccataattgactgtgtttcctactgaccatgtaaggagagcagatgcccttaattatggtgcaaaagatgcaggattgaacctaattatacaacataatgttatggcaaagagttgaggagcctttcccaagttgtttttttagataagtggttttcactagctttccagtttggtactacagtagatactttgcaaattattagcttaagaacggtatagcatttgatttgtttggcccatctcccatataccatatagtgataggattatccctatttatact

SEQ ID NO: 70046 - DNA, 1681 bp, Homo sapiens
ccaggcctcggcggggagctctttacttacactggccatttccctcttctccccactccctcttcccccagcccaaggacgcggcgtctccagccccggtatgggtggtggaggggtgggtggcagcgctggagcgtgggaaagctaaggtgagacaggtctgtgaatccggggtctctgtcacttggggaaaaaaaacgggcagaaaagctctgaagtttgaaacacataaggaaaatctgctatctgtacccccaccctcccaaaatatagttgacgcccccgcgtgatgaagagtttatgggggtggaggcttggaggagatgtcactgcgcctgggagcttgtgtccgattccgggaggtggccgtgtccgagtgcgtggttgtacatttccgaaggtctcagtttctctcactttcagcccgcgagttcctccgcttctcctttagcaggtagtaaaatgctgcgctttcggtaaatgccagtactatttccctcagcccttggggagggggaaacttattccaactgtctaatataacattttggtaatccgctttggtgattaagcttgcgtttgactgatcagctatttcaggaaccgactgagttaggttgacgacccagagtggaatcgggaaaggagaggtggaggattttattgcccttcccccagctccatggccacttttccactgactattaataaccatcttatgaatggtaagataagtaacgttttcccttctatctactacctcagctgtacgaaacgggaaaactaggagacatttagaatagaattcaaggttattaatgaaccagggagtgcaaaagtgcacgcaaaacctggtggctggcacacctgcgccttttcctttaaccccatcccctcggtagttttggccctcccctatccgtgcacggcctcgctggttgattggttcgtccgggaaccaatcagctcttccaatgcctgggcgccttgatgctgaccctgttctggtggcccggataccccggggcaggcttggttcccgaccctaagggttccggtgggagagactgcttggaatctgctctgcttattatctctaattctcctttccttctcccatcatcctataaagcgtttctccatgggctgaaatggaaaacgtgtataaatggggctagacgattggagtgtgaaagtgaggaggcagaaatgcgctttgatgggagctcagacagtaaaaattaacacatcataaaagatgagcacggaagagaacgttgtgggtggcgaaggtacaaaatagcattgtaacttccaagagaaagccaaagcaaaaataaacacctgtgtaaggaaagacctaaaggagaaaaaagagcctgccaaacataccaaacactatttcttgactgaaataaaaacgttatttaaaagcccatttaggccgggcgcggtggttcacgcctgtaatcgcagcactttgggaggccgaggcgggcggatcacgtgaggtcaggagttcgagaccagcctgaataacatggagaaaccctgtctctactaaaaatacaaaaattagccgggcgtggtggcgcatgcctgtaatcccagctactcgggaggctgaggcgggagaatcgcttgaacccgggaggcagagatggcagtgagccaagatcgc

SEQ ID NO: 70047 - DNA, 1403 bp, Homo sapiens
tagaaatctgtcatgcaagaggagttcaggtgtaaattttgttactataaatcacttgctcatctaacaggaattgtttacatgtagctgatggtctaatttttaaatgttcagagtcctaaaattatgaacagattatatgtcaaaaattaatttgtaatatacaaggtatattatggttgaactagtttttgtggtcttaggctggaaattaaacacctagtatatagaagcaataatatttcaagtatacatattcatttatagcattatttctatgggaaaatgcacccagaattctaactaggatcttcaagaacaactctccccaggtcagtgcatggagcagaaagagaagggaaagggatagaatgtcttcatgactttaatcctagtatttgaaaaaaaaaaatcaaaccttgcacctacaaatttctgtcttgatccagaaagtcattagcataaaaaagataatagtggccttctcacctaacgccaccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccgccaaaagtatgtccaacaagcctggcagaaggcagacatcaatacaaaatgggcagccacacgatgggccaagaagattgaagccagagaaaggaaagccaagatgacagattttgatcgttttaaagttatgaaggcaaagaaaacgaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatgacggccgcgagtaaaaaggcttcagcccagaaggttcctgcccagaaagccacaggccagaaagcagcacctgctccaaaagctcagaagggtcaaaaagctccagcccagaaagcacctgctccaaaggcatctggcaagaaagcataagtggcaatcataaaaagtaataaaggttctttttgacctgttggcaaatgtaaaaaaaaaaaaaaagataatagtgagtattttattatttcaggaaggtaaaacagatcttttaaaatggctcgttgtatcattatgttctcatttagttattttcagtatttactttttctttgtaaaataaacgtgaaagtggcttgttaaattttttttagagaaatctgagtaatcttcccagaggctcctgaagaa

SEQ ID NO: 70048 - DNA, 1520 bp, Homo sapiens
aagaaatttagaactcatatctaacaccaccatgaactaccaaatacttcctcatgaaattagacttttccttaagaaaatatcagttttgtcacatagttaatttagtcaccaaacatggacatcactcacacagtgtggcattttagcaatagaacttgtagaattgaatacattatatgaaaatcagatgagaaaaaagttaaatcttcttcaggagcctctgggaagattactcagatttctctaaaaaaaatttaacaagccactttcacgtttattttacaaagaaaaagtaaatactgaaaataactaaatgagaacataatgatacaacgagccattttaaaagatctgttttaccttcctgaaataataaaatactcactattatctttttttttttttttacatttgccaacaggtcaaaaagaacctttattactttttatgattgccacttatgctttcttgccagatgcctttggagcaggtgctttctgggctggagctttttgacccttctgagcttttggagcaggtgctgctttctggcctgtggctttctgggcaggaaccttctgggctgaagcctttttactcgcggccgtcatcttttttgctggaactttagcagcagcagcagcagcagcagcagcagcagtacccttagtaccaggtgcttttttgggagaagctttcaggagagctgccttttgaagcttcttaacttcattcttgattattctgttcctcgttttctttgccttcataactttaaaacgatcaaaatctgtcatcttggctttcctttctctggcttcaatcttcttggcccatcgtgtggctgcccattttgtattgatgtctgccttctgccaggcttgttggacatacttttggcgggcactgtgcggaaacttgaggatgaaatcagtgagctgcatgcacttgaaaggcatggcctgtctcctcacttgagtgcaaggtccatcgaccaaagccctgttctgatcaataacatctacaatcgcgaccaattttccggcatgaggtccaaaggagacataggccacccggccaacctccacgaagcgcctgaacaccatgttggtggcgttaggtgagaaggccactattatcttttttatgctaatgactttctggatcaagacagaaatttgtaggtgcaaggtttgatttttttttttcaaatactaggattaaagtcatgaagacattctatccctttcccttctctttctgctccatgcactgacctggggagagttgttcttgaagatcctagttagaattctgggtgcattttcccatagaaataatgctataaatgaatatgtatacttgaaatattattgcttctatatactaggtgtttaatttccagcctaagaccacaaaaactagttcaaccataatataccttgtatattacaaattaatttttgacatataatctgttcataattttaggactctgaacatttaaaaattagacc

SEQ ID NO: 70049 - DNA, 1111 bp, Homo sapiens
ggtgcaggagctagatgcgtggacgccggtgcgtggactggaggtttccaggtaccgcgcttagcgtgcctgttgaagtcaaatgcatggttaaggaggctagcgaggaaggctagtgagggaagcttgtggaaacggctacgagcccagaaaaggcatgactcgtccagttgtccaagtttttggaagggaaaagcgggaaagcgccacgatcccacctactgtgaggaggaatctgcgagtctcccagctccaccccctccacagtgatgcagaggacaaacaccgacgtagggagaggaaaaaataaaactccagggagcggggagtaggcaaccagcagtcttccggcaatagggcgggagggagcgcgtcccaaggaaacaagcaccgcataaatacttgagttgggaacccagtgcttccggaagctcggagctcaccttcccgacctcgccgaagttgaaaaaaggcagagcagggagaggggccagctcaccctgctgagagctgctcagtgggcaggcgggacgctgctccgggagacgcccactggagggatcgcagagcccggcaagctgcgagcgcgccaaagaccctgcgcttcggacgaggagcccaagtcctccgagacggggagggagcggcccgcgagggctggagctccgaagagggccgagtaggagctgcatggacagcatgcgtctctccgccggtcccgacgcggggccctcgggcaactccagcccatggtggcctctggccaccggcgctggcaacacaagccgggaggccgaagccctcggggagggcaacggcccaccgagggacgtgcgcaacgaggagctggccaaactggagatcgccgtgctggcggtgactttcgcggtggccgtgctgggcaacagcagcgtactgctggctctgcaccggacgccgcgcaagacgtcccgcatgcacctcttcatccgacacctcagcctggccgacctggccgtggcattcttccaggtgctgccgcaaatgtgctgggacatcacctaccgcttccgcggccccgactggctgtgccgcgtggtgaagcacctgcaggtgttcggcatgtttgcgt

SEQ ID NO: 70050 - DNA, 1290 bp, Homo sapiens
tcaaacacgtgttaaaatccaagacgtcgtctcaaatgccagagatttgcgggaatgctcctggaaggcctcaaaatcgccgcaaggtttaagacatccgtttccatgttgaaacaaagccctctctaatcctgcagtgaccataaggcagactttacctccaaattctggtcccctgtcctgtgttttaacttgtgttaagatcagactcggctttctctttccctttattcagaattttgcacgatagtatctaagactggtgaacactacactctgaagtcagttttttgtgcataggttacctgtatacaatggataaaaataattgcaaaagttaagcttgtaacttgatacatattatcctgttatttttaaaggttttgtgttggggaagagaattttcctgtctcaaggtagcattttatttctaagacttttcagagtaaaaaaagttcagtaaaaaaattgctgattttcttttttgttttcattgtgtattaccagtttaaattcagttgctgtacctctcagaaattaaagttaggatgaaattagaactaacacttaatttaaatgatttgaatttacctacaactgcaataataccttactggtaaacacttactctttttaaaacagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggtaagttaatacgtagaaggaagacatgtaaaaagcattataaaatgtattttattgatatgaaattcattttaatataatttatttcataatttgttaattaaggcatcatgatatattttttcgctttttgtcaataattcctttctccttccaattagacaacatctgtttgtaaatgtacacacatacatattccactgttggtctttagcagagcacagcttcatttattgatacattgagtaggctgtatagtgtcattagattgcaatgcatatgtcaactgaattttcatgaatctgtgtattttttggacacttgatacacaagtataagatgtggcccctgcccttgatggccaaacacatttgggaaacactgaagagtacaaagttaaacaaggttcttcattgcaggcctttctcaagagcctttaatatgacaatgttcattgtatcagcgaaggaatatattatagtatgtagttga

SEQ ID NO: 70051 - DNA, 1579 bp, Homo sapiens
cactctgacactcctgcctcccttgtgtgaggactcttgagattacatagggcccacctagataatctataataatctcttcacctcagcatccttaacttaatcatatttttaaagtgtcttttgccatgtaaggtaacatattcatagattctaaagattagaatatggacatctttgctggtggggcagagggacattattcaacccatcacatttggaaagcgttatctaattggccacattttaaacgtggtggcttgcgtttcctttagtaccagggtacaatgagaatggaacaaaaacctctttgagtgtaaccaaaacagggtgcccagaggtggtgtatggtctccatagtgcctcattgagtaacactgctctcctctactctcagagctttcattcaggtgaaatcatgataaaacatcaggggctgccataaggagaaaagatgcaatgacatttgtctgtgaggggatcatgcattcagggatatgtgttcaagtgaggaggaggtaatatccccttgacatattgaatgtattaatatatgtacatacatgagctcctctggctccatttggcacaaaatggcaactcccccaatctgttataaaagcagttctaaccacatagtatagtttactttgtaatataatacatttcatttcagaataagacaggtggtaaagatccatataaattaggggtttctcaaatctagagtaggagaggtctttaatattaactcacattttgccacattttacacactaacagcttctgagctctgtctctcattagctgccatgttgatgatttggagctgttgcttgatagcactgcctgccaacggcccaaaggagaggcattctggttttatagtcaaatgagtaaaagaacagaacgtaaacttgtctcatgcactaaagtagatgagacagtaaattgttttgattttgtttttgttgttaattaccaggcttgtatctctgggagcatatttttgaaggcttacttgatcccagcgatgtgactgctcaatggagagaaggaaagtcaatcgtaggaagaacacagtacaggtattggttgtattagttgtgcaacattaacctttgatgttttgctctgcaatattttctgtaaatactaaaagaaaaataataggaaaatatatttataaaaatacttctatttcaacttgtaaagaatagagaagtaaatctcatgaatatgtattcataattaagcttacttggaccttatgaaattgtatattacagaatactcctttttggcatcatatgtctgttttatttttacctaattatatagaaaagttcatactccacatcttacagcgtttgaatggtgacagccattgaaaacattctgtatcttggaggaataatatgtaaacctaaaagtattttcatttttctctttcatgtaatagtcatgttcactttttaaaatatttaggtgatatcaaagctcttgctgtcactttgtagatttttgtttattaaaacaaatttgatgagttctatcaggatttattttttattttaga

SEQ ID NO: 70052 - DNA, 2431 bp, Homo sapiens
gactaattttaagatgaattaaatggtacttgttctatttaatacatactagtgaaaatatttcaatggtactggttgttctaggcagcacttaatatgaaaaaaatgagttatgatacatgtctattcctttaatgaaaactttttaaaaatacagttaaaaagagagtaggctgagcacagtggctcatacctgtaatcccagcacgttggaaggccaaggcaggtgaatcacttgaggtcaggagttcaagaccagcctggccaacatggcaaaaaccctgtctctactaaaaatacaaaaattagttgggcatggtggcacgcacctgcagtcccagctactcaggagctgaggcacaagaattgcttgaacccaggaggcagaggctgctgtgagctgagatcatgccacagcactccagcctgagcaacagactgagactctgtctcaaaaaaaaaaaaaatggtaatacaacacattcccatttactcaccattcaaaactaacaaatttcagctctctgtcatatttgcttcagatatttaattttcctgttaaaaaaattaaatactttcaataagggtaaagctccctttgtactgttttctagtccctttcatcttccttcctcctcagatacaattgctatcataaatttgatgtggatcctcccattcaaatttttatatttatactgatcctaaatatatatgtgtaaataatttttatgactgtactttcaagtttatgtatattttgtgagtgtcctaatccttgctttttttaacattatatttttgagatataacattcatggaatgtttataatgccattcttcgtttcttaatttgtcagcactttctcatccattgagtcagatgaagagtgtaatagcagctcacaccataaaagggttgagaactactgactttaaatgcctttctggtttgaactaaaccattattttacagagttccatgctattcaattatatttctttgcttaagagtttaaattctagccagcatttattttcagtgtggttaaaacaacaacagaaaaaaaggtcaggcatggtggttcatgcctgtaatcccagtactttgggagactgaggtaggtggattgcttcagccaaggagttcaagaccagcatgggcaacatggtgaaaccccatctctacaaaaaaatacgaaaaattacctgtgtgtagtggtgcacacccgtagtcccagctactcgggaggctgaggtgggaggatcacctgagccagggaagttgaggctgcagtgagccaagattgcaccactgcactccagcctgggccacaagagttgagaccctgcctcaaaaaaaaaacaaaaaaacacaaaactatcacattttgtattatcatatgcaaattgatctgcctacagccaaagcttaccattaatctacagctatgccccatcattcaaacttgttcaaaagattgtattatagaaattttacttctagatagaatgtggattaaatctcattgtagattttgtataaaatgatgaatttctgataccacatacctttgttcaggctttgtttgtctcttgtttttgttgtgttgtttttaacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacgtaagtacaaaatatgattaaacatttttaggccctaacacctgaatttctgaaccaggaagacttattcaaaattgtaataaatttagttcttctgggattattgaggccaggtacagtctttctcagagataaaaacagggtgtggtcgcatccttcaataacaattatgatgtttttaagagtattttattctttaatgaggagatgagttactttttttcttttaaaaccccaaggcatagaatggatttttcaagcttattaggagtgccataaaaatatatttagcagagaaatggcagatagatttttttaaaaacaatgatagtatctatatatagtaaaaaaaggcaatattattatatcaggaatataccgtaccattgtgtttgagactggctgaatttatacaaatctcttctataaaaggagggattaattaaatgatagctaaggtttctcaagatacagtcttttaggccaggcgcag

SEQ ID NO: 70053 - DNA, 2184 bp, Homo sapiens
aagaccctcttaaaaatctattttttgagcagagcctgcatttgtaaaatgttttcatatagtataagatggaacctcttggtaatcatgatgttgttgcactaggccagtatatttcttatataggtctgtggttctcaaccaggggcaattttgcccaccgggaggcatttggcagtgtctggagacttttttttttttttttttttgagacgaagtcttgctctgtcaccccagctggagttcagtggcacgatcttggctctctgcaacctctgcctcccaggttctagccattctcctgcctcagcctcccaagtagctgggattacaggtgggcatcaccactcctggctaattttgtattttttatagagagggggtttcgccatgttggccaggctggtctcaaattcctgacctcaagtgatctgcctgccttggactcccacagtgctgagattataggcatgagccactgtgcctggcctggagacgtttttgattgtcacaactggaggaaagaggttgtcacaactggtatctagcagatagagcccagggatacagctgaacaccccacaatgtataggacagcctccacaagaaaaaattaacccaaaatgtcagtaatgctgaggctaagaaaccctgttatatacaaactgttaggtaaaattttgttctcgtgtgaaagttacatttcaggtacacagtttaatccctggtatttccaaatgctcataaaaataggtaacttttcctgtatggcataccatggttttatctgtcagtttgttttaatctacttgaaaagcccttgggattaatttttcagagccctttgcaatagcaaaatatataatctttccttttttttaattgacaaatagtaatggtatatgataatggggtacaaatgatgttttgaaatatatttacaacgtagaatgcttaaatcagactaacaaatccgtaaccttatatacttaacaatttttgtggtaaaaacataacatctgctgttttagcaattttgaaatatacagtgcattattatttattatagtcaccctattctgtgtgatagatcactaaagcttattcctcctgtccaactgaaacttcatacccttcgatcaacatcttccttttccccatccatctccctcccctggagtattctgtaatcttttcatcacctggttaaaatgttgcttaaatcgtgatcattatgaatagagaagagtctttatactttgaaggttttgaatgtaacatgcctaacagctgcagatgagtaatgcaagttaaagaatgtcaaaaacaaataactttaggcacaacatctctgtaacacttttgtaagagatgtcagtgtgaaattcaatttttttaagtcagtagattcagggagttttccaaagtattcatggaaaattacaatttgagatttagaaatcacattttaaacctcttctgtatacttcttgctacctaagagattgggttatggggaatttttgccaattctatatcatatgttaattcatgtgtatttatttttatagatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacagtaagttctatgcttatttaattcattcattttgttctccagtctgagagttgctttatgtagaaacacaggtttccaaagaggcattgttaactctatttgtaccaatctttccccagaagatacattagtaattaaaactgtgaaaagactgggttgtacacatttagaatagagagaaccgcctatgactgtagtccatcttgaagaggaacactggtaactgtcatttgcaaatttcagttgttagggtttcctcaataatatttgttagtcacacaggagattatagatgctaatgagatacttaggttcatcactgagatgttgtgcagtggaccaattcagtgttccaagaccggtgtgcaggtctcacaaattcaggaattcaggaacctgacaccatcttcaggacatggaccttgtattcttctgtgaatcc

SEQ ID NO: 70054 - DNA, 1040 bp, Homo sapiens
tcctttgctcttttctcacagtattctaccccatctaaataatttactgacttcacttggtcactatccatctccaccactagaactagaatatatgctccatgagggcaaggtagggaagagaggacctagcactcccaaagtatcggttgaattattattatccattcagaagtgttacggtgactcctagattttataaatgtacaactgtaaaatgttccaattcttcaacatttttaagaaatctgtttgggccaggattttggatatctcttatgcctatcatctctataaagtttcaccatttcctgaaactgattttattaaaagataaggtatttttgttcacaaactatatacttagtaaagtgaaaactacagttgtttttctgattttctagctggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagt

SEQ ID NO: 70055 - DNA, 2248 bp, Homo sapiens
ttaaaaaaaaatctaaaaaaatattttaaaaactttcccacaatttacaaaaaatccgcctctcccctgccatagacttttatttttttcttcttcttcttttataaagtaaccccgtgaagcagccgaggccgactcgcccgcccgcagcagctccaaaaaggaaccaagagaccgaggccttcccgctgtccggactgacacctccaccttcgcccgcagccagcggcagcggatcaacaccattctggggcggtgaagtagttttcgattccgggtgatttttgtccctctgcgcttgcgcttgcgcttgcccccgctcaccttcccccagctccggcccctagccccagcattcgctctcctcctctcacggaaaggtcgcggcctgtggccctgcgagcagcagtgccgagatgaaccccagtgcccccagctacgtcctcgctgtacgtgggggacctccatcccgacgtgaccgaggcgatgctctacaagaagttcagcgcggccgggctcatcctctccatccgggtctgcagggacatgatcacccacggctccttgggctacgcgtatgtgaacttccagtagcccgcggacgcggagcatgctgtgaacactatgaattttgatgttataaagggcaagccagtacgcatcgtgtagtctcagcgtgatccatcacttcgcaaaagtggagtgggctacatattcattaaaaatctggacaaatccattgataataaagcactgtatgatacatttttctgcttttggtaacatcctttcatgtaaggtgggctgtgatgaaaatgattccaagggctatggatctgtacactttgagacacaggaagcagctgaaagagctatggaaaaaatgaatggaatgctcctaaatgatcgcaaagtatttgttggacgatttatgtctcataaagaacgagaagctgaacttggagctacgtgaaagagttcaccaatgtttacatcaagaatttcggagaagacatggatgatgagcgccttaagaatctctttggcaagtttgggcctgccttaaatgtgaaagtaatgactggtgaaagtggaaaatctaaaggatttggatttgtaagctttgaaaggcttgaagatgcacagaaagctgtggatgaaatgaaaggagctcaatggaaaacaaatttatgtaggtagagctcagaaaaaagtggaacggcagacagaacttaagcgcaaatttgaacaggtgaggcaagataggatcaccagataccaccgtgttaatctttatgtgaaaaatcttgatgatggcattaataattaacgtctccggaaagagttttctccatttggtacaatcaccagtgcaaaggttatgatggagggtggtcgctgcaaagggtttggttttgtatgtttctcctcaccagaagaagccactaaagcagttacagaaatgaatggtagaattgtggccacaaagccattgtatgttgctttagctcagcgcaaagaagagtgccaggctcacctcactaaccagtatatgcaaagaatggcaagtgtacgagctgtgcccaatcttgaaatcaacccctaccagccagcacctccttcaggttacttcatggcagctatcccacagactcagaacggtgctgcatactatcctcctagccaaattgctcaactaagaccaagtcctcgctggactgctgagggtgccagaccccatccattccaaaataggcccagtgctatccgcccggctgctcctagaccaccatttagtactatgagaccagcttcttcacaggttccatgagttatgtcaacacagcgtgttgctaacacatcgacacagacaatgggtccacgtcctgcagctgctgctgctgccactccacattataactatgctgcgggagttcgcagtcctcagaaacatcttaatgcacagccacaagttacaatgcaacagcctgctgctcatgtacaaggtcaggaacctttgactgcttccatgttggtatctgcccatgctcaagagcaaaagcaaatgttgggtgaacggctgtttcctcttattcaagccatgcaccttactcttgctggtaaaatcactggcatgttgttggagattggtaattcagaacttcttcatatgctggagtctccagagtcactccgttctaaggttaatgaaactgtagctgtactacaagcccaccaagctgaagtg

SEQ ID NO: 70056 - DNA, 1049 bp, Homo sapiens
gagtctataaaacattaattggttttcatattttactatttttgtgtttttttaaaatttttaaatcaataagtaatctaggactagcattatgtttgctagacctggcattttctcggtacataaggttcaaagtttcttttcctttttaaatttattttatattttgcaatgtttattaaaaaaataatatttacatttttcgatgtttagatatttttcttctgtgaagcacaagtttcttttcatggtacctgatcaattttaaacagttggaacaccggtggcacggttaactgctttctgggcagccacttcagcttggtgggcttgtagtacagctacagtttcattaaccttagaacggagtgactctggagactccagcatatgaagaagttctgaattaccaatctccaacaacatgccagtgattttaccagcaagagtaaggtgcatggcttgaataagaggaaacagccgttcacccaacatttgcttttgctcttgagcatgggcagataccaacatggaagcagtcaaaggttcctgaccttgtacatgagcagcaggctgttgcattgtaacttgtggctgtgcattaagatgtttctgaggactgcgaactcccgcagcatagttataatgtggagtggcagcagcagcagctgcaggacgtggacccattgtctgtgtcgatgtgttagcaacacgctgtgttgacataactcatggaacctgtgaagaagctggtctcatagtactaaatggtggtctaggagcagccgggcggatagcactgggcctattttggaatggatggggtctggcaccctcagcagtccagcgaggacttggtcttagttgagcaatttggctaggaggatagtatgcagcaccgttctgagtctgtgggatagctgccatgaagtaacctgaaggaggtgctggctggtaggggttgatttcaagattgggcacagctcgtacacttgccattctttgcatatactggttagtgaggtgagcctggcactcttctttgcgct

SEQ ID NO: 70057 - DNA, 1033 bp, Homo sapiens
agggagggttgtggcgcccgagctgggcgcgttcccagcgcctgccctccgccgctggccctgtcccgggcgcccggtgcgggtctcgaacaatggtgcggagcgccggcgcgagccccgcgcccgcccagcggccgtagaggaagtggccgggctcccggcgaggtgggcagggagacgtcccccgccactcgctggctggagtttgcctgcgcgtccggcctctcccccggggatcccctgggattaccgacggagctcaatttcgagagtatggtgccagcgcccgggctaatctagtcctctctactcgctctttttcccctcctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaaggtaaggatgggagcggctgccttgctccttttgtgtgccttcttgtcattgtgctcgtggagttgcgtatctaacttggtgtctgcgtgggaggaaggtggtgaggggacagctcgagccctgtctgagccacctgggcttcctacaagccagttagttcccagttgcaatcccagtcccgtcaaacccacggggagctggaaactgggtgacttcccccgccagctgccagcccgcatctctaatggggagagaactggctttaacttaaccaccttcagctgggcaacttatgtgggaagcaggcagcagtggaggatcctgtccagctattattatcaccatcattattctttttaaatggtaggattgtcactacgtaatttttttacggaatgatttttgtaaagtctgtgaaccccaagcggtctacagcctcattgagtgcaggctatttcagatatttacaccactcacctatt

SEQ ID NO: 70058 - DNA, 1045 bp, Homo sapiens
tgtgcagtttttccacatggctctttgtggcaggtcttcaaggggtggcggtctggtttttctgccgcctagagcactaattggcaaatgcacttccaaatgttgatttctttatgtttgctgtaaggtcacttgccagtgatcaagtccttatttgaaaatcagcgaaatgggatgtgttgcaatgtgtctatcaaattcaaacggaagaaaaatcatgaacatggtgaaaatcacatttggagctaagtctgtcccacagagaatgaccttctccctatttccttcaacacttcttccttccacacacccacgagtccctaggctgctttaggagtcttcactgcacctgccctgccctgagtccaggctttacctcctcctgcagtacctacacatccagtatctaacctagatcactacatccatacacaaacatgggaataagggaatatcatggagtcagatcatatacgcattaaatggcacaaattcacctggtacttctaggcaaatcaagaagagagtgggagacaaataacagataaatagtacatgaggccagctgtccaatgcagggagagtaggccccttagtaaggacagcatgggagacaagactggtttttctgtaccctcgcagagtgctagtctgttatttacaggtatgtgttttgggatcaggtgcagtggtgcatgcctgtaatctccgcatttcaggaggctgaggcaggcggatcacttggggttaggggttcaagaccagcctggccaacattttggtagagaaaccacatctttaccaaaaaatacaaaaattagctaggtgtggtggcacacacctgtggtcccagtgtgcctgtggttccacttgaacccaggaggcagaggttacagtgagccgaaatcacatcactgcactccagtctgggtgacagagtgagactctgtctaataaataaataaataaataaaggtatatgtatttggaacaaactactttttaaattacagtcagcaactttatctgatgataaaaaaaaatt

SEQ ID NO: 70059 - DNA, 1050 bp, Homo sapiens
ttcctggtgataattcgtaattttatgtataagatcatagatgtatctagttgtgtgtatcattttgggcaagtcacttagcctttctctgggtttcggttttcttatctataagataaggagttggaattctcttcatcttaagtgtcttttttttttctttttgagacagagtctcactctgtcacccaagctggagtgcagtgacacgatctctgctctctgaagcctctgccttccggtttcaagtgattctcatgcctcagcctcctgagtagctggaaatacaagcgtgcaccaccatgcctgactaatttttgtaatcctaagtgtctttgaatctaattgaagatgtcatatcagttcatattaattgcctcataaaattttcaagcttttaaagttttcagttggctgctctgttttgtggagaatcatttttgctttcacttttttttcataagttcatggacagtgtataaattgagtttttggagaattaaaatagaatacaataaagaatacagaaaaaacagtaatcaaaaccacatgcagagaaatgtagcacagaattgtaagacagaagaatcaggaatgatacaagtggttaaacagtggataggtttaaatgggggacaaaaggggaccccaggcaacagttttaaagaatgaattgaacatttcatgcctcttggtcaaattctcaaagacttagaattaagagaaataaatctcttgtttgaataggccattagaaagcaagcatgtctggaaaagtgtatgaaacccaaaccagttgactatgctatttgttagcatctctggcaaatagcgtagcagtggaagggattgaataattggctagcagaaggttttgaattatctgtggactttagtgatctatgtaattcttgtattctgcagcaaaaatattgtggagctacacatatgggaacaataaagactcataaagacatgttttatgaagtggaacttatagatgagaggctgtgtttgtttttaataatgcatgttgctagttgctaagaa

SEQ ID NO: 70060 - DNA, 1050 bp, Homo sapiens
gttgcctaggctagagtgcagtggcataatctcagctcactgcagtcttgactttctgggctcaggtgatcctcccacctcagcctccgaagtagctgagcgcaccagcaaacctggctaattttttgtagagatggacggggttttgctatgttgcccaggctggccttgaactcctgggctcaagcgatatgccagccttggcctccagaagtgctaggagtacagccatgagccactgcgcctggcctgaattctattttctatgtgcaatgggggagtcctattttaatagggggagagataatatttttataaggagaccactctcatcataagatctgcaagtgtctccttaacttttaagtgctatcaatagttctaaaaggtcagaccacttccttattctcttgatatctggtattggcttctctgttgagaagatctagttttagtttaattttcagaaaagtgaattgctatgattttgttgttggtggtggcattgttgctatagatgtagattgctctaccattaacctgcactagttgttcactagttgtgtcaaaaataaataatgtgccagacaaattaaaaaactaataagttattccatctggctctcaaaggcataatcctctcatttgcttccagataggatatatatgtatcgtgttaagacactaaggtctgttttgtgctgctataacagagtaccacagactaggtaatttataatgaaaatatatttgttggctcacagttctggttgctgggaagtccaagatggaaggtctggcatctgatgagggccttcttgctacatcatcccatggcagaaaggcaaagaaagggcaagagagggccaaatgtatcttttataaggagcccactccagagataacaataatggcattaattcattcaggaaggcaaacccctcatggtctgatcacctcttgaaagtcccacctcccgacactactgcactggggattaagtttccagcacatgctttttgggggacacattgaaaccacggcatatgg

SEQ ID NO: 70061 - DNA, 1731 bp, Homo sapiens
catctgccactgcacctagctaactttttagttttgtagagatggggtctcactgccttgcccaggctgatcttgaactcctgagctcaaagtgatcctcttcctccacctcccaaagtgttggatattacagtcatgagcagtccttaaagaccatatccgtcaaatacaagctggctctaatacctggcacataataagtgctcagttattgtttggtgtgtgtgtgtgtgtgtatatttgtttgtaccctcaaagatcaggtttctaaatattttctcctattttatttctgctttttagcaggaaggtcgccaataatcaagctgtaaaaatattagctgctcccaatttagaatttttgtgttcttatgaatgctgaaatgtatgtaaacaaaattgcacagtgttaaatggtatgttgttgaaccagaaatatgtttattgtcttattttataaacaaaatggcactgagatttctttaaaaattttttaaagatatagtttttgaaatttacaacacaactcagtaaataagattatgaaaaagctatcttagatatcctttttgattggttctaagattataactttaagcaagcatagggacacttttaacaacttggaaggtattttggtgggacagtaagagtgtatttgtttatatgaaaatccgtaattctttgtaagaacgtaatttgaatctgtagttgattgcaagtttagagaggtctctgcaatatacaaagtttcttagttgcagtcacttgccaagacgggctgatcactaagaaataaggaaactcagctagaattaccagctgctgtttataaaaccaaatgataaaattcacttaatgaaagtaatgtgctgacagcagtgtttattacttaaaacataacaatcatgtttattgtatctctctgtgacagctttgctgaatataacttaaatgtagcagaggaaatccagagtaatgcattttttaaaaaaagtgtgtttatttacatgaaaccaacataaaaagtttgaagacttttttgtcagagatcttagttttctagagttaaactgaaaagattgaagaaatggtaagtagctaccatttttggaaacaagaaattaagaagtacaaactcagaaaacacgcttggagaaaattttaatatcatgaaacctagaactcttgaacttcaaaagaccttacaatccgcttgatggtgatatttggaatctcagatatagtattgaaatatcataggatagaaaggaataatcagggagcttaatgcaatcagaaccttgtagcctgttatgggaagtatcatttggttaagcctgctaagctactgtaaatgaatgttaatcgcattttatcagctgcttatactatctttattatgtaatttgaatatttatgacaatggaaatatgtttaactgtgaaattacagtgtttatggaactcaaattccaaaaagcatacaaccctctgatggagaataactatatttaaatactacaaaattcaagatgtttctaccatttaacattagtctatatcttgtgggagaagcattgtttgtggctaaaatactgtgacaaacagaatgatgtacgctcatgttgacttctaagataagcatgtgatttagataatttattgtttgcacaaaaatcagtcaccaactagatcattttaactttttaggatcatgtagtatttaact

SEQ ID NO: 70062 - DNA, 1537 bp, Homo sapiens
aattcagaaacaacttcagaagaaagaataagcaaagaccccctccagaggatttaaggatttttgtttttgtttttgagatggagtctcgctctgtctcccaggctagagtgcaatggcgtgatcttggctcactgcaacctcctcctcctgggttcaagcaattcttctgcttcagtctaccaagtagctgggattacaggcatccgccaccatgcctggcttatttttgtatttttagtagagatagggtttcaccatgttggccaggctggtcttgaactcctgatctcaggtgatccacctgcttcagcctcccaaagtgctgggattacaggcgtgagccaccgtgcctggccagatttaatgattttaaccagtggggtcatgtggaggctcagtgaccccagaaggcaactcacttccgttttctacatggggttgtccagggaaaatctagctcataaggaaggataagcacaggagccccttgatgggaagccacctcatggcaggggagtgggggattggtgttgggggacagcggttattcacactttccgaaggagaggggtttccatgctatctgagccctctggccataaattccccatttggatccactggaaacactgggtttggcaatggaggaagaaggaaaaagctttgcagccgagaagcaagtctgaggggaagggtgggagaccctcctgtctttgaagatgtgaaccatttcccaggggccatttgctccctgacacctgtgccacttggaacatcaggtggatcatcacttctagaaactcgagttgaatggctgtttgaattgtcttaggtctgcagcctccacccttgagatgaaaaggttttgtctagcctcccacactctcccccgggaatcatgtgctgttagttcaaggaacagaatctaagatgataagaagaaattgttccttccaccctttcttcaaggtctttgaattactttcgaaggtcttcagctcttcatcctcatggcttatcttgtcttttgcttcagaactttcctcttcttgttccaagtcatgatctgccttgacaggtaatatcctgagaagctccatttctttctgacaacgttcattcatttcctttcctctgtcctgaagattttgaactgtactttcagttgaggttccctcaatccaaagcttgttaagatgatctgtcaggtcagtttttgtgtcctcttttttagaaatgttggcatagagtttatttttctctttcttctgggtgttgagatgcacacaacccggcagcatctgtcggtttcctcctggcttctcttgctgctcatccacatggtctctgtctcctgtgtcccagttaccaactgtgttctcttctccaaggggagctgctaggtctttaacctttcacacagcttcctccggtcttcatctgaccttctgtagagactctagagctctgtatgaaaaccctgagttttttttccttttgcccttaatagtattaagcttattgtattttttcc

SEQ ID NO: 70063 - DNA, 1012 bp, Homo sapiens
tgtttggttttttgttcttgcgatagtttgctgagaatgatggtttccagcttcatccatgtccctacaaaggacatgaactcatccttttttatggctgcatagtattccgtggtgtatatgtgccacattttcttaatccagtctatcattgatggacatttgggttggttccaagtctttgctattgtgaatagtgctgcaataaacacacatgtgcatgtgcctttatagcagcagcagcatgatttataatcctttgggtctatacccagtgatgggatggctgggtcaaatggtatttctagttctagatccttgaggaatcgccacactgtcttccacaatggtcgaactagtttacagtcccatcaacaatgtaaaagtgttcctatttctgcacatcctctccagcacctgttgtttcctgacttttttatgatcgccatatttttcaagatatggcttggtagcttaatataaaatttagtgttcaactgaagactagagccttctttggctccttctgatcaatagcttatctcatatgggagttatcaagcattcaaagtatatttcttggtacacatgcaggaagtgtggttgaaaaggtttatgggatgtttagccctctgccgtccaatacagtagtaactagccacatttgaccacttaaattagaattaacattatttaaaaataattaaaaatttagttctctggccacacaaccaaatttggaaatgtactggacagagcagatatataacattgccatcatcatagaaatgtctattagacaacacagttctatccctatttatgccaaagtcacttataatgagtctagatctagaagtgagatacctgaatttgaactccacattcacgacttgccttgttctataagctgtaaggtctcaggcagagcctttaacctagtaacctcccatttcctttgggtaaaatgaggttacatctcctacaatgtccgtaaaatgcttccagttat

SEQ ID NO: 70064 - DNA, 1424 bp, Homo sapiens
ttgcctctttgcttcatggggaattcaaggaatagtgtctcaaattcttttgctctgtgggagcattctgcaccctgcaatcagctgtgcctttattctttagtgtatcatgcaacaaaacattgccttctgccaaacttcctgctcaggtttgctcttcactcagtcagattttcttataagactcaatgtgctgttatggttatgactgtgggctctggagacaatcaccttgctctgccagctctgccacatactcatagtgtgaccttggcaagtctaaccttattttatcatccataaatgggagggagggggatttatataaaaggacatatgccatagagttttgtgggggttaaatgatctattatccatgtacttggcctagtggctagaacttagtaagttccttataaattattcttgttaataataatacgatggtgatgtattaataatttagtgaattacctgttaggagtataaagtccagacacagatcttgatcaccaaaagatagaatgtgtgacagccaaagttttgaggtttactagagggacactttcttacctatagttgaacaactcagggaagctggtatgtggttctttctccatgttaccctatcctctgcacagggtctcaaaggcaaataaatgcctaggagaggcaggcaggtaatacacaggcataaggcagactgtgggtaagagattgcagagaatagaaaggatttaagtagactggagaatgtgtaccctgtctaagtggtctaaatccattgccaagcatcatttagccagttacaatcatgtgggaatggagtattagtaaatgatgtttatatgaaatctccaaatgtcaagtattggcttagtttttatttaaaactcttgtgtataccagacagaatatgtttgtgggctgacgctggcccatgagccatcactttaccgtcttttctttaaggcaacatttcccagtgtcttcccaagaatgctaacgctgtgggttgttaatttggaattacttggaaagaaggtcctatagccagataaatttgggaaacctagttctgtgacgaaattacatttagaaaatactttaccctgggtttcgttcccaaaatttatttgatcagagaaccttgctcccaaagaagactagtgaatctctccatggggctacacgagggagatgagtgtcagtattttggagaatgacaacaacaggggcagatctcaaggacctctttttatataatagacataaattgaatcttagttgacatttaggaagaagtcattaagttactcacattttgtgatgcaaatggaaccattgaatgtccattttgttagattttctgtttttaaataaaagatcttatcatctgacacctattgccagaacatatgtgc

SEQ ID NO: 70065 - DNA, 1012 bp, Homo sapiens
tccccttgctaagtcttctgtgtgaagtggcaccacgttgctaattctgtagttcccagttgttgtcaaatgctcagtgaactcttgacaaccatctcagactttaaaatatttaagcatcaccccgattacattgctaagaggtgctgaatgttttaaataaagcttacctaaacagtcttgtctcattccggtttcccctcacagaggaagtgtctttcaataacccaaaactactggcttctaattttagggataactaaggtgggactaggacagaaaataagctcttctccattgattttccttagtcattttactccagaggcctataattagctctattttctccacctgtggtacatctttaggttaaaatgatgttggagaaatagtggaggatgtgcagagttagaaattagggagtgtacttggtctcacttttgcatacttagatgaatggcactggggaagaagagaagggggacattatacaccaatctgtgtccatttccttttatttttaatgatactaataactcagggacacttattgatcatctactgtttgccaggcactgttctgagtgttttacttgtattaactcatttaatcctcacagtacaaaagccctgtgaggtaggtactgacactatccctatttcagagttgaggaaactgaaagggtaatttattcaatgtcacggagcatgtaaaagtcagcactaggctgggcaccgtggctcagacctgtaatcccagcactttgagcagccaaggcgagagaatcacttgaggctaggagttccagataagcctgggcagcaaagcgagacccccatctctaaaaatattaaaaataaaaaattacccaggcgtggtggcatgagcctgtaaccccagctacttgggaggctgaggtgggaggatggcttgagcccagaagtttgaggctgcagtgagctatgattaagccactgcactccagcctgggtgatggaacaagactcc

SEQ ID NO: 70066 - DNA, 1109 bp, Homo sapiens
ggtgtaagccactgtgcctggccaatattttaattgttttaacttaacattacatatatatatatatatatatatacacatacacacacacacaactatgtttgaaaattataaaggataacagtgtcatatgtatgacttaccacctaatctacaaacaaaagccctgccaattctgtcgcacttatctgtgctctgccccatcccatatacctgcctatcttttgaagcaactacttcctaatttttttctttctcttgcctttttttaaaaaatgttatttatcccttaaaaatatgctcataagtactatacagctaattttgcttgtttgttttgatttgtaaaaatagtataactgtttgacattgttgcatgtagctgtagttcattcattttaaaagctgaattatgtgttgttgggtgagtatgcagaatcaattgattcattgccctgttggtggatatttggattgtttccagctttctgctatttgaacaatgttgctgaacattttcatgtgttcctattaacacacatatacaggagtttctccatggcctattgctgggagtggaattgcatggttattgggtatgtcagtgttcaagttcacatgatacgactgcattgttttccgaaggagcatcaccagtttacattcccactcataagtgattaagagctccagcagacccactttttatcagcacgtggtattataaaacatcttaatttttgccagtctggtgggtataacattgcattgtggtcttcattgacatttcctgataactattgagatatagcctctgaagaggtgacttgagcagaaacctgaatgaagtgaacgaccaaaccatgaatgactgatgggtggaatgttccaaggcaacaaaacacaggctgaaattatcctgagatgtccatggagtagcaagagagtccttgtgaataaagagaagtgagctggagatacaaggttgggaaggagtggagaggctagttctcctagaacctgggatgccatggtaaatactgtactttagacttgatatgagagtatgagaagacatgacaaggcgattagaagggaggaatgtgatt

SEQ ID NO: 70067 - DNA, 1558 bp, Homo sapiens
atttgtttcctggatcctgatttagtagcagagcctccttatgaagaagtggcctgccttctcttgcctgaatttaaagtagtactgcttcaggtgcaaatcataccagcattcatattcaaggtgaatctactgctgacattattataaactatttactttcagcatcaatgacttagtctctcatcagggcagacaaatgctaagcttttacactttctgatcattgggaaaaataaatgagatgtataatgtcttaattttgatgaggggtttaagttaaatttgaggaaaattgttaatagttgtgtatattaaaaagcttcattattaaaattatgccgattagtaggatgtacctgcagtgcagaagtcaaaattatcatgcacattcagtgttttagaattaaaattttgggggaagtattacagcgaagaaaaattgagggaagtgttaacatttattgagaatttgcatatgttacttaattttcacagtcacagataccacgtgttaatatctaaagtagaaaaaggaataaagcaaaggaggacaaaaagaaaaggagtaagaataatttttctatgaaattattgattgctgcgcttatactgtagcccttatactgtggcctgtccttgtactgatcaggccagcccgtccacagatagagatggcatccttatgtttataccgggaagctgtaggtttcctatgtctgaccccactttcccctaacccagccacagtggcccagtctgttagggcagaatttgtattatgcctttcacacttcccattttgttctttaattcacactgtaacctaagcctagaatgaaaaccttcatgcataaataagatggtcccttattgcaggtgaaaaatcactttggactgaggaggaccacaacttgcccagtttcaagaggatttccttttatccttctctctcaaatccgcaatttaatttcatgttctaaaaatgattggataatatatatttatagtagtttgatattataccactggtttaagcactctgattctttcttcctcacaccatcaattacatagactttttggatgttccaaaattacccttctaatttaatatcttaacagcaagcaaatgtggattttttgttataaataatagttaagagttgctgagcctatgctgtgtgttgggtgctgtgctattctattcagacaatctttataatactctcatgggggatataaatatagttatcattccagtttcataggagaggaaagtgaaggctcagagaggtgaagttctttggccatggtcacccaagttgcaagtggtccagctgaatttagaccaacttgttcacctcctaagtctgtgctctgcctgccttctgggtagggctcaagtcttctttttgtttgttgttttttaggatttttattattaatattatttttgtttgacaaatcataattgtatacattcatggggtacaatgtgatgttttgatatatgtatacaatgtggaatgattaaataaagttaattaacatatca

SEQ ID NO: 70068 - DNA, 1075 bp, Homo sapiens
aagataactaatttccttattgtgtaaagccagtttgaattgggcccaaagttctctcactgatatatcaattctacaatttgctaacttgttcatatccaagattgactttgatctgaacaacaattctgcaaagttggtaatatataaataattattccctatactgatgatgaaactgaagttaaaaggataccacttgcctaaggacccaaatccaaatttaccaattccaaatctttctgttttccctctgctttttcaaatgagagagcgccatatcagtggagagatgtggtacttaattcatcagttctggagtgaatgcctgttctatgcccaggtaacattctaggagctagggatccaaagcagaggagagggaagaaaagaaaagcagcagagagtgaaagtgtgctcagcatttggcacatgaatctcatgttgggatcagtggatgttgcacattggttggtcatgataactgcatcaaaaaattaagttgggattagattgtagaaacctaagaattccaggctagagttaatttctcatttagtaggaaaaactgggatgttgctgacaatggcccataatcatacagcacaaaaagagaggcaggtctttaaaagtcctttcatcttggtgacaagttgtatatctatatgtgtaccattttatatataatctactatagaacttgaaataagggaaaaccagaaaccccaagaacatttctctttagatgtggataatttagcattatccatactgcaaatgaaatgtagtagtattctatgaattacttagttcaaatgtgacttgtctatgacatctgggccccatatggtagattaattaaagcagggatgctgaatttggatagcttgatatcctcttcaaagactgatctcccttaggactaagacaggaaaatcctgacgttttgatttctctgtgtacagggacctttagcgtgagaacaataaacggccttttgtagcttcttaatgagacatgtagcatgttatattaacacctaggagctcgccttaaactgctgtccctcactaat

SEQ ID NO: 70069 - DNA, 1032 bp, Homo sapiens
taattgtaattttttacccattaaccaacctctctgtatcacccatcctccctacccttcccagtctctgatgaccactattttctttacttctgggagagcaactttttaagctccctcatgagtaacattttagaagtaaaaaaaaatgtttaaatacaagaagataatagtattcagtatttcagagatttgtgagctctttgaaatttttcttaattaaatcacccagtatacccaaatagaactttgctgaaatacacaaaatcattttttaaatcaacaggttgtcagagtaaggttgttttatttgttttataaagaaaattatgtaattgggaacagcagaagttgctgagagaacagaatgtattttggtttgattttttttcccctggggaagtgagaaaagaggaggaagtaaagaattctaggaacccgccttcagcacccagcttcagctaccagccgggtggctgtgggcaaattcttagtctctttttgcctcagtcctcatctgtaaaactgagatgataataataatacttatctaataggattggtatagaatttaaatgagttaattcctacaaaatagaattgtgtctgacataatatccactctctcacatttagctatagcaatatatgattataattgttattactattattagatatcttatatttgaatgagaaatttaagtttttgaagccttttgtcattcatcctttcatccttcatgcaacagtgttgggagtccacaagggtgagtatttattatacctgttttaaggatgaagtcacttgagccctaaagaggattagtaacttgcccagggtcacttaagtagtggcagagctgggaatctcatctagtattctcaattgaccctttccagtagcctgagaagtaggacttaataaaccccagagaaagcattacgcttgaggcctatataactccctagttacactgtgggttttcttctttgaattacatcccaagaacagctcactagtggttactt

SEQ ID NO: 70070 - DNA, 1032 bp, Homo sapiens
tgtgctgtgctgttggcattcaggagagccctagtctaggagactgggcctgaagtgccctgcagactgctcgcttgcctctgctcatggttacttggcacctgtgcttggggaagcatccaatggagtggcagaggctcaatgccatccattcagacagctttctgaatgccggcagccaagagaacatcagctgtgcctgtgagtagtgtgggtccccgccagaaacatctaaacttcaaagggaaaaaaatcgtactgtgggtcggtgtggaaagcttttggtcttcttgaattttactcgttttcacagagaaggaagatggtgtgaagcattctgatggactccacctgtttttaggtgccaagataattaagctagagtagttgcatttaaaacctaaccatgaaaataaaatgaatacaaagaatttctgtttggtgtcagagctaccttagaattagggaactgtgaaagaagatcttggatgaatctgatggcagatttcattaaagttgaagttacatattcatgactgattttgattgcaccatttctaaggtcttaaagcggtgggggtggggaggtcttataaccgaataacctactctttcgttctaaaagaaaaagaaatcgtgcttttgttttgacttgaaattttattctcatgctggcccaagagtaaagtctgatacctggaatgtactggcagcaaaatgtactgtttaaaaatctgaaacatcggccaggcacagtggctcacacctgtaatcccagcactttgggaggccaaggcaggcggatcacgaggtcaggagattgagaccatcctggctaacacagtgaaaccccgtctctattaaaaatacaaaaaaattagccgggcgtggtggtgggcacctgtagtcccagctactcgggaggctgagttaggagaatggcgtgaacccgggaggcagagcttgcagtgaaccgagattgtgccactgcactccagcctgggtgacagagcgagactctgtctcaaaaag

SEQ ID NO: 70071 - DNA, 1041 bp, Homo sapiens
gctatctttcaatgtatataacagctgtgatgtatttcacatatcacatgatttatcatttcaaaaatgcaattcagtggcttttggcatatgccaggttttgcgaccagagccacaatcaatttttcatcatttttattaccctataaagaaacttcgcaccccttagcagccatttttccccaaccctcccaactctaggcaacccctaatctactttctgtctctatagattagtctattctggacctttcataggaatgaaattatagactgtggttttttgtgagtggtttcactcactaaagttatgttttcaaggttcatccatgttgtaaataagtacttcattcctttttatggctaaacagtattgtgttgtgtggctatatcacattttatctctttattagttgatacacatttgagctgttttcacctttcagctattatgagcaatgctgctattgcacacattcacgtgcaagtttttgtatggaaatagattttcatttctctggaatgtatacctaggagcagaatggctgagtcatatggtaactctaagtgtaatcttttgaagaactgccagactgttttccaaaaggactgcatcattttacatttccaccagcaatgtgtgagttccagtttctccacattgtcttccaacactttttttaaatctttttgattatagccattctagtgagtgtgaagtggcaccccattgtgcttttgatttgcatctccctgaaagctaatgatattgagcaacttttcatatgctactggccatttgccatttgtatatcatcttgggagaaatgtctgttgagaccctttgaccttttttttttttttttttttttttgagatggagtctctatcaccaggctggagtgcagtggcacgatcttggcttactgcaacctctgcctgccaggttcaagcaattctcctccctcagcctcccgagtagctgggactacaggtgcacaccaccacgcccagctaatttttgtatttttagtagagatg

SEQ ID NO: 70072 - DNA, 1009 bp, Homo sapiens
gtaaacataaattgctttcttcaatggagcgtttaaagctgagggcctgcctaagcactgtgtatattagggtcccatggtccttgtcaggaatatggatttcaccagtgttcatggtccaagtttttccttccaaacctggacaattgctggctctatgccatccacaggctggaagcctgttctgctggctgataagtgtcctggtctgagaaatgctcagagcaggatgcacagcacagtatccatctgttgtggttctttagtttgccttggtgacttcactcatctgattggggcaactttgaaatgggtggtaattctgtgtttcttcacttcttaggaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaaggtacactccataaatcctgccatagtgtgctttccaataactgccttgtctataaccaggactgagaacggtatctgaaaaattaggtgaatgaatgaatcctttagagacacagaataaacagttaaaaattagatgaatggatgttttaaagacacggaataaagagttaaaaattaggccgggcgtggtagctcatgcctgtaatcccagcactttgggaggctgaggcgggtggatcacgaggccaagagatcgagaccatcctggccaacatagtgaaaccctgtctctactaaaaacacagaaattagctgggcgtggtggcgcttgcctgtagtcccagctacttgggaggctgaggcaggagaatcacttgaacccaggaggcggaggttgcagtgagccaagatcgtgccactgcactccagcctgggcgacagagtgagactccgactcaaacaaacaaaaaaaagagttaaaaattagatgaattaatcttt

SEQ ID NO: 70073 - DNA, 1047 bp, Homo sapiens
agctggctggtgttaggagtgtagcctatggcgtgatgaaggataaacagtgagtaacagctgtctgaggtctggagaggcaggctgtggagggcacaagaatttgaatctcagtttgaggaattggtatgttgttatctaagcaattaaggatgctaagagagttttaaagcagatatatgacttaatcagctttgtgaagcatttgaaagcattggaatgggaagaaacttgtcttggggaacctgatgaggaagctgttgcattagtaatctgggtgataatttttatcctatcatgtgagttgtggccagagcataactctatacttacaatgacattgccttcaaaaagttcttattattgtcaaccaccagtgtgtcctgggggggaaaaaagaattatcattggtgcagattaataacgagttgaatggatttttgctgttgacttttaaaagccctgttagtaatttaaatccagaatatttttattcagtccatcctattcagattttcttaaggcttctacttctttagctgatggatctttagcttactgggaaaagaaaaagaatctaatcctgattcatagattcttgggcttataatctatgcagacatggatttggactgactccaccaaacagggcaatcacaagtgattacaagttactgagtggcctgtgttgcttcctaatcctcccaagatcttagcttcaaccccttgaaatataaaaacttgtacttaatatcactagctggaaaataatgaaccgttatctgtgaggcaaggagaatttgctctgatttctgtaaactgtgtcatataaggcagtggtccccaacctttttggcaccaaggactggtttcatggaaggcaatttttctaagggcaaggggatagtttcgagatgaaactgttctacctcagatcatcaggcattagattctcataaggagcacataacctaaatgccttgcatgcacagttcacagtagggtttgtgctcctatgagaatctaatgctgcggctgatcggacag

SEQ ID NO: 70074 - DNA, 1032 bp, Homo sapiens
gatttgaaagtttatatgaatagactgttgcattcaaatttagaaaaacaaagtgtcttcacaagataaagataagatgctgagctaataatagcatcataatgacaataagagataatacttatggaatgcttagtatgtgccagacactctgttaagcacataaccatgggcatgtcatttaatccttttaacaacgctatggagtatatactgtgatctttccctattttacagcggaaacagctcagagaagttaaatatatttaaacagatatttaaatagcttggcccttcttgaaggttttgggggttttcccccttaaagtgcctgtcatcccatgtgcaattgcccattagccacaaggatttttaaaatttctctgattgtattcagcaacccaagtgtctttgtcaaaaagatacttactccataagaatgtttttctttttctatttgttttggtacctttacttacatccattgtcagattggtgaccagttaactggctgtagttctgaggtggtgctattcagccaaatgtcaatctttaaaggaagtttctgatttcgtttaaatttttaaagatcaattactttatttaaaaagtatgggtatagttccagagtgatataaatatagagattttgcttggcttaaagtgtttttgaagatgcgtaaatcagactggattgaaattgttttgattacctctctgtttctctcctagactgtaaggccacttttctttcctaaacacataggagacacttagtaaaaattagtagaattaatgggttaatgcgtgactgagtatgtgaatgaatgaacttcaatatctcaaagaatctctgccttttgcttgctaatccaatggatgacttataaatgagcaaatttcctgcttgttgatttgcttagtccctaggtttttcttaccacagtactattaagagtaagcttatgggtttcctacacaatgtggtctaatttgcttcattacataatatacttataatcccagccacct

SEQ ID NO: 70075 - DNA, 1050 bp, Homo sapiens
aagagtcaggttctaccaaaggccaccagggttggagtgaccctatcacagtcatttaagctctcagaattggttgaggaattaagggatagggcagacaagtaatgaggttttaattatgtcatctgtagatcactttgagctcctggggaaaaaatttactttaatcagagagcatgctcagcaaggccagaggtcatattctgtggggagagaacttcatatcactcatgcacacacacacacaccctctccctttttattctaaaaggagatgctattttgtctttcttgcattttatcttcagatacacaaactctgtcttgttcaaatcaaatctatccattatattaatacttactcagtttatattaggaaagaggcaagatgaggcatatttgaacagtggaacaatatttggaggaatgtagtttaggttccccattcaaccactcactggcattttggtcatgaacaaataaccaagttgcatcgtgcatagaattttgtacaactgatgatgtaatagtgattgttgaagtaacaggcataaaatacatagcctcagggaattgaggatgctttttaattgtcttttctggcaaatattcactcctcacttgctctcaaaccttgacactccttgggagttgaaagtgagcagttgagaagtatactaacttccatatgccagtggagtacttaattttaaattacagtcaacctttgtggtgggtgacagccttatgtttggacttccttaccccagaatattgctcccacagcaattgttgattatttcaaacattttatcagaaggctgtgtctcaaataaaatatatatgctcaggaaggagaatagagagagacgccctatggtccatttatacgttagagtgaacctagttttaccaggccagattgtgcagatgatggggtagatatgatatcatatgatgatatgatagatatataatacaatagagcacaggttgtgtggatatggcacgaagccctggacttaaagcaaagacaggatggtggcatta

SEQ ID NO: 70076 - DNA, 1099 bp, Homo sapiens
agagagtgaattctctcttactcagcctttttgttcaatgcaggtcatcagtaggttggataagacccacctatattggagagggcaatctgttttacccagcctactgattcctatgttaatctcatccagaagcactctcacacacatccagaatcatgtttgaccaaatatctgggcaccccacggcctagtcaagttgacacataaaattaattattacggcatctgacaaggcacaaggatataatggggaagggtcaatgcttaaatcacagctctgtccctttctggtgtgcacaactctgcacctcagttttctcatctgtaaaatggagatcaaaataatacctcttagagttgttgaatgaatgttctgaagacaaatggaagcattttgcatgcttgctgagctatgcactatgagatgtactgggaatatagctgtgaataaaaacagaccaagtccttcctctcaaggcatttacattccagtgaagagagagagaggggccataaataaatgtataatatgggaggtgtaagaggtaagaggaaaagtacagctgagttgatacaggtaaagcattcagaacagtgcctgtcacacggtaaatgtttaaaaaacattagtagttaatgttagcctcctcatcatcatcgccctctttatcagtgaaatggggatggccccagcttcatgtcagcctcacaaagtaaatgcagatatcaggaatgattttaacagtaattacagatggttttttacatatatatgaatttttttatgatgaatatatgttacttttgtaccaaaaaaaaaaaaaaaaaaaaaaaggaaggtaacttccctaagaaactacgttgatagtaaatgttaacagggctgtgatcgaagaagtggaaaagtgaaaggcaaaaacagagaaaaatggtgacacaaaggttagagggaacattcaaaacaaaatgtgccttcatcggcccagtaaagaggtcatatgaaacgggtttaaagtgttaagcccgtcccactaccaaaatctcaaaaggttatgtagtattttaatagaaaaaccatgatttgccctttattact

SEQ ID NO: 70077 - DNA, 1039 bp, Homo sapiens
tctttagcctgtctgtgaattttctgctgcattatttgacccatctaaatgtatgagtatcagtgcttttactttttagcaatgtacatattttcatataatattaatgttatttttgcatcaaacattttatctacattaccttttttagtcattttttatcattatacaaagtatgtgtagagggaaacatcacactgtaccccataaatgtgtacaatttttttgtgtcaattacaaataaaaatattttttaaatccccaaaaaagaaaaaaaatgccgctctgtatgataactcctgaaacaaaagtattaacactacagtgaacagaagctgattatttctgtgatgtttcttagctttatttcctccctttgcatatgtgttctccatttttccctttgttttacttagtccctgcatctcgtttgccctgtcatttggttacttggcagtccctagccagcagggtgcagagtcccagacagtgtcttttgttcaaagcatttgtttggattataaatataatttgatgataaattcaaactgttatgctgatttcatttcagtggagtcacaacgtatctcaaatttcctttgataaacttgccctaaagaccgtatctcatgctatttaattgttcaccttggtctatttgctcattctaaagagttttgtggccaggtgtggtggctcatgcctgtaatcccagcactttgggaggctgtggtgggggcggatcacctgaggtcaggagttaagaccagcctggtcaacatggtgaaaccccatctctactaaaaacacaaaaattagcccagcatggtggcgaatgcctgttatcccagctactctgggggctgaggcaggagaatcgtttgaacccgggaggcggaggttgcagtgagccgagctcatgacattacacttcagcttgggttacagagcgagactccatctaaatgaaataaataaataaataagactgggtgcgatggctcacgcctataatcccaacactttgggaggccaaggc

SEQ ID NO: 70078 - DNA, 1065 bp, Homo sapiens
gagttaggaaatattgtcactaacatactgtttttcatctcccttccctgccaaaccaccacatcatttcttttctgagaggccataaattccaacactaaccatatttcacaaatgacttagaactatttgtcatcccattagtccaatcccaggtatttattgctggtgctattttggaagccgaggatagaaaagaacaatgccagatgcattgtagatgtttaataaatatttgttaagtgaataaatggatggacaagcttactataaaatgggttcttatccttcatttgattctcacctattttactcatactgtatatgagacagttttaagaatctgaaggtacataaacatgactggtaccctggctcttcttacaggacagtccacaatctgggtggtacacagagatctgtgacatatagctaaagtgctatgtgctgaagactctgaatgaagagctgtcttgaaagacaatacttgtcttggcaatcagaagaataagatccctctggctgagaagccagggaacacttagccataggtgagatttaagcttgccatggagaatgggtcaaatgtcaaaaggaggaggtgctgggggacagcagctcagggacttgcttgggagaagctgcagaggcaggaacatataaattctggggagggagccgtgagtgactgactcagagtggtacacaaattgctgcttggatgggtgttgggaccagtctgatagcattgaactccatggtagagggaatcatgtcaagtttaagaaaaggtcaaagagaatggtaacagggaaaaggccttataactgtcatcgtggattctttttcttattgtccattccctcttcctccgtactaaatgaagtcaccccaagccatcctgcatatctccaccatgttattactaagacactgctttgaccatactgtctgcaacactgtggattcaccaacacctatagaatacattatgcccttcttagtgggggtttcaagactctttggcccatgccaacttatctaatcttatccttcagcttgtta

SEQ ID NO: 70079 - DNA, 1032 bp, Homo sapiens
acatttatattttttgtttcaagcaagctttaactcactgaagggagggccttgatccaaaagaataccaagagaaatgaagagaatttctaggatgggtataaaaatgagtcctgggatagagcaccccaaagaaaatggcagagctcaggatggctctcagtggagaaaccactcgttttctctgatgcactgagcattttggcatccatgatttgaaaggataacttcagcgtccactgttcattcagtgaactttttctgataatttgctgtgtttcaggcaccatgctagtccctggagctataaagattattaagttatcactgacttcaagttgcttccaccgtaggtggaaatataaacctctaaacagtgaggcatgtgcttgtgagaaattgatttgagatcatgctccttagaccacactcagtgtcaggtccaccctcatgggtcattaaatcagagtcaggggtgggccgcaggaaaacaggttttctgagacacagctgaaggcagagactttgttctgagagtcctgagcaacaatgatgttttcttccttggattaagttatatcattgctgaaaatgaattttgttcaaaaacaagagagcctagcatttgtaaacattaccttaaatgcaggtacataaattattagtgtgaattcttctggaatggtgatgtgacattccctaccctcacccccccccaaaaaaaaaagtcgtggggcagcaaacattgtttttttcaaatctggtaatgcctacccaacacagacaggggatagggttattagcattgcacccatgttagggtacaaggagcaagagaaggccatggcaggatgctctgcctgtgctctcgccttctgtggcctgtgctagctgtgagtttctgtacccttggctaattaattacggagttgacccaatctctctctgtgtgtgtgtgtgtgtgtgtgtgtgtgtgtgtgtgtgtgggcggcgggggggggctctttctgctaatttttagtacatctgaaa

SEQ ID NO: 70080 - DNA, 1049 bp, Homo sapiens
tatgaattgtatatttgtgctttaagaagcagaggacactctgtgtttagatttggttttgtttgtatatgtcatgattaagttctcctggcacgattttcttctaaagcatggtgctaaccttgaggaagcgtagtgaaatctagggagggctggaaagtcaataccgagctcctagggagggatcttcagagtgtggtgctcctgatcgtagaaaagtctggaaacactgcccctcccctacctgctgaccccccagtctcttcttccttcccttctcagacttctgcacccttccaaccccacccctgtttgttttaatgggcgagtatttgttgttccatctgttgcctgtttagactctggaaaccagttaaaccagtttgggtgatttttttctttcagcaggcattggctgtagttgagaaacaatcttaaagtataagtagattgctatgtctaataatagtaacaaaacaacagcaacagctaacacttgaaaggctttctctgtgccaggctttgttctgagttgtatattttactgtgcactaataatttctccgtttttacaaatgaggaaactgaggggaggcatgagaatacaggcaaaggggactgtataaatgttaatgtttctctttgtctttatgaaatttaaaaggaaaaaaataaatacaagccaagttcctgtcttaagtgcttcatagtctgtaactttatcttttattcacactagaccctgccagaagttagaaaaagtaaaagagaatgtggaagggagtgggaaatgagaggactgagttgtgtgagtaactcaggtcaaaaaagagattgcgcctcttagacctaaattcttgcctcccacaattctggaaccttccttaaccataaagtttctatcaccttatctcctggtttccaccaaagaactcatcatcctcagggaatgaccacatggagaaaggttatcatgacctaagaaccatgtctgacacagttaggatgaaaaggccaattacacctagaaggaaaaaaaaaaaacaacg

SEQ ID NO: 70081 - DNA, 1088 bp, Homo sapiens
tcccattaactatatgtaggagataaaatgcatttaggtgtgaaaaataattcacttcataattctcgagtgaaatttaagagtagctgaaaaaaaatgtttgaaccaagaacaagttaagcctgggttatttttttccttcaaaatggcttatatgttggggggtgtggcgaggggaaggagtggtccgttgtttttaataattaagtagctttccaaagaaaatgattgaaatctaatcctcagactgctggaagctttcacatttctctgggaagaagagtcttctaagcttgtgtgttattgatctattaatgatgatactgattaaaaaataaaacctcattcatcagttgagacacactcaggactattagctgaaaaaacgatggatgtggtagtgtggttatactgtgaatcatagttcttgcaaagcacgctcttggttcattattcaaaatgtatcttttataggtttttaattttttatctcatactattaactatggatggatggagcaaaataattttaagcattttacatatcattttctaaatctagggaataatttgttaggatattgttacaaaaatagcagaatttcaaagttataacacatttcatttctaaggaattctcattggcatcattattgaatcacttgaaagtgattacctatgttattaaatttacatttatagatattaatttaataatgtacatatttatagaatttattaaatttatttaaatattcagtattttgtatttggctttaggcatatgaggcagacagaattgtaagccataatacctacctttcttctaggatctttcaaagtatttgccaggaaaaaagacttacgtttttaaaggtggtacattatagtgcttgggagctagtacattatagttcctgggatctcaggactgggattaaaacaaacttggacctgagtgccacacccaccccatactaatagcgtgaccttgggcaagtcacttttctatatgctcagtcttttctgtaaaataaggataacaatagaagctacctcataaagtcgttgtgaaaattgtgagttaa

SEQ ID NO: 70082 - DNA, 1387 bp, Homo sapiens
accacatacactctgctgattcctttcagtttacttactttaaatttttttcctgcaggtcatagagctgaatatatgactacaaggtaggaaaatattttatcataacttatagcgtattttactttctctttaacaagaagcaaccatttcaatgctgaaagaattaacattttgttaatgaatacgggagatagttttggcttgacaaagcatagcaacatgaaatgtttgggcttcttacaagactaggtatgttctagcttatttttgtttccctctggaattgtaaagctctttaataggcagagacagtaacaaaaacctaagttaaaccggcttggtttatctaatccagaatactttaactgtttctaaatagcgtgacaggacttttgatttgatagtttaattaaaaaaaaaatacgacgtgtacatctactgcataagtaagtagaaagtacaattattttctgttcctattttcctttagtcatataaacattagagctggccgggtgcagtggctcagcctgtaatcccagcactttgggagactgaggcgggtggatcacctgaggtcaggagctcacgaccagcctggccaatgtggtgaaaccctgtctctactaaaaataccaaaaaattagccgggcgtggtggtgtgcgcctgtaatcccagctactcaggaggctggggcaggaaaatcacttgaacccggcaggcggaggttgcagtgagccaagattgcgccaccacactccagcctgggcaagagcgagactccatctcaaaaaataaaaataaaaaataaaaataaaaatttgagctatattgaatatctttaggattttagctgtctatatattctccattttgattcactttaaacatttaacttttaacacatactcccatattgtactttcttcattcaggggaggattgtgaagctactacaagaaaggaaagccatttgggcagcagattctgatttgggttcgggaaagtttgtggcaacttttatttttctatgtcaccatttgtgcaacagacagaaattatctaattagcatagcaagatgttgcatttttgaaattgagttctctttgaaataagacgcatttagaacactggtatatctgctgcagtaattggcaagttgactttcaaggatctataatgttattgctgggcagcttattcataaggaagcccctcgtacttcatggtaaaccaactagaaagatacagctcctgacttttccaaacctaacaaaagaaaaaaacactgaggtttttcttcactgtgtcagtgaaaaagaagactattacctcgacctggtaatatgcagcttatagagatgtttttcacctatagcatc

SEQ ID NO: 70083 - DNA, 2011 bp, Homo sapiens
atgctttggtatattggggactttctgaccccagaagtactgcccctcccgggattagccaattcctagcagtagtagtaagaactggcttgccaagtgtgccttttgtatgcaagccaggtgatccagacgacctacctccaaccacctccttcatggttctgacactcacggccactattccccttccctaatcaccccaaggccaggtataggacaacttagggatagtccctatgccccaaagcccactggaatcattccaactagcctattctaaacctgcttgcccagcttctcccattccctccagtgggaaccacaataaagactcctgcccacattttcctttgtgccttctgcctcctgacccaccccggtgcttccttctgtggcctccctggtggtggggcacatccccaactctttaacaaactatcttttcagtggtagttgtctcctgaacgttggcctccccgtacctgaataaaaatgaaatccacactttaaaacacttttaaaatagtgaaaggagtggatgaaatcaagtatgtagggttaaatgctttggtggttggttgttttgttctttttactcctatcagattatttcctccatgaatggccagaactcagtgtataaaagagatctcagaaatttcatccgtggcaggagatgacatgttgcctggtagaagtttccatattctctcctagacacttgcaaaggcttcttttaacctcgccagcactgtagaacttcaggtgctgcttgctgtgcaccttgttcatcatatgagcccatctgctgggagggtcttagaatttagctgtggaaggctgtaccagtaggtttgtttccatacatgatagtgtctaaggaagctagtcaggcttccacgtaacttcttgggatctggtatatgaaccagactttctgaacttaagctaaatgaactaaaaaagataaattttcctagagtctgaagcttaatgaagggctttacacaatttcctggtgtggtgtgtatcctcctataagtcttgcagttaaaaaggagttttacattaaaacatccagagacaggtctcagggctctccttccatgtatttcattcagcacagtagtagaagttgagtcaggtaattctggccttctttccactaaagggagagagcagaagaggttccctctctgcagtcacagggcaagatgtcacagtttctaaatatactacatgctgcactagatgtgcatatgtcagagagaatggtttattcaccagagcaaatgggcagactggagaggaagagagtctgcagtggcataaacaagtacatcctcagatatttaggtggtggaatagtttgttctaaagaaataataactcatgcgagcctgtatgtcccccaaattagaaaaagcagtgaacccaaattatttttctcacttgtgacctattaatagttacttttgcatgaaataaaattccattactgctggaggggtatcgaacagatgtgatgttacttgcattggtttgctgggctgagtgaggtggctcacgcctataattccagcactttgggaggccaaggtggaaggatcttttgagcccaggagttcaagaccagcctggaaaacacagggggactccgtctctataaaaaatttaaaaattagctgggcatgatggcatgcgcctgtagtcctagctacttgggctgaggtgggaggatcccttgagcccagaagaaggtggaggctgcagtgagccatgatcattccactacactccagcctgggtaacagagcaagactctgacttaaaaaaaaaaattatgtgtacctaaaaatgttatatttaattcctcatttggggatctaccggagccctaatctttatgaccggttgtatcttactgtgtgacttgtaaaccaaataacaagaatgctggtttgtaacatttggccaaatagctaacgagtctacttggtagtgcttattt

SEQ ID NO: 70084 - DNA, 1350 bp, Homo sapiens
tcaaggtactggcaccagccatctgggtggctgatctccatgcttcttactataatggtctcagcctcttgtaagaggaggaaggtcattatgtccaagtctgtcctggggctctttgctttcccagaaaatcaatataatatttcctgaagtcagagaggaaagaatatttgggtcgagtgccttcagaagagagaataaatgtgagtattattatgtgggcataaaagaaagccctctttctttatttttttaaaaagagccataatttgtacagaaagttaaaaagcaacctgataaaaatgttgtatttttactcatgcaaatgagatggcacaaaatattctttaaagtctgcttgttaggatagctctgaaacacagcaggagttttgatttcccatgacttgaggaattcattatattgaatgaattgtaagactatgatctataccttgtacctctgctgtgtttactcttcgtcttctttttcatcctgtatttctgataatgcttctagccgaggacgaagaaactcgcacacaagacatcaggtatagtgctagagggacgtgagggtgctctttcactgttggtatcattttcaagtcgtgctcatgcttggctttaattagattgttaaggtttttaaaagaaaaatgtttgcatttggaaatcagacaagtttataaataggttttacttagaaactgtagcaatcaaacactagaggaaaaatgggcacattaaactattagtttttacattatgtgtttggcaaatgtatcaagtttgatcaagggctttattagggaaagtcaatgttaaataccaaatacacatttaatactggattatggaccctagtgtgaattttacaaaaaagaaaagggcttgctttctcctttgtagttcacattttatggcatgggctgcggtgtttctgcaaactaagtttatctgagaaaccatgtcattaataacctcccttaatgatatattacagacgtcttactttcttaggtctgtttattgaatatgtgtactaataattaaataaatgtgcatgtggcatgtataaggacatacatacatatatacatacatacatacatacatacatacatacatatgtacatagattaaaaacctctggcagccttaaaaatcagccctactctggaattaagtggaaagccactgaagaacctaaatagcagttacagatctactgccttaagccttaaatccagaagaaccttattggctctaatttaatataaaattattgtcaaatttgattacctattttcccagcccctggcttataagcagggacaaattatatgga

SEQ ID NO: 70085 - DNA, 1041 bp, Homo sapiens
ttcacttataggagctcttcacagcccagatggcacattgaagaatctttggtaatagaaacaatacagagggctcctttccacttctaaaaagggcttgatcacttgcaatctccacaatgtcactgtgaagacagcaagagcaaaaccattttttctcttttttctcttgggaaaaccgacaccaagggattagtttgaatgatagatggaatgcacccccattgttcttataaaatattttcttatgttttctacccatgcatctgaaatctgtaaaattaaattaaattaaatcacatatactcattactttttgactacaaaattaattatatctgaatgaaatactgatcatagcttttttaaaaagcaattagtaaatgtaaacacaaaaacattttttaaaaatatgaaaaccgaagacattttttattgagaactttcttagtgcaaacattttccttttcataaccttgtattctttgcttttctttttaatactaaattcagcagagatgtaaactaatgatctctttttatcacttacatttaaaaatatgttgctttcagattagtgttccatgaattgttcgtatagtttacttcccctaaaacacttatatcttaaagaaaaatcctttcacatattcagtaagttatgatgtaattacattgctgttcctgagccaactagtccacactaaaatgcgtttttattcttaagactcttctttaagaaattaataaaatttgtgctcctaaaacaaattaactaattagaaaaacttaatacagtctccagaagtaattgagccattaactggtttatacactgattagattgtgttaaaacctaaaataagacaattccttaagaagtataatacccattccaggaatagtaaagcgtttaaattgctgaactgcattattcttaatccttcccccactgcttaattggaaaggttaatggattctgaattgttctaatatattaagacaaccaactttttcttgcatttcaaaataaaattcctc

SEQ ID NO: 70086 - DNA, 1011 bp, Homo sapiens
accaattattttaattttagtaccatataatctttcataaagcataattaaaagatacatgtatatatagcaacgtgtatgttcatagaaatatatttttgttcagagaaaaagaagcactgttaatgtaatgagttttttttttttttttaggtgaaaatcctttggctgatgaccagagtaaccatgatattaactcagttgctggcgttctgaagctctatttccgtgggctggaaaaccccctctttcctaaggaaagatttaacgatctgatttcttgtatcagtaagtggacatttttttcatcttttcccacaagaattatttcactagctaacttcctggaaaaggcagtggcccccctccatacacccccacccccattaccccattaccaccatatttctgggaccatttgttttctttctggatccagtgcgagtcatcctcccagctgtggcctcaccctcggctgagtgggctttcctcctgaacatcctctggctccagaaagccaggagcttcccactcatggctggaattgagcagaaagccaggtgccagctgcctaagggaaaggaggaagttgtaagctgggaaatgtgaccttttcttggcttttgattcttggtttttctcaaccaattttaggagtggggtaatttatccatctttcaatgttatttcaagaaatggataaaatgaaatcaaagatccttattacagtgcaggaacaccaggtggtaattatctgtcagtgggcaacccaagctaataggcagagttgctctgggattgtgtatgacatattatgaaaccgataatcattggcaaagtaaagcattgctgtttacttcagtgggggctttttgacactatacaaaggaaggtgaaaataatgataccatgaattaattattagccacaatcaagatccatgcatctaaaaatacagtgtcccttttaagtccgagttcccagcaagagtctagagctgacttcaatcac

SEQ ID NO: 70087 - DNA, 1036 bp, Homo sapiens
acagtgctcaagtgcaagtgaagaagctacaatgacattccctcctgtattaaaacaatggattaatcaaaatcaatggattcataatccttggattttaataggattgttaatgttttcattagtgcagtagttacaaagtttcataaatgttgagtagtctgccccaatcctatttttccccataagtcttgttacttttagtgcaaagttttacagaatggcaggtgtttcaaaaacatacatattgacactaacaacctctttatagaacaaccccttttcctccaacatgtaacctcttaagaaagagaggattcttggatgttattatctctaagcaagcatttttttcttaccaatgtgaccataatgcatttttcctggattttcctgcatttttcctggattttcaataaatcctttgagtagcataatacatcttttatcattgtatccccttatcaatattgcagacttttgacgatttgaaccaagttgattaatagtctacaatgtataaaactgtctagggattcagagacttgattcttgcatttaagaggcttaaaatgtagtaggaaaggtaagatatttacaaataaatgcaggctaagttaatatatgatagaaacaaagattttgaaattttagaggaaagagagatctgagtgatagattgtttttacccctgtcatcttgtagcattgctgtaattgggtttgattttccccattaaagtaatttcacatgacagttattttgtatagaaaaacttcccttttcatcttttctaagagtttgcataaggcactgtagcacccactacttttcgcttccgtatttttggattgtttggggaaaggggtgtgtgtgtgtgtgtgtgtgtgtgtgtgtgtgtgtgtgtgtgatgagtagttatccagccatgtttatgctttatgaccctgagtgaccacgttctttggaagcttacaaatatatgtagtcaaaggaaatttatcttagcattctttttttaaaaatatgcactatt

SEQ ID NO: 70088 - DNA, 1390 bp, Homo sapiens
ctgggctcaagcaattctcttaccttagcctcgaccttaactttaaaatgaggatttgctgggagaatgaggaaacttcacttttgaaacacccaagattctcaataaacagcgggagaagttttattgttgtcttaagaataaatcataatatgtataatttcgcttttgaagagttttttctttttcatttttagagatagactttctagatacaggtatgctaaatcatctttgtcttctttaaagcagcaacaacattacactttttataaaatcagctattttaggtaataagcattcaaccagttaatttctgatatgagataataatgcagctgtgttgaaatagtatttaaagatacagaattcccattaaattctcaatgacttgcaaattacttcatgtttaggcatttcatcttccctctctgtacaatgtggttttgcacatatcacatgaagttgtcatggagataaacagcttactctgggacatgtcttgatcctaccaggaccaaactgggtggaaatgttgataacttaattattgagttattgtggcctgagagaatttatacacctgttgaataacttcttttttaagcatcttattccctcttttcagggaaaaataaatcaagaccattgcctgggaagtatgttaacaaagtgcttgtatgcaatagacgtaaccctaatctgccttgttcatagcgttatattttctccattttgaaatattttacaaataaaaaaggcaaaatgtagtatattcaattcagtattactaagatcacactattataaattatagatttatattgaaagaataaaaatgaaagaatgagaatgttaattgcatgataatgttttacttacattctggttcaagagtttctgaaattgcatttgctaaaagatgacagagctacggttccaactttggcatacttaaaggtgggaatggaagtggttttttctcaggaatcctgataaattattgcttgttttgtcagctcattcttggttaatcaagaatattcctaatagatttttcgtaccttttcagctatgcaaaagggaaaatagaatgcccagtttgataataagtggaaaacagctggggtcagcactcaagattccagggaaataagcttagcaagagtaattaagacagtggttctcaaccctggctgcataaaagaatctcaggcatcagcatttttaatctccccaagtgaatccaagtcaaggttgagaaccactgatacaagaggaatcggaaagggaaactgagttaggagagtattttgatagtctaagttagaaataatcaagacttcagttagaaaattagcagtgagatatctagaagtagaaactacag

SEQ ID NO: 70089 - DNA, 1093 bp, Homo sapiens
catgcatcatatgaaggcaggaattgtattgctaatgtattcttagtgcttgaaacctggtgggctctcctaatattgatggtataatgtaatacaaggtgaaaagtcatataagtaaaatgcagtggtaattttgagaaaggagagattctaaacctggcacattgcctggatcataattatagacaaatatatgatgaattaatgcataacagttcggggagaggtgccatgccccagaaagctactttggttagcatgcagcaagaagttgaaatcatatcagatgcaaaatttagaattagcagcaaaggaaaaaatggtttttaaatctagaagactctaaattactcaaagccaagtccatgaaaatcggagaaaacggtaagggtcagaggagatgccctctggaatggtggtatacccaagccgatcatttattcgctgttttggttacaattggatctcacacaagagcagggtgttgcttatattcagatgtgtaccggtaatacatgtactgcagtgttctgttttaaatgtggcaagtgaaaggactctgaccatgtcatcttctgtctgtaggaatagataatctctatgagagggcgcttcacatccgcaaactcctcctgactttgcccaggtcggtccttatagtgatgaggtacctctttgccttcctcaatcagtaagtacctgaatgctctgacaaaaggcccatctgaattctgtctttgttcttcgatcctgtaaaatgtacgttgggttccatttatcagcagagtcaaagagaaaaatgattgaatatacattgaaaaatgtactgaaggtacatttttcctcagcagatcaacatcattgatagatgaaagccctaccccagatgtaaaaactgtggccacaaatgcaaagatatttaaatattactaaaaaaaaaccacaacttttcagtgagaagtgttattcagtgtttttcagactttcatccaaaactgtcatgaatgtttttgtcaaaatgatgtaaactggctgttcattgcggaaaatttctgcgactttttaatattgtagttgaggatggaagaaaatc

SEQ ID NO: 70090 - DNA, 2061 bp, Homo sapiens
aaaatgttgctctttttttatttttattttttttctttttctttagagacagggccttcctgtgttgcccagggttgtttcaaactcctggcctcaagcagtcctcctgcctcagcctcccaaaatgctgggattgcaggcgtgagccaccatgcccagcctgtgatgttgcttttgaaagtctctgagtcctgcctctgccaccatcctttcttttgggtttctttgtttctcacatggtttatttctttttcactgctgccttctcttaggtgtttccctgctttccccagtagccagaaaagccaggacaaagcccagccatctctcttcccaaacatgaatctcaccatcatgccatctgccttttacctcttgactataagagagctttgctgagtgctctgtgttttagataacattttgaccatgttcacctgattttttggaaagaaaaacattgcttacaaaggacagatattctcacccgcagccaacctccaaaatcctataactaaattaactagagtatcaattatcctttgattgccgaggtattgtattttttctctgtcatggatcactagagagagtagcttttgtttctgaaagacaggctatcacagaacaaaaccattctctgcaaggacagtgggtaacagatctaggaggaaaaatgtcagcaacagcaaggttccaaagagaaagtgtgatcacattttatataacattacaagaaatggaaatataagatttgacagcaccaggcagtcagggaatcagctgtgttgaattgtcttcccttttgcacaaaattatattacccatgcaggaaaactaagtgatcatgttgcactctcactattattgttattgatagcagcagtagcagcattctatgaagtctctgcaggaccttgaagtactgtgaggctttctatatgaaagaggcacagtgtaccatgccctgagattgatttgctctgcaatgaccagactaagatgtgtgtaaatagcttattgattgacacttgactgtgaaatggctctcacaggagtagaaagagtaaaaataatgaaattgctgagaattactagttgatgtactaggattgccaataaaatgttctgctgatttatctggtcatcctgtcataacctgaccacatttgaataaataagcagagtctgataatcctgttgcttgtttcaaaaaaataataaggccaggcccagtggcttacacgtgtaatctcagcactttgggaggccgaggtggacggatcacaaggtcaagagatcgagaccatcctggccaacatggtgaaaccccattgctactaaaaatacaaaaattattggggcatggtggcacgtgcctgcagtcccggctactcgagaggctgaggcatgagaatcgcttgaacccgggaggcagaggttgtggtgagccaagatcacgccactgcactccagcctgggaacagaacaagagtctgtctcaaaataaaataaaataataataagaggagatgatcatagaggtcgtgattgtgcaattataataaaatatgtatatatctgttgaatagttttaactatgttgaatggccagcattgacagtgtgtgattgaatgtcattaaagaatattaatggttctgtctttatttctgtaacataagtatatgtagactgtatactgtatcatgtgttggtatcttttaatttttgtaagtaaagccaaatacaaatatgtgggtgtgttcacacaggaatttgcaaattacatgtcctgaagttcttgtaaataaattagcatgccacgtctgtagtcctagctacttaggaagttaaggtgggaggatcacttgagcccaggagtttggggttacagtgagcaatgattgtgctactatatccggcatgggtgacaaaatgagaccctgtctcaaaaaaacaaaaactagcatgtcttcattcttccatggggtgtttatttctttttcataggaataactggggtacatatttgggtatctgtcatctcaagtcaaccagg

SEQ ID NO: 70091 - DNA, 1026 bp, Homo sapiens
ctcactgtgttgttcagactggtctccaactcctgggccacacagtgatcctcctgccttggcctcccaaagtgctgggattacaggcgagagccactgcacccagccactaaaagatttaaactgttgttttaaacattatccttacaactactttgttgggaagcctactgtgcagattatagtgttgtggttctgcaatacaaaatattattcgcctcaaacattatccactagagaccaggcacctataatcccagcactttgggaggccatggctggaggattgctatgttgcccagcagtttgagaccagccttggcaatgtagcaagaccctgtcactgtttaaaagaaaaaaaaaattatccaaagcaaaaagaaggggcatttttctttgtctttatttaaaatgtttggctgaaatttggccagggcctttatataataaggtgaagcctaagctttttaatatgtttgttggtttttatgctttcgccttctatgtcccagagaattttgaatatatcaaatgagaaagaagcccagctgtctgtccaagaatttctcatgcaatgattataagtacaatggctattgcagtaaacttttggaagaataaactcttttaaatgggaaggtttgctaccaaatagaagacaacttcccggggaatttttgagataggcaggttttaatctcttctgtgtacacgtattctagagtatttggaaatgaatgcatgcccagtttttagcaaatgatgtattgttcattgcataggcatattcctgtaagtatatgccccttgccttggcccctttttgtcctgtttattattgaagagaagtttactcacctttgttgattacaaggctaaggatgaggtatttgtgggagaggggagcaaagatcataaggcctcaaattgaggagcttcttgcagtaagataaatcacaaagaaacacctctttggttgctgagtctgtcctcctgtttgccttcaatatttgtggtcagaattag

SEQ ID NO: 70092 - DNA, 1023 bp, Homo sapiens
tataaaggtgtttttggttttattttttgctgatttcctttggaatcccttggttacagcagcagttatttataattggttcctggtcttaataattcacaatgtggtgcttattatttataacatatagtgtcaaccttgtcaagagtgctaagattttctttattctcctgggatcccagtagtctgttttcttgcatagagggaatatatgtgtatgtattcaattttctggtatgatctaaaagattagattcaaaggaaaatacaactctaaagcagaaacaaaaaatcatgacacagcaggaataaaaatagtgtttcataatttgtgtgctcttttgctttgaatacatctatgtgaaaggtaggctttttagttccagttggtgttatttgctaggttaattatgctctgaagtaaatctgaatcctcattgaattggggtgggtgagaattggtacatgggtaagcaaattgtacacaggtccattgctacagtaatgaattctatcaggtattcatttagcttattccttagggaaattatgaatcaaagtatttatgattatcataaagtatttatgataatcataaagtatttatgattatcataaagtatttatatctcaatcatagacagagaatatggtagatgaaaacttactgagctcaatgggtttggattctttgcttttgcatgttggtaggtgtttggtacttacggtttctccttcttacttgtcatgtgcttatgttgtttgcctaccagggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatggcagacttctatgagaagatgtacaccctcagcacacagaagttcatcaatgctgaagagctcgttgg

SEQ ID NO: 70093 - DNA, 1079 bp, Homo sapiens
aattctagtgacaaaagtattcctggaagaatgagcagaacacaggcatagctgtatagaatgtcacttcctcttttatcatagagaaagaagcttggacttcaacaaaattaagtgcatggtgccactctgtttcaggcatctgtgggctaatttgtgtagtcccatagagtctctatgaaagataaattgtctacgagcagttatggctctcccacaaccatttaaaaacttgtctttactatattttatgccataaactaatttaattccacaaatacttaactttggcatcaccgtgaggtgttgaatttggacttctaagaacataggaactggactctccattcaacttattatgacttgagggaggatcagagaaaaatctacttccaaagaaagagttcctaagccagattcgcctgtgttgggcagtggagataattactaggacattttattccaggttctgacagagccaaatgaccagctatttgacttcaagcaagtcaggccccctttccaggccacatctgtttcttcctgggcttcctctgctaggtggaagggtgggactagatgttctccaagttctcttccagctcttacattctctgcctgtgacaagacatttaacactctgaaatggagtagtgtgtttctctgctatctcggctcagtggatgattttgcactaacttcaagtaatcctcctttctttttacccaaagtttccctttcagctgtcaccagccatcaccccataaagtgtccaagtcttttccttcattacccaatgaggagtccacattttctaccctcaattttgggggcagagagagaggagcaaaatggtgtttttgagtgtcctggctgttagatgggggattattttcaagagacggtcaatcaaaggaatatgaaaagattcttggaacataggcaagtattacctcaaaccggacaaagaatgtactgatgaacccgcaggatgacaacgagaggatcaactcagctctgccttagcttctccgcagtgccctggatctgggctagtagtcatgcaggctctagtgagg

SEQ ID NO: 70094 - DNA, 1052 bp, Homo sapiens
aataaagaaatggctcttttgcccaatggcataaagatctttgcacacttataataaatcaaatttattttttaaaattttaaacttctcatagagaggtattgatggaacattcaattaaaatctttgtttataggactcagagatagccagatattaaacaaataaaaaaatgtttctcgtgaatatcaagttgactcttgattaacattttatactcttattaacattgcgtacattgtttgtttctattcaaccaatttcagaacttcatgaaaaagttgaatggtaggttgagtgatggggtaacacaatgggagccttttctgcaaggctggcatgtgaataaagtacctgcaaatcataaaaagaaacaaaatagagagttttaaaaacaagaattttcacattggtcacttgagtacattcacactcactggctagggttgttgggtgtgggaatctaagctacaagacttggtcagcattttcagatctccaatctcccccatttgtgacctagaaaatctctgacatgtggactgtccctccaatctcccccatttgtgacctagaaaatctctgacatgtggactgtcctcaccacagtatgagcagaggctcctgcttcttggtttatcaggcaatgcgcagtgaggtgttgaaatgaaagggtcaagctgtggtgactactagggccaagtcaagagggaagagtagaactcatcccccacggcctcagtaaaagcctaggaaaggccagaggaagaggcaaaaatgagaaagacttcaaccatccccttggatgacttaaaagaatggttctcaaccctgatgcacattggaatcacctggagagctttatctttaaaatctcacagccctggtaccacgccagacaaatggaaacagaatttctacgtgtgacacctggttatcagtatttttttaataggttgagtatctcttatccaaaatgattgcaatcagatgtgtttcggatttcagattttttcagattttggagtatctgcattatacttaatggttga

SEQ ID NO: 70095 - DNA, 1051 bp, Homo sapiens
tcttctgcctcagcctcctgggtagctgggattacaggcgcaggccaccatgcccagctaatttttgtatttttagtagagacggcgtttcaccgtgttggtcaggctggtctcgaactcctgacctcgtgatccgcccacctcggcctcccaaaatgctgggattacaggcgtgagccaccgtgcccagccagcaattttttttagatggagtttcgctctcgttgaccaggctggagtgcggtggcgccatctcagctcactgcaacctccgcctcccgggttcaagcgattctcctgcctcagcctcccgaatagctgggattgcaggcatgtgccaccacacccggctaatttttgtatttttagtagagacggggtttctccatgttggtcaggctggtctcgaactcccgacctcagttgatctgcgcccccctcccctcggccttccttagtgctgggattataggcgtgagccaccctgcctggccagcatttttttaaaaagccatagcaaattcaaggaagcttttattggacttctcaatcagggattcttagaaactccgaaatcgttttttctctctgtgggcatttttcaggggaatggacatcagattttcttaacatttagggggcgaagggaaccagtgcctttctttgtgtttttctgtcttttaaaaatgctgatctggtataagaatgccccaagtcgtttccattccacatgttcctacctctgactataaacaacgtattgagggctcactatgtgccagccatgctctgcataccttatctctttgaagcctttacaactttatgaggcatatggtctttttcccatgtcatagaaagggttctctcaggttttgtaagttgtccaagtggccccaattaaaaaatgacaagatggggatacaaacccaggtctttgaaatccaaaacctatgctctactatgtcctagggacatagtgatggatagtcaagacagtccttgccctttaagattgtgagaaatggccgggtggctcacacctgtaatc

SEQ ID NO: 70096 - DNA, 1051 bp, Homo sapiens
cactccaccctgggcaacagagtgagactgtctcaaaaaaaaaaaaaaaagattaatgagagaaaactagtaagctggcagtgacagcatagcagtgcttaggatggggcatgtaatccaatttgggagagttggacaatagaggtcaaagaagtgttcttgaaagagatggcttctaagttgaatttcaaaggacagcaggggttaacctactaacaagaagaaagagcagtgtgcaaagatgaaaggtagaataccactggagaactgccatatggttcactagcactggccttgctgacctggtgtgcagaatagtgaggagttattcaaaagtgtttggatcgtaatctgagggcagtagggagttacactgccttgaagtctgcaagtacgttatgaaccataagagaaagggctgagctgtcttcaaagctctcagtccatatcctgagttatttgattcaggcaggctcagaggaaaacagaaaagcctattgtaggtatcctgtaacctggacctgagcctggttttgctattcccaaaaggcctttctcccctacccctgctattcccaaaaggcttttctcccctacccccaatccaattagttttttggcgtctttggttaacggtaattgaaacaaaaagccccacagcctttttttgttttttttgagacagagtctcgttctgtcacccaggctggagtgcagtggcgtgatcccagctcactgcaacctccacctcctgggttcaagcgattctcctgcctcagcctcccaagtagctgggattacaggtgtgtgccaccatgctccactaatttttttgtatttttagtaggggattttaccatgttggccaggctggtcttgaactcctgacctcaagtgatccacctgcctcggcctcccaaagtgctgggattacaggcatgagccagcacgcctggccccccacagcgtttaatggaagtagtaagacttggtctccctaccttataggtcttgagagaataatatcatttttcacatcatttagagtttg

SEQ ID NO: 70097 - DNA, 1048 bp, Homo sapiens
cgggcggatcacgaggtcaggagatcaagaccatcctggctaacacggtgaaaccctgactctactaaaaatacaaaaaattagcccagcgcggtggcgggcgcctgtagtcccagctactcgggagggtgaggcaggagaatggcgtgaacctgggacacggagcttgcagtgagctgatacggtgccactgcactccagcctgggcaacagagtgagactccgtctcaaaaaaaaaaatcagatttttaggaattacacattagtggagtagttagcagagcccatttttctgagaattaggctctaacttttagttgtaatttagataagttccaaaataagtttttaaacatttaagcttctttgcatgattttatccatttacgttattcaggataagcatctatttgtttatcaagtaatgttttctttcaactttgttttttgtggcagatgtttataaattcttctgtgggatcagagggcacgcctattacaaccagaaaactacaagtataacagcgaggatggatgaacaggctctattagggctaaatccaaatgctgattcagactttagacaaagggtaagttactctgctgaatcattttttaatcatgtcaccacagattggcattagaggacttgaataaaaatgcacctggcaaaagtttactttgggtagaaatgaacagaaacaaaaaaatttgaggtatttgaatatattttgaatatagaaacagtgagtgttgtgatttattttctgtttacttggccaaacaaaagtattaaaatctcatatgattcaaggcagatctttatgcaacatcagtcattatttctaattatttaaaaattgtaatgcaaaggattcgtttaagagactttccatagcagcagacatgtgtattttattttctctttccttggcttgatctatacaagctgttttaacacttaccttaatgattttttttttattttaatttttttctagagatagggtttcaccatcttgcccaggctggtctcgaactcctgagc

SEQ ID NO: 70098 - DNA, 1321 bp, Homo sapiens
acaagattttttccttctgcagtgtggctttctatgaaatctttctaaagcattcaactaactttttacggaaataggaactctcttatactcacttcattggcagattgttggtctctagaagatctttgtcagtgtttatagctggctaactgcaactctgccactcccctagaaagacagttggaagtgggtaattggtgtgttgacttttgcccccatcttgtataagcaagggtaccatatttgtaatttagtgtcctgtacgaaactttgaagttggactgacagtccatgtggccctgcttgttttggatttggctacaatagaactactggggttgaattttaagcaggacttggacgaccatctttactttcactcagactctgtctgttctgccatttgtaattttacacctaacctgttattgtaaaatgaagggactgttccaggaatcttaatatctggaatttagagggatggtttgctgcttacaaagcattgtattcaaggtgcatcttaatatcttggttagtttgcttgtcagatttaatggaaattttaaatattgtgtaatatttagagttctcatagctttttaagtaaatggattttaatgtcataaaatgagaccagtaagtatgaaacaagccaaaggtctagtttgagaaacttttctgctgtattactcattactattttgcctttgatttgttttcctcagttcatattctgcttatctcattttctttttttctttttcagtgatgatcatgtgaagtttttctgctttcaagtactggaacatcaagttaaatacaagtaaggcttttcttactgttttgactcagatttgcggggagaggtcatttttttaatttaatgtttttcttccataaggaaaccataatacaggttgtaaattcacagtgtatatgttatatccaggttatagatacgttttgatgtaccccaaagtgttttaaaagtgctgagttggccaggtgaggtggctctcgcctgtaatccgagcactttgggaggctgaggccggtagatcacttgaagtcaggagtttgagactaaccagcctggccaacatggtgaaaccccgtctctacaaaaaatacagaaactagtcagatgtggtggcatgcacctgtaatcccagctactcaggagactgaggcacgagaattgcttgaacctgggaggcggaggttgcagtgagccgggatcacaccactgcactccagactgggtgacagcgagactccgtctcaaaaataaaaaaagtgctgagtttgttggttacac

SEQ ID NO: 70099 - DNA, 2557 bp, Homo sapiens
actgcaacctccgcctcctgggttcaagcgattctcccacctcagcctccctagtagctgggattataggcacatgccaccacgcctggctaatttttgtattttttgtagagattgggtttcgccaggctgtgctcaaactcctgacttcaggtgatccgcccgccttgccctcccaaagtgtggggattacaggcatgagccactgcgcccagcctaaattttttttaactaggcaaatactgtagtgacatacacgagttgattttcttttatgaatctgttgagaaaggtagtctcaatttaatactgctatatagtccctgagcaaggaagaagcattgcttaggagttgtccgtgttgctacttctgtattcttcatcacatagtgtaagtactatgttactatattgagaaataacttaaaatatgcttaagatttctaagcagtgctttttatagtttgtatttactaagaaattaactctgacactgaggagtagaacagaaagaggaaatacaaagaatcacaggatatgatcttagagctggtaaataggaaatactggtagggaatgtgttaacaagtctgaaagtttactctctgcaagtatattcagatatcaaacatgattttgtaaggtaatctactttgcatttggcgttttgtattttaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtaagtatgcctattatttttatagtataaacttgtaaaatacagtatctaaaactcatgactttgaaaatgttacaattttattgtcccattaccaggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggttggtaaatttatataaaacattgtatgtaaagttgttagaacaaactgggataggtactaagttaaatataataatagctttttttcttctaaatgttataaactccccttgagattataatataaaccactgcatctagccaaaatgttctcagtagcattctccttggagaatgggttataccagttcttaaacctgaaagcctgtaattgcacatttctcacaaactcttaggagatgctgacacaacttgttcatagtggaattgagattttttgttttgttttgttttttgagatggagtctcactctgttgcccaggctggagtgcagtggcacagtctcggctcactgcaacctccgtctcccgggttcaagtgattctcctgtctcagccttccgagtagctgagattacaggcgcatgccactacacccggcaaattttttacctttttggtagagacggggtttcaccatgttggccaggcttgtctcgaactcttgacctcaggtaatccacccacttcggccttccagagtgctgggattacaggcataagccaccgtgcccagcctggaattgttaaatatatgacgtcattttaaaattgaatcctgtaattagcacttgattcatattaaagttcagtttttcctcttagcttgggcaggcagttttaaacagagatgtgtcttgattgcttataggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacaggtaagtttttgttttattctttttgctcaatacataatacaaaggagccatggagaagtggaaaatatggaaaaattaaaaatgagaaaatacccataattctactacctaaagatatttactgttaaatactaatgtatttccatcttaaaaaaaaaagaattggccagaaaatagtttcaggttctaaattcagtagactaaccagcttcagaggtagttataggtttaggtttttttttttattttgaacctgtctttatttgtgaatacagttgaaattttcataagcatggtttgttattttaatttacatatacatcattcatttctcataaacaatttttttttcttttttgagacggagttttgctgttgttgcccaggctggagtgcaatggcgtgatgtcagctcaccacaacctccacctcccaggttcaagcgattttcctgcctcaacctcccaagtacctggg

SEQ ID NO: 70100 - DNA, 1049 bp, Homo sapiens
gtctcactctcttgcccaggctgtagtgcagtggtgtcatcacgactcattgcaacctccacctcctgggctatcctcccatctctacctcctgagtagccaggaccattggcagttgccacaatgctgggcttattttttgtagagatgggatctcaccacgttgcccaggctggttaaactcctgggctcaagcaatcttcctcggccttacaaagggctggaattacagacaggagccaccgcgcccagctgatttttcagtgtttaatgtttaaactttaggtgcccagttaataaaaatcaagggattttggcaattctgtaaatgcttttttcccccttcatttttcccattccacctgtaaatgatttttgacttgttaatgtatatgaaaagagaacttcaggttgctttcctagttaattttggaaattgcttaaactaaaggtttttctcctcaggtgcagagaatgtagaaagagtgttggttactgttatccaaggagcagttgaatatccagatccaattgcacagaaaacatgttttatcatcctctcaaagttggtagaactctggggtaagataattttatttcttaaccttcatttcccaaactctttcataaaactcttagacataatggaacatagccctaacagagagagaaactgggagttggttttccctggtgatgaattaattgacttacttttatatataagatgaaaatttgaattctcttgacaggaggtaaagatggaccagtgggatttgctgattttgtttataagcacattgtccccgcatgtttcctagcacctttaaaacaaacctttgacctggcagatgcacaaacagtattggtaagcacctaggaatctttgtttaccttgtgtagctcatatattcccaatttcttctttaatgccaggttgattatattatgtttcattgattttttttttaacttagtgatttcagatcagggttctttttttaaagatttatgataccttctggagtttttatgaattcttattgaat

SEQ ID NO: 70101 - DNA, 1053 bp, Homo sapiens
caacttgatcctccttgtatgatagtttccccaaatctaattttcacaatacttaatgtcaatttccgctttctcactttcccacaacctggtaaaagctagatttcataattgtaatttactacgttaaaacaacagtttgtatttttctgttttttttctttttttacttcaacccacttagtccatctgcctgttacctttccttcctctatcccttctctggagttaaatatttctctggaaatatttatttgaatttccctggcagtggccagggtagtaaagagaagagctggatcactaaacaagaattgaatatatagaaattcttaaacttgtttttcacaggctttatctgagtgtgcagtgacactgaaaacaattcatctcaaacgggtaagccttttagtccatgccccttcattttcatctcacatgtggtattattatcttgttcttgaaagatgtatcttgtgtaaaatttaacttttgttttgactttttggatgtggggaaaggggatgaatgaaagtagcagtatccatttattgtccttcatgttttgggtaacatgttttggtttgactaaggatgtgaaaaatcttagccagaatttcaagattcagttttcatgatcttgtaggcttcttcactaccagattttttattttatttttatttttatttatttttttgagactgagtttcacttttgttgcccaggctggagtgcagtggcatgatctcggctcacggcgacccctgcctcccagattcaagcaattctcctgcctcagcctcctgagtagctggaattacaggcacccgccaccatgcccggctgatttttatattgttagtagaaacagggtttcaccatgttggccagggtggtctcgaactcctaacctcaagtgatccgcctgccttgcttggcctcccaaagtgctgggattacaggcgtgagccactgcgcctggcctattttttatttatttacagggtctcactctgtcactcaggttggaatgcagtggtgcaatctggggt

SEQ ID NO: 70102 - DNA, 1052 bp, Homo sapiens
acagtgacttatgcctgtaattccagcttcttgggaggctgaggtgggagtgtcccttgagcctaggagttggaggctacagtgagctatgatcacaccactgtactccagcctagatgacagagcaagaccatctcttaaaaaaaaaaaaaaaattaaaaaaaaaaaactggatacgaattacaatggatttaatacaaatacatttgttctttttctccctcttttccccaccccccaggagttttgtcaagcgcttcagcagcctgatgctaaagtttttaaaaattacttaaaggtaggtatttgtgaagctcacgtatcttcatacaattaggtaatgtttgagagccaagagagaatacatacctgcaattatagatgtttatgtgaagtcccttttaactaagctcttgaaaaagagtataagttaggtaagcacactgaatgtgtacacctttgagtatattggtgagaaaatgccagttttcttttacagtttcatgatgtaattaaatagaaactagagggattaggagaataagaaatgttcaagaacagttgtccaaattaagttgaaaagaaggggctaaaaatataaaaacagaaggatgagatatttgcttatatcctattttgaaacatttgaactgtaaaacagacaaaaaggagaatcctcagatttgggccatcaagcctccttttacatttacgaaattactgatttttttttttaactctgtaaatcaacaaaaagtgtcacgtgtttatttggtattcatagttataattgagttcatgagatgaaactgtcttggtcttacctaggtagtcattcatttcatacataatgactgctttttatgtaccaagtactacagtaatggctgcaaatacaactatgagtaattttccctccccataaggagctcatgatctagaaataaagttacagtgtgacaaggtgaattattttttattatcttcactcaaataatttgaagacaaagcactgtattaaattcagtagcaggtaacttagtgtatcacct

SEQ ID NO: 70103 - DNA, 1028 bp, Homo sapiens
caggcgccgtgcccgtcctcaatatttaatttaccagtgttaatttggaaatagtaccaatcagtaaaaaggtgtcaagagcttgttttcttctgaccacttgatttctatagcatagagataacaccatattttcactacttccccagttgggtgatgtcagcataagttatatctacacttaccaaactctccagaacagaaagttcttagcttggattacatacggatatataaggcatgcgaaatgttctaatgttacagaagaacattgctagcactcagatacttggagccattcttcaggtgaaagtgatatcttctgacattagtattgattgcattaatactttatttacaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaaatcttccaagtcttttctggaattattataaatactttagttttattttctcatcttaatctctccataatttcccatttaaaggttt

SEQ ID NO: 70104 - DNA, 2244 bp, Homo sapiens
tatgtgtttattatgtttgtaaatggtaactgacatttaattattagaagtacttacccctgccttcctccatttttattcatggctacttgagaaagcaaaaggaaaaaataatagttatcagtagtgtcactggaaagaagagaggagggacaaaactgagcagcagaattcgtatagacatttacgtttaaattctaaaagcccaattgagatgttcagggagggtttgttttgccctttggcctcatgaatgggtttcatgaatgggcttcagtggcttataaactctgtaaaattctattctaaattttgtacatttattttgttccggttaattccagaagacatttcaaacatttttcttacaccatataataaaaatacttaactaaattgacagttataaaaataaatcagtgaaatgtaccttatactttaataaaaaatgttttcagaaatagataagtgaaagctgagtgtttctttgataggttcccctgtactataggagtgataattgcagctattgcaatagtagtaattgttaaatggatactaatgaatagcatagcatagtgggtaagagtttatatagcacaggctctagaatcagattaagtaggttcaaataccagttctgccagtaactggttttagaaccttgggcaagttaaagaatgtctcccagcctcagtttccctatttgtaaaatggaaataatggtagctacctcaaacctcattacgaattcaatgagttaaacttgaaaagacttattacagtagctggcacataaagacttgatagtagtttatatggatgctatctcatattagcatatatggaattaatagtgtatcactatactttttttttcttttttttttttgaatagagatcagtctatcacccaggctggagtgcagtggtgacatcatagctcactgtaacttctcccatactctaccaatcctcctgcctcagcatccagactagctgtgattacaggtgtgcaccaccacacccagctacatttttttttggtagagacagggtctcactatgttacccagtctggtctcaaactcccggcctcaagcaatcctcccactggcctcacaatgttgggattacaggtataagccactgcacacggccttactatgctatcaattccatatatggaaaggtgttttccctttcagagctctttaaagctctgcagaagatttacatgtgtttatagagctaagagaaatcagggcatggaaattgagtgtgtaataaaaattaaactcttcatgttatataatcatgcataacttctatcttcattctctgaagttgcctagagcaccatcacagctaggaagcttccatcatgaattaccttatttccaaaagcaagtactcaaataattgtctcaagagaggaaggacaaaactgttacaagctgaaatatttggggatttgtttgacttgactagggaaccacaagttttcatataatgcctgatttagccctgtgcctaacagtttaaatcttaatgctaatgttaattgcttcccagttggttgaccttataagaaaacactgtgtggtattttaatgtggtaaacatgtgaatgaaggcctgtggctcagttaatcactcccacaactttgagctgtgagttttactggtggaaggaactttaacaggtcttcgctcttgtcattagatatcaaagaactgaaattagttggaattgtaagcagtgaatagatgtgttgttagaatgattccatcacttatacattgtttaaaatgctaataaagtaacttgctttgtaagaattcattagagtggacttttgttatctccattgtgcatttgataaaactgaggcttagagaggtaagagattagcttttaagtcagtaattggcagccgagacagcaaccctaggtctgttacattcaaaagcctctgagccactccgcatgacttcccattcattcgtgtttgctgctgctactctgggaaacaccatcttcctcttcccctccactcagaaatttagccctagattagcagcggtctctgctccctcatgttgagaaaggcctgttgtgctgtccgtgggcagaagggaccccttcagaaagctattccttattgggaatagcggcttgagattttgactgcacgaatattgcaggacctaattttagtatttaagttttagttcttaaat

SEQ ID NO: 70105 - DNA, 1052 bp, Homo sapiens
cttgagactaccagtcagttctgtcagtgacgatgagataagcgtacatgggggaggggctgtttcctctggggagagaatattgactataaacaccctttatggctcatagagaatgaatcagaagtaccatacagacaacttttagctttcctccccctgtatctagaattatccacaagctctggattcttattcagattacttgcgatcaatcctgggtactccgtcctagaaattgcttttgttttatgccaaggagaaaatgactagtgcctcagaatttagcattgagaacacgtctgatcatcttatcttcctgtagtccaaattaacaaacttttaataatcacttggtatgtgtcaggcactatggcagacctagtgaatattactatagctaatgtgcggttagctatactgcacattaactggacacagtttcgagtttagtagcaagattgattagaaaggaagtaaagtggaagctgatgggatgagagatagtcaatagtgatagagactggatgagacatattgaaagggcctggcactagaagatacgtcacatatcctgctcctctttccttacttagatactcagtgttcttcatgtaagtgactacacatagtatgcactctgtaaatgtttgctgaatgaaagaataagtgaatgaatgaggactgattagactaccccaagacaacctaaagttctccaaaggaaacaaatatgtactttacccattatagtgtggaaatctaaaatgagaatttcagaagtataagaattaattaaaagattgtgaagtcgagcatggtggctcacgcctgtaatcccagcactttcggaggccaaggcaggtaggttgcttgtgcccaggagttttgagaccagcctgggcaacatggcaaaaccctgtctctactaaacacacacacacacacacacacacacacacacacatacacacacgaaaaagattgccaaggcccagtctagtatttagtccccaacagttttcctagggatgtgctttgagaaaccatat

SEQ ID NO: 70106 - DNA, 1117 bp, Homo sapiens
cagtggctcatgcctgtaatcccagtactttgaaaggccaaggctcttaaggtcctcaaggatcacttgagatcaggagttcaagaccagcctggccaacatggtgaaaccctgtctctactaaaaatacaaaaattagctaggcatcatggcaagcacttgtagtcccagctactcaggaggctgatgcaggagaatcactcgaacccgggaagcagaggttgcagtgagccgagatcaagccactgcactccaccccatctcaaaaaaaagagaaaaaaataaaacggacacagattcaggtaggttgtatttggtaaagggcataagggagtgctggtctgattccttccatttccacattaaattatgaagcagggtcatcaaaactgaggatcaaaggaggtggtggaggtttgaggagggaggggaagatgtgaaatagtcttttcagattgggaaagtgaagttattaggaaaacaaaatagaatttctaagcattattgagtatccatttgtttgtataatgaaatgggtcacaggttcatgatttttttcttttttttttaatcttagcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtaagtggtttcccgatctaaaatcagagaagcatttaaaaaatgatttctgtcttggttcatcttattgttagtggtttatgctaataaaaattgatttaacaatcatttctgatattttaagctacctggtttttaaaaagaatgcagccttataaaagtttgcataattttatgtttaagatatttatgtttaaatatcttatatacacagtataaatggtattcagtctttggcccatcattaaaaatgtactgctttctagactttatttcagcacactgtttatttcactctgcatacttgtcagcactttcctcccatacaactgaaaaaaaatacatagttctgtggagtattagaatcattaccagatct

SEQ ID NO: 70107 - DNA, 1482 bp, Homo sapiens
acaaattcagatggtacaatgactttttctataacttgggtatttaagtgttttccagcaaggacagtgtacatatttatgggaagaagacacctatttaactgtactgatgattttggcatagcatcctattgagcctgctttatgtcattgcccttttaatgaaatctcttcattaataaaaactgataatttgtgtttttctcattacacataaattgtgcctaacagttaatcatacttttttcatcatagatagtatcagcctttaaagcaatgtcagcatttcttgctgccctaaaaatggtttaaataaaagtgtgtgctgctcactaataaaggaaacatgtgactcataagcagctaggaatacctgatgattttatctgacacccttgtgggcagatataccattagaagaattttattttattagcacagaaactcaactttttatgaacattgatgctaaagaatgttcagaggtgattgaagtactcagtaataataattgttttactttactaatgaaagatatattcatccaacattatagtagtgctgattcctcagcatctcatttgcatgttatgaatgtacttatatgtggatcttatcaaaattaaacttttttaaaacttgtaagcattcccctaagacttttgccatttattctattcacttctcttttgcattaatcccacacatgtgcacttacttcttagatagttgtcacatgaacacaccttatttttcacgttaatttcctctttgaaaaatctcttaaggcagaaatcctggctgccactgctgaggaagcagcaaatggtctaaatcagttgtggtggtttgttctattttttaaaaaaataattaatttgctcaaagcacatttactttaatgttaaacaaatgtgctttttccaaaatgtgcaaatgtgtgttttccagtgtgcaaagaatctgatactgtgctctatatagtataatcttttttgttttaaagaatactattcattctgcagaaactttagttgtgcctttggataatatgggtaagagggattatatgctttttttcatggtctagagacattctgtgacacaacttattttgtgtttgctcagttttttcagatggaaaaattaatatatttgttgtgaacatcaagatgctgttataaagcactgtgagatctcaaatgaaaattaattatggcatatataaataaccgtacaaccactattgtacttcagtcagtcagattcaaagtattttgattgttttatggatcctgtgagcatcaatcacaaagtttcatctagtagataattgtaggtgcaattgaggaaatacttttgcaaagcccattaataagtcatgcaaaaatgaactgcttattttattctgcttttgttcctcccaaggtataaaataattacaggaaagccttctggtgcaatatctggagtacagaaagc

SEQ ID NO: 70108 - DNA, 1072 bp, Homo sapiens
cttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatacgtaagtatctctattttcttcttgtatcaacatgttctgttatataatattttcctaagttaggaaaagaaatagaaaagatgcctcagcttcaccaaaagtacccatttcccacatggaaaattatatttaagtgcttagtaaattccttttcacttatttttggagtaaaaggattgataattctaaaatttatagttaaattagcttgtttcttaaactgtaagttttacaaaagtactttcattgctgtgccttctttcaagttacataatcacataaccacaaatggcatctaccaataaaccagccaggttttgctaagtgtactatcctgccatgttaaaatatcaaagcctaagtcttcattgttagcatggttatttgcctatgataaccctatgcagataatatggttactattaaccataataatggttaaagcacctggctccggaaaaataatcagtgtttgttttatgtaaacaaaaacacattacacccatgtgattaaaaaaaactacccatgtgataaaactgcatataaagttttggtcaatgatggaccatatatacaacactggttccgtaagattataatatcatatttttactgtaccttttctatgtttagacatgttcagatatacaaatactgtttctaattatgttacagctgcctgcagtattaagtacagtagcatgctgtacaggttcgtagcctaggagcagtaggctagctaccctatatagcctaggtgtgtagaaggctataccatgtagttttctgtaaatatactctgtgatgttcacacaatgatgcagtttttagaactattcccatcattaagcaatgcatgactgtacacatacatatacttgcatgtaaaactggg

SEQ ID NO: 70109 - DNA, 1867 bp, Homo sapiens
cagctgggtgtggtggtgcatgtttgtaatcccagctactcaggaggctgaggcacgagaatcgcttgaatccaggaggcggaggctgcagtgagtcaagatcgtgccactgcactccatcctgggcaacagagcgaaactctgtctcacatacacacacacacacacacacacacacacacacacacacagaggaaagaaaatattaagaatcctgtatattacacaggtatccaaacataaaaatactttagaattgcttactgtatggacaggttatatggaatggagtttgtagtatccacattaacaaagcaagtttatatggactggttatgatattagggatatgaattagaaatggatgttgttgcactcatttaaaatattttgcctctcactttatccccagttatagtgtccttttgaatttttctcacacagtgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaagtaagttgggatttttcttgtcgttcttactagccattagaaaaatacagccagcctgggcaacatagtgagaccttgtctctacaaaaaaataaaacaaaaattagtggggcatggtggcttgcacctgtagtcccagctgcatgggaggctgaggtaggaggatcacttgagcccaagaggcagaggttgcagtaagccgagattgcaccactgcactccagcctgggagacagtgtgggaccctgtctcaaaaacaaaaaaatccacaaagtctgtcattgtagaaatgattgtcatccttataaagctgatgataatattagtgtagagctttcataaatattaaaattttataaattactatagttgaaagagagtaattgtaaaattgaaaaagccttgtagacatgatttgacttcaaatattttgtttcctaaaacgataaaatcgtttgtcatacgtttcactgtaactctctttaaaaagtgttttgctaacactcaaaattaccttttatatcataaatttcagcaaatattttttgtgtgcagtatgtatagaacattgtgccaagctttagagtctaagaaaaattagatctgcatttttagaatcttttaaattactcattctactggtagaaaaaaaaatggatcacccagaattttacagttctatttgaaggttgggatttgatgtagatttaaagagaagcattggactcattgtgttggtgtatatttaaggaaaaaatgaaactccttagaaatatttgaggtaatttgttagagaatgagcattattgtttgaagtggtgtttttttaatcacgaaaactacattacagattttgccactaatgtttaatttagacattgtgtttgctctataaaggataaagtgattttttcaaaaagttttctttctcattttattttacttcatatttcagtttccctccctaaagtacatccacgttatgatttagacggggatgctagcatggctaaggttagtatttaatttaattactatgtaaacatctgaatttaatgtatcctatcaatagtggaagcaataacatgtattgtgtcttcatgtatgtctatatgacttaggaaattattcacttaaattgataccctttccaagtgattttgtggtctttcttttttactttttatcctttcttgaattcattatataagaaaattctctccatt

SEQ ID NO: 70110 - DNA, 1043 bp, Homo sapiens
tcaggaaggcatcaggtttttttgtttttttggtttttttttttttgagagagagtctcactctgtcatctaggctggagtgcagtgatgcaatcactgctcactgcaacctccgcctcccaggttcaagcgattctcctgcctcagcctcccaagtaactgggactacaggtgcatgccaccacgcccggcttattttttttttttttgtatttttagtagagatggggttttaccatgttagccaggatggtctccatctcctaacttcgtgatcttcccaccttgacctcccaaggtgctggaattacaggcgtgagccactgcacctggccggcatcaggttttttttttaacaatctgctggcttatagactttgaatcaattttttatttttaaatggttatgatgaaagctgaaattattatttataaaacatctttttaaaactatgtattgattatactcatttaattttctcttttgacttttcatacagatatgaaaagttgatgaagatcaacctggaagcggcagagttaggtgaaatttcagacatacacaccaaattgttgagagtaagtgtttacaaaattacgaaatttgtaagctcataacctattcctttgctggcactattagatttaaactttcttaggagctaggcatggtagtacacacctagagtcgcaactactcaggaggccgaggcaggaggatcacttgagctgaggcattaaaagctgcaacgagttatgatggtgccactgcaccctagcctgggcaactgcacgaaatcttgtctgtaaaataaataatttaaataaataaactttcttatagagatgatatttctcactgcagagaaagaatttttcccatctttagaaacttctttacaatattaaataatcttactgccttgaaattttttgtaacatattcaaatgactactgtaatttaaacctctctcgctgcctctctctctctcggtgtttaaatccataatgctcttgtgttcttgctgtggcagttaaagca

SEQ ID NO: 70111 - DNA, 1026 bp, Homo sapiens
atttcttaccctgcccgtcttatgggttgttgtactaattaaatgagataaataaaaatactgtactcttggctgggtgtggtggctcacacctctaatcccagcactttgggaggctgagtcggatggatcacttgagtccaggaattcaagaccagcctgggcaacatgatgaaaccccatctctacaaaaaatacaaaaaaattagccaggcatggtggtgcatgcctgtggtcccagctacttgggaggctgagacaggaggatcacttgaaccgaggaggcgaacgttacagtgagccgagatcgtgccacttgcactccagcctgggtgacagagccgagactgtctcaaataaataaataaataaatatattgtaatcttgcaagcttttagtattcgaagtattctttcataaaatggatgttaaattaaaagtgaaaggaacttgatacgatatccttttcactttccagcttaggctgatgtttgtttcttttcctcagttttagatctcaaacagtggttttcaaaatatgagtaatgaacaactagtaggttatgaagttgggtgccttgtaatcagcaatgtatttttcagtggaacagaatagaaaatgtcagaatgtgtcacatataataaggaaatcattgtttatgaaactttgattcaggtatatacacactttaaatgttactgagttaaaacagtgagtttcttactatgagttgtggtcaggaaagtttgaaaaccatagctatagaataaggtgattaaaagtcagaaagcacaaaatagtcttccccagtatttgtctgcatttaaatataggcagccatattgctgtcagtgttttatattcttctctgttttcaccttagaacatgatttacctgctcataggcctagtggacatttatttccagggccagcatcgtttgagcactttaaatcaaaattaatatattttcttttggggatctcaaaatgtttctcatttttatgacattcctgtgagatta

SEQ ID NO: 70112 - DNA, 1054 bp, Homo sapiens
gctccggccaacaagtgagtggcgcgcggcgggcgctgcagcccgcgccccagagttccggggaacccgccagcccgcgccccctgcctccacgtgtctctgcggggcgctcgggggatgctcgccgggaaggaggagcgggccgagaagtggcttctgccttttcgggtcccgggaacgtgcctggagcttgtgcgtgtaggcgagggaaggcggaggaagggcggggaggctgagggccggcttctgccttccgcgccagatggcctctgcagctccgcctcgggctgccgcctgcggggagcagccccggagccagcaggcgtccccgggccactcccccaggtttccccttcgcgtccccgctgggtcgacggtcgggttcgcgcgcctgtccttcctgttagtcagcttactcatctgtggcccccagagtggcttgggtcaacgtgtaatagctaggggtggccgggtgacctgacctcccctcttcctggcccgggcgacctggtggagtgggggtccaagggcaccgtgggcctcgccaccataggctctcactaaatctccgttgcgggactcagggttgtgcgttttctgtaaagctaggttttttggtgcccagatgttttgcaaacaagctcctatgctaaatactagccagcgacagctaaccttttcgccggtttcttccttttttggaggcagcatgccgtgggaagcacgagttgggaaaagatgggaagggaacttgtgccagtttcgccagctgtagccgtgttttttgggaggccttcccgaaacggggcacgtcggctggactgaggagcccggtgctagagcccgcggcctcctggcactaggagccgcaccaggggagccgggccaacccggccacgctcacatcagattacagaagattgtaatggcacaaatttgttgcttttagaaaacaggcgttcgccaaacatttctattaataccggactgagacctagagactagaagcaagaagaatcgttcaggggccggatgataacttcttttggtggat

SEQ ID NO: 70113 - DNA, 1058 bp, Homo sapiens
cagtttttttctaggtttatatgcatttagcgtttctttttttttttttttttttgagatggagtctcactgtgttacccaggctggagtgcagtcgtgtgatctcactgcaacctcagcttccctggttcaagcgattcccttgcctcagcttcccgagtagctgagattacaggcatgcaccaccacatctggctcatttttgtatttttagtagagatgggatttaaccatgttggccaggctggtctcgaactcctggcctcaggtaatctgcccgccttggcctcccaaagtgcagggattacagatgtgagccaccgcccccggcacatttattgtttctatgttgtatgcaatcatttatgtatcatctagcatatatattatactcagggtagtattatttagcatttagaattagtctaacattaatatgtattttgaaatatcgtgttggaaatcaggacaggaagacatagttcgtggttgaagagcttcatatgtgtatttgaagctttattgcctgcatatttttcccttctaacataacacatgtaaggtgctgagttgtagaagttatttgccaggcagagaaagtgttctaaactacgaattttagtgagcattgtggtttatttaaagaagtgatatgaatgttttaaattcctggtaagattggtgaattagggaagtaaaacatcataaatataaagcaaaacactcttaatgtagaatgttccttttatctaacgttagataagcctttttcttcattttcatgctgatgattataagaataagataagcacttctgacatacatcatagtagtgaaatttatcctttctctagagagatggaaagagaggtattgctagaaggatctattagagatacagtgattttttttttttttggatgctgtaccacctggtggaaaagtgagaaaaatgaggtttctagatttcttgaaaatatccggagaaaacaagatgtttgtggtaaatgcagaatggggagaaaggggtgagggagcgggtggactggaaatttctt

SEQ ID NO: 70114 - DNA, 1075 bp, Homo sapiens
ccctaaaacttaaagtataataataaaaaaaaagaaagaatgtaaaatatgataattaaaaaattgcaattacatgttgaaatgataatattcgataatatttgagttaagtaaatttaatgttacttattttttagcatggctatggaaaacttaaaattatgcatgtggctcgcatgatatttttgttgaacaatgctgtttgctgaagcagggctggcagcccttgccagaggtttgaatctccattgtcttggtggctgcagatggatggatgtgggggtaccagcctggtgtgttgggaagatttttctttgtgaaggggaacttgccctttactgttggggatagtttcttctcagcctatccagggacacacataccagcattttggggttgtgaaacttttgtgtggggaacttcccttttttttttccacatgagccaataagataaaactgacctaatggcattctcggtgcaactctgccttcagtttaaggacagaagagggctcatgtttcatagagtattaaaggagcaagcttaatattttgcattttgtggactgtaattgctaactgctgctacatgattcagtcagctaagaataatttactaattatatattgcctcacttggttctttttccagatgctaaacaaggtgagataattagaggaggaaaaagggtgagtttgggaattggagaccagaaggatggatttagaagatcttggagttaacggacttagaatatagtcagcaaagagttcacttaaaattagtgcaggttgccaggcgtggtggctcacgcctgtaatcccagcacattgggaggccaaggcgggcggatcacgaggtcgggagttcaagactaacctggccaatatagtgaaaccccgtctctactaaaaatacaaaaattaggcaggcatggtggtgcatgcctgtactcccagctactcggtaggctgagacaggagaatcgcttgaacctgggaggtggaggttgtggtgagccgagattgcgccactgcactccagcttgggcaacagagtgagactttatatc

SEQ ID NO: 70115 - DNA, 1327 bp, Homo sapiens
atgattgatagattatgagccctccttaatccccaatttcttaattcaaacaagcttactgtgaaaattttcttttttctttctttttttttttgagatggagtcttgctctgttgcccaggctgtagtacagtggcacgatcttggctcactgcaacctccatctcctgagttcaagtgattcttcagtctcagcctccccagtagctgggaatacaggcgcataccaccatgcccagctaatttttgtatttttagtagagacggggtttcaccatgttggtcaggctggtctcgaacccctgacctcaggtgatccgcctgcctcggcctccctgagtgctgagattataagcatgagccaccgcgcccggccaccgtgaaaattttctacaaatgcttgtttcgaggaatcttttttgatattttgccagcaaagtcataggagcaaaatttttttaaatgaaaatagaaaacaacatagttaaatatatcacgtaggaggaaaagtaccagtaccaaaattaactttagcatttcttagtgttttacagttaacagggcattccaagggaattaaaattcagttgattttattggactttaatttcagaggaactctgagatgagaaatttaactagcacgtttatccgtttaggccttaagcagatgcaggtttcatgacatgccagaggtaaatttaggggtacttgactgtagtgagtaatttcccagctatgggaaaatgtaaatattatgtagatggtataaagaaacaatattacgtttgtccatttaaggtctgtttctgtttgttcagacaggcttgtggattgcttttcttgccagtgttcctttaggtggaaggtacagccctttcagatatttcagaattttattttcttttatttttttgagatggagtctcactctgtcacccaggctggagtgcagtggcacgatctcggctcactgcagcttctgcttcccaggttcaagaaattctcatgcctcagcttcccgagtagctgggattgccagcacccgccaccatgcctggctaatttttatttttatttttttagtagagagagagtttcaccgtgttggccagactggcctcaaacttctggcctcaaccgatctgcccgcctctgcctcccaaagtgttgggattacaggggtgagccaccatgtccggccatatttctgttttagaattgctttcttgcttttcctctgaccagatttggtcacgtgaaactgtcaattagcatgaatgaggtgctgctgccatgcaggggtttgatccttggctgtcatgtt

SEQ ID NO: 70116 - DNA, 1071 bp, Homo sapiens
atttgaagggaactaatagtccagccaaagagcgaaaaatggcaggaaattggaaattaggtctgtctcattggctttattaaccaaaatgaattgggaatctcaatgtaattgatcaggaaggagctccagtcattcctggaggattaatttattattattattattattttttagctgcataccatatcactgtggtgcctttgtttttggaatggagctgttgcctgctgaccacgcctgggggcacctaatcacaagtctttcccaacttctttttcctttaaagcaagccactccagttgaaagagaatgattagacatatgaaagtgtggttttgtttgcccaagagtttatgtataagttaacacattgtacacttttttttttttttaaacttcctctttctctcttatctgcctctgatcacgggatcctggttagttttgctcagggcagctcgcttgacctggtgacaaattccgcttcttcctggggctttcctttttcctccagaaagtcttgtgctcatggtttaggaacttagtcactgtcgtctttctggttttcatgagatcaaatcaaataaggtaatacgtgcaaactgtataacgtgctgcaaaggcagactctgctgctgtccttagagtccagttccctggccgtggctgggttcccagccctctgttctctctccacagagtgactgtctcggctctgagggtttcagcgatactggatgcttccacatttaggaaataggcctgcttatgctccagtgcaggcattaaagctcaatgagtcatgtgatctgcttggccgactcttcagagttcgtttgtactcagtaaaattagtatgagtcttggaacccggtgggaaacctcttcctagtcctacaggccggatgcgccttctgagttttcatattatctctccacccccaacctccccctcctttggttgtatgtttctcacaatgaattggttgttggaaactggctttgtaataattccaaatgccactgtgaagatttttaatagcctttaaaatttttaattggctgagc

SEQ ID NO: 70117 - DNA, 1312 bp, Homo sapiens
aggcatgagccaccatgcctggccgtagttttttcataatattcattttccttgaaatttttgatgacccctcgtatctgtattcctgttttatagtatcacacatttattacgtgcctgtctaatacccattgctgtggttttctctgggaattcaaagaggagtaagctagtagctctgccttctagcacatgggctagtggaaagtcataaagagccatttaatgaccactgtcaatgtctgtgtaagggcagtgaagagcacgctgctgttgataaggatggctcacatttatggtacacttgcaataccttttacccatactgattcatctcattctcacaccaactctgtgatgtggtacagttattagaagaggcacagagaggttaaatagtagctggtaattagattaaccaacgttagaaactgggtggtctggtgtgagagcacaggcttttaaaaagcggtaagaagaggggaagctgcagcctagttagggtgactgttgtgttattgaagatgaggggatgaggactttgtgcatgtgtgtggagcctgggctgtgagggtcaagggacaatgggaagggacattaaaaggttatggttaaagtaagcctagacggactagtttgaagtcaaatagtagaaggtgaggatagagagggggatgggaaccagattatgaaaataggcagtatctcttttttatgtcaagtgttaccctgaaattccgaaactatatttcttatgaacatactgattacattcattgttatttaaaaatatgcatgtacaatatgggtggaaatgataatgattgtaatgagagtggctcacaattccaaagaagttgggggtttctgtgggtttattataacttacggttttttttttttctgatatggagtctcactctgttgcccaggttagagtgcagtggtgcgatctctgcttacttcaacccccgcttgccaggttcaagcaatcctccccgctcagcctcccaaggctcccattgcaagcatgcaccaccacgcctggctaatttttatatttttattagagacagggttttgccatgttgccaggctggtcttggattcccgacctcaggctatctgtccaccttggcctcccaaattgctgggattacaggcatgagccactgcacctggccagtttattataatttaaaaagcagtctgttattagtaggcttcggaaatttgtttcagggagtggtaaggaaggagttctagaaagtggttgtatattgctgcatgcttgttttcctctcagatcaca

SEQ ID NO: 70118 - DNA, 1051 bp, Homo sapiens
cccgtgttgaaatgggactccctggttgtttctggggcatggtgtctgtggaagaaggtggattctggatcttgcctggctgggaatgagggctccagcagcaaggcttagggtttgaaggggaaatagtgtgtgtgttttaaggggctcagggggagatgtctttggatatacatgaagagtgcttagaatagtgctaagcactcaataaattttagctattaacatatataatgtactgtgccttttgttataaaacgcagacctttaaatagaaactagaagggccacgttcttggaaaaaatgttcagtgttagaagcagtaattatgtattaataattatgtaagtgccaaatttggagcatgcacataatgttgatctctctctacccctcaccctttcattcccttaggccattttggaggaatacattttaaggcgggaacctcggatgtgttacgtaacaaaggccttcttgtgttactgtctagtggatcagtaggcaaaaggaagaaacacattctcaaagcatggtcagattccttaaaatgtacttagataagggggaaaagggtaagaaatctagtaaaggtgtggtgcatgctaattgatggggaagacaaaaaaagaatataatgatttccgaaactctgaccatatctaggttagtgacaaaatttgagtttgggaaaaatatacatatcagggatgcaagcttattctatgcagtttacacctgcaattgttattgttatttttttttttttgagatgaagtcttgctctgtcacccaggctggagtgcagtggtgtaatctccgcttcccaggttccagtgatcctcccacctcaacctcccgagtagctgggactacaggcacatgccaccatgcccggctaatttttgtatttttactagagatggggtttcaccatgttagccaggctggccttgaactcctgacctcaggtgatctgcccacctcggcctctcaaagtgctgggattacaggtgtgagccaccacccccggccatcctgcaatttctt

SEQ ID NO: 70119 - DNA, 1021 bp, Homo sapiens
agtggatttggatgtgcgtggctcggagtcctctaataatctttcctttcttacatagctcacctagaatttgaggaaaattaaaccagttgtgaaatatatcacgtttcagaaatgaacggcatcttaattgattccctttgagaacacatcagactgggatttctgagtgtaatctggtatgccttgaggtggggacctcatgctggggcactcagaggagactggtccacctccaagtttgttttctggctccaaacaaatgagtggctgtttgactgttggcacactacccagttttaaaagtacaaccatatagggtatggagggctggtaaccagggggtttaaaaagtgaggtcatggaaggcccagatgaagctcttttaatgtgtatcacaactgcaattaatcttattaacatgctgggcctgttcctgctttcgctgccccaggtgtgtgagagtatttagggggcatgctttgaaggattcttgttctttgatgatgcacatggataacagaagtacatcaaactttgtatctggcattaaaagggcttttgtttgcctctgtagattcattcagttttgagaagagagcaaaaagcttcatgccaattgataagatgtacaaaagagggtggattgcaaatgcagtcttgcagcagtgagctctatgaccagatcagaatcagctgaacaggaatggagccctcttctatatccaacactaaggtagttccagcacagtattctgggagtgaaagatgtaaaaaagcagccaggcacagtggcttatgcctgtaatcccaacactttgggaggccgaggtaggaggatcgcttgagcctgggaggcggaggttgcagtgagccgatgtggccccactgcacctcagcctgggcgacagagtgagaccctgtctcaaacaaacaaaagtgtaaaagcactgttgtgtatttgggaagcaaaagtatgcacaggaaacaacaaggcatagaaggtgttgtggatcctaaa

SEQ ID NO: 70120 - DNA, 1134 bp, Homo sapiens
ctgagtagctaggattacaggtgtgccaccacacccagctaatttttgtattttttgtagagatggggtttcaccatgttggccaggttggtctcgaactcctgacctcgtgatccacccaccttggcctcccaaagtgttgggattacgggcgtgagccaccgctcccagcctgaacagtcactcttaattgcactatgtttatttgggcattttgttatgtttttatgtttttaattttgatataatttcacagttatagaaaaattaaccaaaagagtataaacaattctcagaccctttactgagatttgttgggacatattcttagaaagtctgagttgtgagcctgtgggattgggccgcacttcttgagtagagcctgggtcatgctacccgagaactcctgggtgcctgtgaggttgggtgtgtcccatctgagaaagttcgctactgaaaaacagtgacgtaaccccacccaggaactgaagtgagcctgagagcagctctccagggcttgctggctggaaacaatgagggaagagtctaggatttatgaaatatttttttgtggaagaactcttcctctgagaaactgctggagggtttggggaatacaaaacaaaactgacttatgaaaagatgacttgtaactcaccaagcagacgctctcaggcgtggcatgatgccctcactggctgccaagaacaataactgacacattatccacagacggctgcgccccatgccatttcctctcctgccatcacaatgaaagaccagggttgacacttggtattgtatctattccacgtccgctgcaccattttcttttaacccttctttcttgctctcacccctttacctgttggagctactatgcccctcctgggtttcgttttcttctcttcctttttcctgggcatacagctgcgttcctagaaattgtggttctgattcataatcattgtatgtggaggaaggggcaggattctactctgtgaggggacgggagggtcttttttaaaggggtaaacaattggaaagtttttagagttaagggtctttctctgatgctaaatgaaaccactgtcctctgttccaaggcctgagcttatatcttctttgctatga

SEQ ID NO: 70121 - DNA, 1033 bp, Homo sapiens
agcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgcttggaagcatgaactctgggggtgtttttttttttggttattttaattatgtgatgatgctgttaagcttacagatatgcagttgattttttaaaaagcttaactaggaatctttctgaatacttgtcctattttgaaactacctgtctggttttttgtttggttttgttttctttttttaatgtcagaggaatctatccatgtgaatcgaaaggcacaggaatctaggaactctgaggaatttattgtgaaggattttgttagggggttgacagagaaagcaaagtgtaagtttggaagaaggcatgtgcggtggtggcgagtgctgcgggctatggaaggtgacttggcttttcagttaggggtagtggagaaaggggtagttgcttgtaaacgagttaaaagcattcagtgtggaggtgttaaacccattttaggatcgcttggtttcctggtgggtagaatatgggaacagagccagaggcaggagctaaaccaaaaggagggacccatgaactctgcagctgaccaatcagagaatcaggcaggtgtagcctactgacctgggcagaggtgggcctcacgcagctggatccgaccctttaattctgcccttttggagtggaaggtctgattggtgtagctgctctgcataggcaggacagtgacagttcactaactcttgttaagttacatagtgtatagctttccccccacaggtggttttcaaagttgagacggaatttgggtagg

SEQ ID NO: 70122 - DNA, 1026 bp, Homo sapiens
tcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctac

SEQ ID NO: 70123 - DNA, 1090 bp, Homo sapiens
ttttgtaccatagactttctcactagagtcccttctggtgatttgtttcttttacaccccttcctgctatcctttccactgaataatattctgagtgagaagctagtgagagctaatgttacatttggtttttcctccccagatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgt

SEQ ID NO: 70124 - DNA, 1018 bp, Homo sapiens
aaatacaaaaattagccgggcgtggtggtgcatgcctgtgctactcaggaggctgaggaaggataatcgtgtgaacccgggaggtggaggttgcagtgagctgagatcgcacgactgcactctagcctgcacgacaagagcaaaactccatcgcaaaaaaaaaaaaagaaaggagtcatttgagttgatttcttctccttgccaacccatacattttacaggtgcccattttaagtaattattgtcaggagtttagcagacaaggatggcaacagtctacaaatggaacaacccatataccttgatcaagttagccaaaggaacaaaacctcacatctgtttttgagttactggcttccccatggaaggttttctaattgctgtcaaattgcatgtccggcatgagccaagccgattgcccttctaggcaactaggtatttgttactatggaagaactgtcttcatttaacttttgaaatatccctacagcaatgcttcccagactgtgtatgtgaagatgcttataacaatacctatgcctgtgtgaggacaatgtcagcattgtggaatttgcagtattgcgagtttgatgaccaggaggtaagagggacttctgcctgcacttcccccgctcctttcttgctggtgctttgttggctggacttggtggcataagagcaattccaaggctgctccctagggaagaggttgtgtttcttatctgtgcttcactttaggtttccttcagttgtaaggccatgtctcacttctctaattgtaatctttctgaattgagttctctccactcccaccaccacccaaatatacactttaaatgcacaattcacgttttcagaatgataaatgctttgtctgttagcttccctggtagattggttggagcattttctagaaagcttaccagcacctggtgtattcggaaactcctgttcccaccacagcataatccaatgctgctgtaatagattagagtgggggtcagaggcccaggagtcc

SEQ ID NO: 70125 - DNA, 1023 bp, Homo sapiens
catcaagaggtgctttgaacctgttacagtctttagcacacaagtctgtggaatatttctttattgtccttgtgtctattaggttataagtttcttagtctgagcttaaaacagttcttacatagagcatatgacagtattatttattctagtctggactttcagcaacttgcactgtgactttgattcttgcttagctaccttgtcaggttccattcctgacctgattcacagaagtagccttgggaaggaactattaaattttcaaagcatttcaccatcgtttgtaaaggcccttaactaccaaacatactgctcagtagctttcatatgtacctgttttagtcattccctttagttactgaatgaacagtccaattacttttgactcccaggtcccctttagcagtcaattactttgtgatctttatcatagtctatgtgcatcacagaaattccacttgctcttctttctagagaggtgccagtaacttgacctggcgatcagatgtcctggtggaataccaaggagaaggccgtaacgtcactgacccaacatgcccttccctgagtcctggcgtatctgtgagtaatagcttgaatcaacttagacagctttctcactgacaacatggcaaggtgctggttgccatgtgtcaaatattgaaacctttcatctgagtcctgttcctttgtcactgactgtgagtggttagtagatggacaaaggtaaatccagtgatcttggaaatgatgctgctgacctgtcatcagaatgtgcactgttaatcttccaatttatgtagcaagtgcatgtatccacccgtgttcttatcaattcctcttccctgtttttctacccctcccaataacagtaccatttttttttaattagggataatgttactgaggcatgcagtagagagatgtggttcctgcctgtaaccatgccattatgagtgcctcgcattggcggcagccaggcaggtcacaaagagggaaacagccatgttggcctcactt

SEQ ID NO: 70126 - DNA, 1037 bp, Homo sapiens
atgatttttttgtttgtttgagataggtgctctctcaccaggttggaatgtggtggctcaaacatggctcactgcagccttggcctcctgagctcaagtgatcctcctgccttggcctcccaaagtgctgggattaccagcgagagccactgtgcccagcccttaaatgaatttttaagtttatactagacaaaagcaatactgtgaaactagtgtttctcaaagtcatcacattgatgggtgaatccatccaaattcttggttatataaaaaccagaggtaggtataattctttttaactcttcattcatacttggtatttgctagaagtctcccatctcctgatatagtatgctaattttgagactgtccgcttattcaaataaaattctagaagaggagacattttatccattatatttaggggagtgtgatcattatagatttctagggagaaggagtcctggaatgacttgtgcttacggtacttgtgctgaatcttagtgactttggatttatactggaacttacccctttatctccagagagcaaaatgccattagaaagagcctcggctgggtgcagtggctcacgcctgtaatcccagcactttgggaggccagggcaggcggatcacttgaattcagaagtttgagaccagcccaggcaacatggcattgctacgaaaaataaaaaaatacaaaatttagctgggcatcatggtgtgtacctgtagtcccagttgctctggatgctgaggcaggaggatcagttgagtctgggaggtcaaggccacagtgagctgtgattgtgccactgcactccagctcgggtgacaaaatgagaccctgtctcaaaaaacaacaaaacaaaaaagagcttccccccacctcaccaaaaaaggaacaagcctcccattatacaggtggtggctcttgcaatttttggtgagatgacagtcaccattttatatctctgggtttttttatgtttcctcttttcttttaaaactgccttggacatcatagtagtatctg

SEQ ID NO: 70127 - DNA, 1118 bp, Homo sapiens
taatcctgtcctttcttttgtatttattagctgaaattcctcagagaagaacttccccttatcagttatttggttattttgagatgcagtttattcaggaaacacaggataggtgtttttgttcatttgacagtttttggagtaaacttcattcagttgtgatgaggctgagtagcatgcataattttttatgtatttgtgtttcaatactttcctgtcattatttttgcttattttgttctatcataagccagggagtcccttctagtcatttgtttagagaagatgaatttgttgttttcctgccttgtagtaacaagagacccaggcaaatttcagctttctattaaaacaccagaatcagtagaacaaagttgttttagttttggctgtggattaaatgagtgaaacataacatgagcaaggctcctgtcttggctccatctttacattgtgtgttttgttttcaggacagttttccttgccaatagacaagagacagctgtatgagtttgatatcaaagttccactgttggttcgaggacctgggatcaaaccaaatcagacaagcaaggtaggtgcctgacaagctggtgctgtggacaggtaggcacttgcctgagaaaataaggtgtttcctcctgagataagattggttaggttcctcttcccactagggctgagcagcagaagagtttttaagtggaaacaatgattgcttttttttttccttaacttcccactgctctctgtatctgtattttcaccccacatatacatgtctcattagaatgcatagcttttctttgtcttttgagactagatctttactttgttctggagcagtgactctcaacagaggatgtgcatcaaaattgccctccgaaactgaagaagaaaaatggtacgtgcttgggcaatatccagaaagagtatgattgactcacttggtctggaatagggacccaacatctgccttttttccttttgaagtttgcaggtgattctgagaggcagcctggtttggggcccactgccttgtagagcagagcccctcaggcttttctgtgtgtgaatcccctgggatctggttaaaatgcagattctgcttctccatt

SEQ ID NO: 70128 - DNA, 1088 bp, Homo sapiens
aactttataaaaacagacagtgggcaagctttggcccatgagtcatagcttgccagctcctagttcaaacatcttaagcttttttgtagcacagtcctatctgaattaatctgtaatacacagtactgagaatggacaactcttccttccgattgtctctactctcatcactattgccaataaaaagtaaagctaactggttatttaaaaacgagtttatttctttggaaacaattaactttggaatgaattaattatgttctggaattttctaatctgttttttacaatgggaaggtctagggaatggagattggggatttgagttttgggggagagtgttttgcaattttttttttttaaacgggggttgttttggatttttttttttaaacgggggtgtctttgtttttgtttttggttttttttttttttggcaagatagtgatacctcagccattgcccctgaagtcccatttctaccttctgttcacatccaggtggcaaactctcctctcagttgatgaccttgtggagaaactggtcaagaggctggagttcactggggagctcaacaacacttacatcttctatacctcagacaatggctatcacacaggtcagaggcaggagtaggtactgctgtgatctttgagaatatgtctttcctttttcacccaatgagccctgggagggagttctagtctttttataactgtggacatgccagagggaggatcttgccctcaggacccctccagttggagcaccacatcatacccacgtggagaaaccaggtttcattatttgctgtttcacatgcaagatgacatggtgttctaggagtgggagcagagcatgagcttgatgggttggaggcaggccgtatggaaggcatttgagataggaagaccaaaaggaggttgtcttgggaaaactttcttgccattcatggaatttgttttttgggtgtttttgtttttttcaaaagctgcaggatgagtcagctctgtgtccttgactttcatgctttctgcttggaccttctgttgttaaaagcaaatgttttcttctttccacatatataaa

SEQ ID NO: 70129 - DNA, 1025 bp, Homo sapiens
ggttcacgccattctcctgcctcagcctcccaagtagctgggactacaggcgcccgccactacgccctatttgcccattttctaattgtagtagaccaaaggcataagatcagagttgtaaatgtaatctcgctttagctagtagtttcccagtgacatcctctaaaatctcttaatactgccaacagagaagccaagaccttttatggtttgggaggtgctgggaagctgaagaatgagagattgagttaatctacagaaatttctattttaggaacacaggaagggagagaagttctgaaattgcttaaacaagttccagttagttccttcttgctgaagtatgagtgaaacggttctatttattatctactgtagtaatccagtagtttgtttgactgtggtgacttggtgttaacattttttttcttctaaattttagaacaagcactggttaattaggcaagccaagactccaatgactaattcttcaatacagtttttagataatgcatttaggaaaaggtaagagctgctgctacataacaatctgagtggttttaaagaccctgcaaatcagctcatgaagaggagaccacaccacattgttgtctctgaaacaaaaacagagggaagcaagtcagtgggagagaggcttcgatggggcaccagaagcagagagattcctttacactcaaatgaatgaggtggcatttggaccccagtactaattagactgcccatttttaggacttggcaaaagtcttgcaaacttgaaccatgtggtagaattttttctcctgctttaaagaaaaggtgacttggttgagagagcccattgtcatatgtgacaaatgacccaaaagcttagacaagatcaaaatatctgcctttgccatttggaattttcaagaaattctcttaagtcaatttttaaaaatccattactttctcttaggaagtgtttagtgtagaccagggataagcaaactttttctgtaaaggggcagatagtaaatattaat

SEQ ID NO: 70130 - DNA, 1025 bp, Homo sapiens
ctagtggaatgtatttgaatctaatattattcacttagctacttcagtgcataatttatgacatctactttctacatattttcataaggttaaggtaacttaatctacctttcccactgttttaagttgactgtctttttacattctttaaggcatcacatgtagataccataatctccattagtgtaagttaatagtaaaatatccaagttactgtttccttctttgtgggagacatgatttctaggtcataaaaagtcatcaagatcttaattgccttcttatgttggtatgcttctcagtttttaaagtattgcctaaaaaacaaatatatttgttccaacaatatgcttgcaaatggctatgacataagatcatgtgctaagattgcttaaaagctagtaagaccctgtactgtctgctcaccagaagacatttatctattaaatactcatctgttgggtaaggtaggagatgacaaatctttttatgtgtcaggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacggtagcttcccccaccacttgtattcagccatactaagtatcattaactatatggtatacttgtcaggaagcctttgagccatgtagtgggtttttcttcacaatattttaaaggtaattgcatctgtccctagtacaaccaatagtataaacttgcattgcaagtacagataaagttcctgctacacatccagtgagcagctggagagttgacagggaatggtaaagaatgccatctttcccaatttacaggaatatcactcaggctctcctggtaacctctgtgctgactctcctccctcctggcatagccgggactgcaccagcctcctggtggccctcactagcctttgaggcatg

SEQ ID NO: 70131 - DNA, 1069 bp, Homo sapiens
attagctgggtgtggtggcgtgtgcctgtagtcccagctactcgggaggctgaggtaagaagatcacttgagcccaggaatttgaggctgcagtgagctgtgattgtgccactgcattccagtctgggcaacaaagagagactctgtctctttaaaaaaaaaaaaaaaaaaaaaaaaaaaaaagtctattgacttgtgagtcactcctttctgggatgtttttcctgcattgtacaaggtttagcaaagtagtttgcttttctacctgatctacttctggcttttaaactagaatgcataattgaaactatgcttgtctttaataaaaccctagtcaaaaaatccaattcagtattgacttgagtaattatctttttaatgtcttatcactgctcagagtagagtttagcccagcacggattcagacttccactttgtgcactgacctcataacaaatttgactttcctctttttaataggaaaagaattctaagtattataattacaccctgtctatcaatgggaaggcacggaagcatggtgaaaactatagtgtggactacctgacagatgttttggtgagttgcagaagctttgtagctctgtccttacagggttggctcacatttgattgaagactctgcctagaaaacctataatcttattcgtttgtgttgggtaatataaatgcacagtaacttggtctaactgcccaagagtatttccagctgattacaaactcctcagggtgttttctttgtgtataagccaggctcagatctaatgctcttgaaattccagcaacaaatcccttttccaaaggttaatctcttcgactacagagattactttgtagaggttttactttgtaagtgtacctactcttgaccccggttttactcacaagctacaagatgtcagcttcacaggccccattatgaggatggagagatagggatactggatttatttgggcattgggtatttacatataaaaattactgaaagcaggtgaaattgggactttcctattctgaggcgtttctaatgacagtcttcaatagtatt

SEQ ID NO: 70132 - DNA, 1050 bp, Homo sapiens
tttattcatctcatcagataaatcgagctctaaaagtgggtttcatctgcagggcaactgaaatacagattatcccttatccaaaatgcttgggagcagaagtattttgcgtttcagattttttggattttgaaatatttgcatgatacttactggttgaacagtccaaatctgaaaatctgaagtgctccagtgaacatttcctttgagtgtcgtgttggcactcaaaaagttttggattttcagatttgggatgttcaacttataataagtcaatagcttatagtctgattatttgaactgcttagggtcagttggactattcagtctatggtatcagcagctcagcattcaccccatgaataggctgtgtggggtaggctgtgtggactttttctgtagtgggtcagatagtaaacatttcaggccttgcaggccatatgtctctgttgctactattcagctctgccactgtagcgtgaaagcagccacagacactgcactatgtaaatgaatgtggctgtgttccaataaaactctttatcgctgttaaaatttgaattttatgtaattgtcacatttcacaaaatattcttattttgattaacttttatattttaaaattgttaaattcttagcttgctgttcatacaaaagtcatcaggccagatttggctcactggctgtagtttgccaactcctgctttagaagttcctaggattattagcgtttatttttgactagtgtctatttggggaaattaggtacctactatgtttcaggcactggtctaaaaagattgtaaaatttcctgtttctttctggtctggtcatatctaaggacttgtaattgtccctacttgttttgcttttcagtacggagccccagatgcaggtggactagaacacgttcctctgggttggagttactggtatgccttggtgagtgattattgaagtctgtgacaattttatgcagccctacagatgcagaatatgtttaatttagctctgatattgacataactttatttgcttttacaattagt

SEQ ID NO: 70133 - DNA, 1055 bp, Homo sapiens
aggtatgttgaatgatctgtttctttttttataatggcttttaaaatgtgaatataattcatgttaattttattatttcaattaatgttaaaggatttcttggtatacgttgttttctgtgaatctgcccattaaacaagtacccatatcatgtaaatatgttcatataagtacacatgtacatatttacatgatttgggtaagaacttgtgtatttatatgatatgggcacttgttcttcctttcagtagtcccaggagcatgtatttaaaaattgtcctaagagtgctgctgtctgatgcgtcttccctttttcctcaggaattctgtttgtcatgtggctgtcatggtatctttgtttccattccttgttatcagtatctaactgaagatatttttcgtcttagaatctttcctcagatttcttagaatcttttctgaattataacaacttaatgcttaattcattttctgatgtgaaacatggcaacaaaatgtgcagagattagttacccagagtcagggtcgtgcaggtcattaaagtgtatggccagcagctggtacaccagccttgtagacctggatggagggatacctcgtggtgacctgtcaaggctggattccatgtgcccacattcacacattggccttagcttttacccaaagtccaagcttaaaggaaatagtatgttcgagaatgtttggggttagctcttacagttaaagtgggggttcaagacagagaaaatgtacttatgctctttatctgtagttgctagagatcttaatatctgatctggattttctgttaattctcccctccccccaataattggggaaatctgcaaccttgtgagtttacaggaagatgagtcagtttgaaaaggatcatgagaaataggaactgtggatactggatcatttggttggggctatgggtcataaagagagcttacactactttgcatatttgaaggtcatctgatgtgtatataaaattaagagagatcgttaaagtataaagattttgttttcagggattaaattctgcctta

SEQ ID NO: 70134 - DNA, 1037 bp, Homo sapiens
atcatacaagactctctttggctgttgcttagagctgaccatttgggaataaaagattgagtaagatgtaacaaaacaggaattctgggctgtgtgtctcaatttattggaagaaattgtttaatggataattacttacttttacagacaccgctaaagaaaaccaaagctctcatcggagagatggggatgactttttccagtgctgtaagtttgaaagttaattcaattttgttaatttaactgtgtttgtattctaagaagatactctcttctcgggaatctggtatgatctatgtggttttttccttgttaaatgcctgatctgaaggaaggatttatttaatgtgaattttaattgaaatattacctcttatcaattgaagattaattgcagatatttctaagccagtctcagaactagagaattttattttaaaccttaccatttgaggtttgaaaatggattataaaaaatcaaggaatatgtatgctgtgtaaacttttccttggtaaaaacccaattaaccctaatagccaaaactgacaaatagcaacacacacaccccataaatatagatgcagaaattcaaaataaagtattagcaattcattttcaagaaccatgtacataaccaagtgaatggtagtctaggaatgtaagggtagcctactatcagggaatcccttgaacagtagcatagtgttatgtttaagtgctcagactctggagccagactgcctagtctggaacaccctctctgcctcttttctagcagtgtgaccttggacaaactatttaacctctctggccctcttcctccccatttataaaagggagtaccaaaatcttcttcagagttgttgtgaggttgagttaataggtgtagagcacttctatcagtgcctgacttattttttcttttctttcttctttttttttttttttttttgagtggcgcaatctcgactcactgcaacctcggcctctggggatcaagcagttctcctgcctcagccttctgggtagctgagat

SEQ ID NO: 70135 - DNA, 1038 bp, Homo sapiens
taaagtctaaattcctatgtggccctgcatcactgactcctgcctgcctctctgacctcatcttacctcactctcccttttcctccctaagctgcttccatcaccacactggcttctctgtttcctcccaggtgcctctctccttcctctggcagcccttgtacttgctatatacccagcctgaaacatcttctgaatttttgcatgactgactcctcatcgcatggctctccgtactgaagttacctcctgagaggccttttctgaccacccatctaaagtagttcccctttcttcccaccagctgtaatcacatcatcctggtttattctcttcatagcacttaccaccacctgaaatgactgattgtttacctgttagttgttttaagtccccaagagtgcagagatcatgagggcgaggaccatctatcctctgtccaccactgcctagattaatgcctggcacgtgttgtgtttaataaatgttattacacagtcttactgtaaatcagatattctttcataattttacatatttatcagacagtttgacaattaagtcccatacagtcaactctggtccttttctccacttactctttgaatcctcatttcaccttcaaatgtcctcacagtaactcaggtgttttatcaaaccaatgtctcatgaagcccagtattcttttcctgaggatggtacccagtgatgctttgaggagagtatggctgacgaccttgcttcggaaggctggcgaagatcttctgcttctctagcgtctcttggcagcctcttctggatctactcatgaaattatcagagctttttttggataagttagaatcctcatccttttgagtttatggattccgtaggttttgtatttatataaaacaatggggaaaagtcatttatacattattgaaaatgaggctcctgttaacctacttatgtatttagattagcaatctttaaggaattattgcacaacaaaatatacttaaaactgcattcaatatggtcttaggtttcaaaggt

SEQ ID NO: 70136 - DNA, 1054 bp, Homo sapiens
tctgtttattaaaaagtaattgggctgggcgtggtggctcatacttgtaatcccagcacttttgagaggccaaggcgggcggatcacttgaggtcgggagatcaagactagcctggccaacagaatgaaacccgtctttacttaaaaaaaaaaaaaaaaaaaaaaaaaaaaaaaaaaaaaaggatataaatgcagcattttggcaacacatttataatccaaaagcataagttaaaaatattatcctgtctgttccaaaaacaaaactcaaaaaaaaaaagccagagtagatctgaaataaatgaaaattgccatttaaaagcacttatcctctcaaagccttgtaattcctttgaaaaatgtaattacctctgaatgaagcaccaggttccttgtttagctgcattcttctctttttcaggcaaatgcccacaaccctgtcgaaatggaggtaaatgcattggtaaaagcaaatgtaagtgttccaaaggttaccagggagacctctgttcaaagcgtaagtaccccatacacattgccaatctgggctactaggtcgttaaactagcaggagtctctcactacatacttccgtgcttagtgcatgttgcctgggcatcacagttaacctttcttcactgacatatatgcttccttatgtagaccagaggtgtggtatgaaatctgtgcatgtaaaaaaatggatactcacacatgcaactgaacgttttaactacaaggtggtttctttgttttgttttgttttgttttttgagacggagtctctctctgtcgcccaggctggagtgcagtggcgcgatctaggcccattgaaacctccgccccccaggtgtaagcgattcccctgcctcggcctcccgagtagctgggactataggcacctgccactgcacccggccaatcttcgtattttttttttagtagagatggagtttcaccaccttggccaggctgatctcgaactcctgacctcgtgatccacctgcctcagccccccaaagtgttgggattacaggcatgagccatcatgccc

SEQ ID NO: 70137 - DNA, 1045 bp, Homo sapiens
agaaacagtagaccattctgagcagagattaaggccttgagttgagcaagagccttcttgtaggttagagtggttaagcaccttgagcaaaggggagagagtcagagttaaagcttctgaactttcctaatctataagatgaggcctctattgactagaatgtttgtgaagattaaaagagaaagtaaattaggacaaaatggacttctgaatacataatttctcagtgttaggtccctctctgcattctccctgaaggcttcctactcttttcacccaagatgaattcactgtatttttatttgtatttataaaattggcttattagttttatttcaaaatagagtgaaagatgcagttagccaactcagataaagagtaggagtcaaaataatgtaagcttagatttagatatagccaattccgagacagtcaaataatagatttttactctgttgcttaattacaggggttgaaacaagaatgaaattcagctctcactttagtttattccctgggagcatgagtgtattgtgtcctgccccaaatatttgggagaaaaaaaataagggcacactagaagttaaacaagtaaaagttcacataaattaaatgacattacctatcagcagtagctatctgcatctgtgtctctaacaactataagatctggcctttttcttttctttttttttttttttagacagagtctagctctgtcgctaggctggagtgcagtggcacaatctctggtcactgcaacctccgcctcctgggttcaagtgattctcctgcctcagcctcccaagtagctgggactacatgcgcgtgccgccacacctggctaaattttttttgtatttttagtagagacagggtttcaccatgttagcagatctggccattttctaagagctaattgctttacacctattgtaccatctaatcttcccagcaactcacagaagcaggtggtggtatcctcatttttggatgaggatgatactaagttaagaaatgcactgagtgttgaacagttagtagt

SEQ ID NO: 70138 - DNA, 1765 bp, Homo sapiens
atacatacacgtattccatatcctttgttatattatgatgctttaactgtagagttcattggtcaaatagtatgcttagggaaatacgtttactttgagtaatagttttcaccagaagattgtaggttatatgtgagagtaacttttaggaggcttttattatttaaattacatataacatatagtagattagtcttttaaattgttcttaatcatatagtctttgaaactttttcatcaatgccctatttttttattaattaaattgctataagtctcttcttcctcatctataaaactagggggttggattagatgatccctaagctctttccagctccaagatttaagattttaactttgaactgccataccaaaacaactcaaggatcaacctgcaatcagagtagtcgcttgttccacaggtgattagatcattatagcccaccaaacgaaaatagagaagcagaatagattgactgtcctaggctcgtatgatcattattaatttttttttcaattacaaaagacatgacttctgcagaaagtttgaatagagatgaaggaaacagtgaatggttattgtatgcctctcttcctagcctcatgctgcccccatataaataagttcaagtattagatcctttctgacctttcttagtatttttcatgtaaatacatctctgtgtgtgtgtgtgtatgtgtgtgtgtacagattttcattcaacagcagagtgtctactatgtgcccggtattattttaagcagcagggatatgtggtgaacaatatgttgcatatgtggaagatgaaatctctgttacagagcttacatttctaggaggggaatggacaagtaaataagaatttcacataatggtagttgctaacacaaggtattgctggtaacttttgggggctgaggtgaagagatatgcaatattacataaaggtaggcagacctctctgaggaaggatgtttgaactgagatatgaatgacttgagggaactagcctttgatcaggagaagagcattctggcagaagtatcagcaagtgcagaattcctgaggcaaaaacaggcttgtgtgttgaaggaccaaaaagaatggccagtgttgctgggacataatgaatgaaggggaaaatggcataccatgaagttaaaggtaggtatgggccagatcataaagacctaaacgccttgagggccgttgaaaggagtcagaattttaagtgatattatagcatacatattctgcaacttgttttttgtatcatgggtaacttttccatatactaattttaagtacagaggtataattttaaaatctcattttccactagtccctttctcatcctataaaaatactaaaatctctaccattctaaaaatgttgctcttctgtgctcttttcttctctagttgttactcttctcaaactttctgcctctattttcttccctgccattcactcaaccctgtctagtttagctttctttaccagccattcctctgctacctctcttcttcaagtcaccagttactcaattttcaaatcctcatctctttggtacatttagtgcattgacaactcccttcttcatgaaactttctcctttctaagcttctgtatcactactctctcctagttttcatacttctgtctgcctgttttaaatattggtggtctccacaacttgatctttggctgtctccttttgcacacatttctctaggaagtttcattcactctccttgtcat

SEQ ID NO: 70139 - DNA, 1021 bp, Homo sapiens
ggcatagctatcagagaacctgggcttcaatattggcccttccacttactagctttttttcactaaggcaagttgcttagccattgtaaacctcaatatcctcatatgaaaaataggttaaatgagaatgaagtaatgtgtgtaaagtaaaactcatacatggcacatagtaataataataactaacccttacgtagcattaactgtgttccaggcactgagctaaacaattattatttaatccttatgaggtaggtacttatcccattttataagtaaatggagacactgagaagtaactcgcccagggtcatgtagctagtaagtgaagcggcagtatttgaactcagacagtggctcttaactgttcttctagattgccttttaatatgtataaataaggacttgatatatgttctctactattattgtctttattttcagaaaactgtgacaagtatagattcataaaatcctagaagtggcaggaataatctatgaaacctaacaactttaggaaaagttgtattcattcaacaattatgaatcacatggaactatttatccttaaggttttagattaattaagggggagggggcatctgctatgaagcaaactataatatataatacatagaacaataatacaatattaaaactatttctaatttttaaaatatttgcagtctcaaaactggtagggaaagtgatcttttgatttgtattaccaattacaacttgttctttctgttgttcatttttaggatataaagaacttttcatacatttgatctcccttttttgctccttttgaataaacttcatattttccctttatactcatatatgttttaatggaaatgatgcatttgataatttcagggacactaaaataatcatgaaaaattattttcatgattcctaagagttgggaagttcttaaagcttgcttctccttgctcattgattattcaatattaactttccctatctgaaaaatatgttatataaatggaaattt

SEQ ID NO: 70140 - DNA, 1182 bp, Homo sapiens
ttcatggtgtatctcaattcagactagccatatttcaagtgctcagtagccacatttggctagttgactaccctgttgggtagtgcaagtctggaccgctctgagttatggagttatattattggtttaatgagacctaatgacagtcaagcattacaatgcctgtaatgtgccatgtatagtgttctctataatattttcagaagatctttgtaataactctatgatgtcagttttgttatcattttagacatagacagtgaggtatggagatattaatttgtctaagattaaacaggtagtctgtagaggagcaggatttaaagctaaatctgaccctaaaaccgctgtcctgttttttgtttctgttgcactgttttaaagcactgccactagcgtttgggcaggtaggtgggtgaggtgtagttttggcactgctcagccagtgacttgtgatttaatttttccttatttttaggcacaaaggacttcttagcttagagtggaagtggtatcttctaagtccttgctcatattcctgattgggaatgttcctttatacttgttcctcatttcccattcattaaactgctttctacaattctttaaacatgtagaatggagagatggctctttgagtctgttacaggaccgtggcggcagataagggaaagctcagctcctattggcaaaagtgaaaactaatgtctagtaaaacttttgtctggatgaagaagttttctaagggtttcagtacttcattctgagaaagaattgagaagttcttattcatcatgctctttgaattgtaaatattttttcagttattttacaggattttatattgtggattaatacttagcagcatgttctatttaatttgaataatttctttgaattacatttggattcctagagaatattttctcacaaactttttcatttcaaaaggaaaaacaggcagtccctaatttttgaatacgttgtcttccagattgtgtgtaaaacagttgtttgaacttggagcatgttttactacactggttttaagttcctgggctagcccacagaagcctatttaaaaccacatcctattttagcactaatatactgttggtttaagtttagggaatcagagcattggatcgtgttctgtgggagttggaggagaaagtaagttta

SEQ ID NO: 70141 - DNA, 1063 bp, Homo sapiens
attcataatttgttaagtatacatcaagggaactgttcctgtcatctagaatgaccatctatttaataaagccatgaaacaattagagaactttcagaaaacaaatgggcataatgctatgttgcaaaaacatgtcctgccttgttcaccctgtccatttttagattggtctggatgatagtgaaatgcagaagtgtttgccacacaggtgcagtgttttgcagctgttggaaacattccccctcacccacaacccctttgctttcttcacataaaattatgctgtgcttagaccattaatactagaagatgggatttgagaatttgaatgtctgtttacataaagatgtaatacagagaaataactgctcattcaggcatctgaatgtaactgcctagatgaatttattaaaactgtccttaaggtcacactagccttaaggtcatggagttttagatacaagagactgcctttaaaactcctgtctgtagaattgctgccctccaggactgaactgtctttgaggacagggcttatatatatttatttttaaatctcttgtaactaacataacacctggacaagtaggcactttatatgtttgcgaatattttatgttggaagatgaagccaaatgaaaatatcttttagtatggtactaaatcagaaattataatttttttaaactgatgccatgtggtacactctatagtagtcatgaacagagtgccatggcctgagagagaaggggagagtgaataatcatgtccatggaaatcacgggatactttatatttttatgtatcacggaaaatacttccctagactacaattggagaatttgttttgaagagaatttttttcctcatctaagagaaaataatgtattttccaacagcagtgttttccctccatatccccatttttgtcatttttgatgcattatataataaccaaattaatgattcaaaattggaaagttttagagcatgctttctttatataaaaccaatattttattttctgtagttatttctatgatgagagttatgtatgctttgg

SEQ ID NO: 70142 - DNA, 1020 bp, Homo sapiens
tttatttctgtgtaagagaatggaaaacagtttacatttgagaaaagatcagtaaaactagtaacatttttggaattggtgggggtagaggaagggagggatttggaggagaagcattgtgtgtcttataagaaattatcacaagataatttgttccttgcaacaaggtgtgattaggaaccattggaaaattttgaggattctaatgaaacatttaaggaatttgatttttacagttagtagaatagtttaaagggaaaagaagtcaaaatattaaggacctttacaaagaaaagcttggtatatttgaggcttgaaataatctgaactaaagtattgaagaagaaatgtccaaaaaagcaatagtgagaggctgttgggagtgtagggttaaaggaggacaacagatcaaaaatggctgcaaggctctgcctttaggggatggaagagtaaattttgaagtaccgtcttggtattatcattgctctaggataagggataagagctgtaattcactctcaggtccctccctagttttctagtgactgaataaagaatgaagtggcaaatttttgctgtgggatgcttttgaaacaaggtttcttctcttcggttacctaattgggagagggtgttatatattttcactaggggtaacagtatatgttgtttccattaaagactaggtaatttggatgtgatagaagatattggtgtgtttttagaaatactgaaatgatttggggaaagaaaaaatgtataaagatactttgaaaactttgagggcttttaatttgttagagttgctgtttttggttggtgttttcttgtaaaaacttaaccccaaggatatgttttacttctgctgttgttaataggtctctgttcatttaataggtggcaattatcatgagcatttggggaaaaaaattttaacgaagttttgttgggcagaaagtatactcttggcttttttaggtatgttatactccaggtattttagactacaaggcaagaggc

SEQ ID NO: 70143 - DNA, 1468 bp, Homo sapiens
taattttgtgtataatcaaaaaagcaatactagcatagctttttttcatagacattaaaacttgtttttggaactgcacacttatatttttaagaattgttcttataaagagcaaataaaacaccttttacactttgtattgtttggctaatttattgtcatttgtttggccaaatgacaaggcatttttttggtagtacgttgagctaaatatagctgttcaatgtttatattgaaaaattaatattattaaaaagggtatctttttagtccatgtgttctgatccttaacattttatttaatcttgaagctatattatttcttctccctattccccttttgagtacttttgattttctgtaatatctttcaaaacattttctttcccaacattaaaacccttttgatgtatagagaaatgtcgtttaaaaatccattagcaaaatcccttatgatgataacaggatacatttttttttccttgctcttttattgtaccttgttaagctggtctcacatgaactttcttagaatcaggcagttcctggttcctatgggacttcctgttttctcaaataaaaatagaaaagcatctcagaaaggaaacctggtcagtgtgaactactttgtaagatcagttagtcttagttagtcttagttgtggcctggattatatagatatatagtctatataaaatataaaagtttacaggtatctgaaagctttgaatattttcgtatgtaatatcaaaataaacaaaatgataaggagaagactctgaataaaaaccctgagaggtgctacatattcagccgtaaacatttttgtatcttaatttagaggtgaatgaaggaggggcataggggttggatggaaagtggtaaatcctttccttattatgtaatattttattgtaaatttggaattgcttaatactgagacttaattcttagttactttgatctgtatttttttttcttgccactttttcagatgttggcaaggattaggaaggtggatttttaaaaaatcattagaagtcagaattctaaatgaattattcagttttaaagcatcttgtagatttctttcagtagttaactgcttcttagtctatattatgaagagaaatcaaattaaggtagaaacaaatgatatagtcattagcagtaataataatggatagtgtgtattgagtacatattaagtgcttgacactgtgtcaaacattttatcttgtttatctcatttaatcctgacaacaactgtataaggtaggtatcattgttatccatactcctttaaagaagaaactacaatttagagtagctaattagatgttagttcaaagagacattactaataagtggtagaggtggagctgggacttgaactcagcttctgtgataccagagcacctgatctcaatgattgtgaggaaaaccactaattcaaagtgagaatga

SEQ ID NO: 70144 - DNA, 1078 bp, Homo sapiens
ttctctatctggactcttttcatacaattatttctgcttccgagccagcctatacattgtacattctggcccgggtagtattcctgatgcacaagtctgttttactctcctgctaaattttcagaatgaagtcaaactctctgtcttgctatccaaggctgtctggtagttaatactaaacaacttttctagtagtttgcagaatcaaacaagggctactggttatgtaagaaatataaccaatgctttcatgccttcatgcccttgctcagggtctttcccattgcctaggatgctgatctgttagtttttccttttaaatcaaactcaaatattctgttccataaattctgttccctccttccctccttctatatttacagaagaaggagggaagagaatcttctgtattactctgcagttgtataacatttaatatgttttttgcccttgagtacaggaaccatcttgttcactgggtctctcgctttgctgagagaacagttcttaactcctagtagatgtttatttaatgtttgtttcattttaacagttcataagtttatacaggggcaccttgggagcctaggagaggactgagtatcagtcaacgtgccagtactcattcccttagttttatgtggttgagttagattaaaacaagacatgaagggcagccttgatgaagaaaacagtctcatatgaacagtttacataagaatacactgtgcagagggggattgggaacattgctttggtgattgatggagtttattgtctgtgagaccttttttttagcactaaccttatgccaatttttaaatcgttctccagaaagtgaaatatttagagtaataatttagagtcttagattaaggtttcttaaaaatatggtgcccattacttaaatgtgaatttgtctttcagattatgtggcttctgtgattttaaatttactgtttttttttttttgattaagaattatttggtgttttttttcttgtaattgggtatttcataataacttctcttaattttaggaaagtgaaaaaactcttatgatgaacacattatataa

SEQ ID NO: 70145 - DNA, 1067 bp, Homo sapiens
ttcagacatgacagaaaccagttgccccgaaaagtcagatcattagatgtatgttctagtcttctgttttccttctgaggaggaagccacgagttgggagtttcctctctattgcactgccctgtggggtgatgagagtgtctgggaagtgagtgatatgaattttcctaacagctttgatacaggtggttttgtgcttgcctaggtgcaggaaccttttaactaatttctggatttttcacaaatggaattggtccatgtatttttgttgaatcggtgtctcattgagggaaggagggtctggggcttcctattctgctgatgtcactcctccactttttaaaaattaagaatgtagtatatgttttaaggctttcagcaaagttttggtaatagtctcctgtgattatgcttgtcaacaaagagaaatattgactgagtttttaacttaatgcatgacttatatgtaggtaccaaaaagatcctaagacagtataataaggagattatatctggagtcaaattctggtactgccagtagaagctattacattttggtaaagtctctaacttttctgaacatgtttctctgtgaatgtgggactgccgttaatacctgtcaaagttgttgggagacttgagtatataaaatgcctagctcagtgcctgatgattatagtagcttcccaataaattcaatttctgtgttttctaattaaatcagtgccactctagcgagtaatctctaataacatgccacagaaattttgtttaaggttgtttattgtctttattttcaattttgacctagatgagaacattaatgacagtaaaatttatggatagtgtaatagctaatagactggacagttaaaggatcagaattcaaaaagatcttgactaaggaggagttatgattatagggctcagtgttatgggatggacgaatgtcagggtgcaggcaaaaaaagggattggattgaggctaaaggagacatagaataaaatattccatgaagaaaggcatagtgagaatccaaagcaagcaaactattccttataaaata

SEQ ID NO: 70146 - DNA, 1063 bp, Homo sapiens
attatattggagtagtgggaaaatgctaactttttttttcttttttctcattctttttaaaattttctgtaatgaatattttatgttatgtagttaaaataaaaatgttatatagagtgtgttataaaggatactttacagagagtcgaatgtagattaagaatagttatttttctctatttttcttgttaggatttaggtcctgaatatgaaggtatatttaacacttcattgcagtggatcttagaaaatggaaaagatgttggaataaggtaaaggatctgatttccactttgaccattctgtactgggagaaatggtttttgactttaaattctaccttacttatttttaaataggtgtgttggttttggccctgaggaagaattgacaaatataactgatgtgcagtttttacagtccacaagaccactgatgtctttttggtgtcgttttcgacgtgcttttgttactgtaactcacagattattgttgttatgcttaggtaagttgtaaagataagaaatgagataaattgcagcctgaatttttgtgtgtatttcactaaatgccagagttgagaattcatttttgtgatggttgccacataagtcacagctagatgtcttcactaaatataataaaaataatgtcagaatcattctaaaggcttagaaagcagtaatataaggagaggtagaaataaaactttgttataagactgtcacagaaaaacaagtgtggtcagtatatacatagaaatctactttagaaagtagaattgaaaaatacaaaaattgagcttatttttaaataataaagtgttataaagtttattaaaatttagtttttaaaatgtaatttacctacatttaaaatttttatcattttttaattgataatagggatttaggtgagagttgttttttcattctttctttcttctttaaaaataattcattttggccagctttagtggctcacacctgtaatcccagcactttgggaggcaggaggattgcttgcactcaggagtttaagaccagcctgggaagcatagacc

SEQ ID NO: 70147 - DNA, 1611 bp, Homo sapiens
tcccagctacttgggaagctgaggtaggaggatttcttgagcccaggagttggaggctgcagttagccatgattgcactactgccctccagcctggatgacagagtaagaccctatctcaaaaacaacaacaacaaaagaaaaattcattttacttaaagtaagatttagtatgtttaatctcatgaggttcacttttctagtcgttttatgcttcaaaggaaaaaagtttgtgaaacatagttatatatatatatttttaaatagtagttagaatttaaatgttcacttatcagtgtaatggaagaaatgcttttttctagaaagtgaatctttggaaaatgttcagtattaaatttttttatgtagttttaattatatagctaattcagccatctgtcttgaaggttcattccgttgtggcagttaaaataatcactgaaatattattgaatgatattgaccacaatttttaaaatacaaagtatattaatattacaggtgtagtgatggtttgtgtcgttctgcgttacatgaaatatcgatggacaaaagaagaggaggaaacaaggcagatgtatgatatggtggtaaagattataggtatgatatttgtaagaatctcaactatttctagaagagtcattgcatgattaaactacattatgtcaagtgattgattcatttgtaaattttatttatttttagatgttttacgaagtcataatgaagcctgccaggaaaacaaagatttacaaccttacatgcctattccacatgtacgcgattccttaatacagcctcatgacaggtgtgttcaaagcattatgagttcaagtaaatcagaaaatttaagtgctttctgcagtattgaaaattatattgagagctgtgacccttctcaactagacttgcttactgcacaggttttttttggttttgctttgtttttgtactttatactctctttctaaattctcttccattctcctgattttgagtgacacctggatttctaagtcattctcattcctaggcattcttgattctttgttgttagtctccatcttatttcctttaatttcatcttgataaagaaatagatgacagccagtggctggtgttttactaatgttttttaagtactaactttattattaatgaagcttttaaagtaaaaactaaaatgcaactttttgaaaataaaagataattccatatcctgaagcagcatcttgaccctagcaacacataaagccagtggagcttttggggaaaaaaaatacagatgtttgtgctctagctctggaaattgaaactcagaaaatctgagatgagatataggcatctaaatcttctttgaacaaactccatgagtagtggtaagaacagctagagttaactattacctcagatactaatatttcaaaaagatgacaagccaagatgatagtaaatttgccattttgttcacatgataggaaaaaaatgaagaaagtctgggatagagctgttgacttccttgctgctaatgagtctagagttcgcacggaaacacgaagaataggtggtgcagattttctggtttggcggtggatccagccttctgcat

SEQ ID NO: 70148 - DNA, 1840 bp, Homo sapiens
tttaccatattgggataactcccaaattttttattttgaatgaagtctggttttcagatttttgtacccaactatatatttctgtactaggaggtgggcaccacagattcaacatgtacaccagcctgatcctcttcagtgttcctagtctagttaatgatacctttcctgagttgattctgccataaacttagggataattcttaatctctcctttatccctctttgtccaacctttcaacaggtcatgtcatatctactccataatatgtcctgattctatccgcttgtcacttgcactgttggcctgtcttacccacatcattatcctctccttcttagacaactataatataataataaccttctaactggtcatcttgcattcacttctgcttttacctgagtctccacataacaatgtatttttaaaatatgtagttttaaaagacagatctcatcctattctactccttaaaacagttgagtggctattactcttaccataatgcccaaatacttttttgtagcctacatcatcttaaataatctgacatcttctgtaggtttatctctattctttctactccagccacatttgctccttcgtgccccaggagctgtgtacaagcaatcacctctgcttgaaatcttcctttacacacctctcttcaccctgctaatttttattcttcagttcccacataaatttcactttttcagggaagttttattttctcatatgaggttaagttacttttaaaaagctttttgtacttttttttttaaggacttaatcacagttgtactttcttacatgacactctttatcatctgtctctcccattaaactgtaaactctttgatagcaatgactgtcttactcaccttaacatctaaccaggggtctggctcctagtaaaagcatgcagtgaatattttttgaatgaactgaatgattgaatacctttcaacaaactagaacaatgtcaaatagtaaaactaacttgttttttgtagcatttcatttagatagaagaaattcaccaccaaatagtttgacaccgtgtctaaagattcggaatatgtttgatcccgttatgtaagtattatgatcaggggtacatgtaactcttattctgaatatttggctggaaaatgcatgatattcttataatggtgtgtctgtaattgaaaatgtttttcttctgaatctctaccacagaaatgttatgtttttctctttcattaaattccaagcaaagatttggccaaaggacactaatgtataaagatttgtaaaacttttataaatctttgtattccttatgaatcgtcatagcagatagataaatgcttgaggcaaattaatgactcacaatgacaaagagtaccctttattaaatgtgtaagtcattatacatgactgtcaatatttttgcctcagtagaaaatatagatacaatcactgctgcttacaaatttcaaatctcaaattgtaaaaagtttcctacaaagatgtatatacctgcttctctacaaagtcctgtctccacttgtcaatataatatttgaagaacttttcagactttataattccaacaacatatgcttccagagaatagcacagtcaaaagtgactgccttagaattcacagtatttcatatataagctgtaatagttcttagaattagcttcctgagggcactgcttatctatccagtgatagtacagatcaaattctgtttgttttaaaagtcccaacagtggcaattacaatatgtatacaatacccccaaagtctcatctaatcactcattgatgaaattccaaataagt

SEQ ID NO: 70149 - DNA, 2516 bp, Homo sapiens
tggcgtgatctcggctcactgcaagctctgcctcccaggttcacgccattctcctgcctcagcctcccgagtagctgggactacagacacctgccaccacgcctggctaatttttttttttttttgtatttttagtagagacggggtttcaccgtgttagtcaggatggtctcgatctcctgacctcatgatccgcctgcctcggcctctcaaagtgctgggattacaggcatgagccaccgcgcctggccagcgctctgcactcttttactggaaagtgggaggagggctgagacttctgaattgtaatttttaaatctacctcctgttagtcaacaagcatttacttaataccaattaaaatcgtatgtggttttaaaactataccaattctagtaatatatatatgttgtaagagacagtgaagaatttttaccgagtaggaatatggttgttgatttttgttttcattaacttttagggaaataggggatcagtggcatttggcaattcaagaagcaattttagaaaaatgcagtgataatgatggcattgttcacattgcagtagacaaaaattcacgtgaggtaaagtaacttttggtattgaatttcatgttttggatttgttgctattaaactaagactattttctttcttttttaatatcacagggttgtgtatatgttaaatgtctgtctccagaatatgctggaaaggcttttaaagcattgcatggctcttggtttgatggtaagaaatttgagtactacaaacattttgaaaagatagttatagtttaattttaaactataccagatttcaaataaaagaatttaggttagcatttttttgagtaataattttagatgactttatttatgttttgtgctcatatgtcttttaccacagttaattttctgcaaatattaaacagttttactgatctaaaatattatttttatcttacaacagggaaattggttacagtaaaatatttacgactagatagataccaccatcgctttccccaggctctcacttccaacactccattgaagccatcaaataaacatatgaactccatgtctcatcttcgtcttcggactggcctaaccaattctcaaggaagttcctgaaaagattttcttccatttctaagactgttatttacaataggaaaattcctgtttggctttttgtcttcctttttaaatgctttttgtatgtaatatttttattgatgaatacatctctgaacgttccagaagtcttaaggttccaaagggatttagcagtgaggcagcaatgctgagtaggtaggataattatttcattcagtttttggagctcagttaagccaatacatttaaagttttgcatgaggaacactgactttattaagcattttcagatgtggtggttgtatttttgccccaagaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatatgtatgtgtgtatgtgtgtgtatatatagatgtatatatatacacacacagagatatatacatatggctgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagtttaaagcagggcacattgttgcagcaaaatgtgtatttgacaaattatacttgcaattttgggtcatgaaagtttgcaatatagtaaatgcacgattgactgttgctttgtgcctcagtatttaatttgtttcagtaaacttactttattactgtttatgatttcagataaaaatagttgctgagtaaattttacttgtaatctacaattggctttttaaaaataacctgttgatatataattgtcagtccaaatgaatatgtgaaacagctggaattgtacaaattttggttgtatttaaagctcagtttccttt

SEQ ID NO: 70150 - DNA, 1038 bp, Homo sapiens
cacacttgtccccatctacttgggaggctgaggtgggaggattgcttgagcccacaagttcaatgctgcagtaagctatgatcatgccactgagctccagcttgagtgacagaatgagactccatatctaaataaaaaatcagttggccaacatggcgaaaccccgtctctactaaaaatacaaaaaaaattagccaggcatggtggcatgcacctgtagccccagctactcaggaggttcaggcatgagaattgcttgaatgtgggaggtggaggttgcagtgggccaagattgcactacttcactccagccttggtgagcaagactctgtctcgaaacaaaaaaacaacaaaccataagcagtttcttatgactgaataaggacatcaatagataagaaaggtaggcaatggtcacatctttgtaggtcacatgaagattggatgttggctattaaagggagtttaggtgagaaatggatgataaggatttgttggcatgaaaaatagagaaaagatttgaagaataagataaaatgggaaagatttgattaattattgacagagaaactgatatctaattatttagcatgggaaatctaaaatcccaacatttggggaatagatggtaaggaacagattggataggaaaaatgataaattggggttttggctatgttaagtttgacatgcctacaaaacatttaggtggatgtttctagcaagtgaagggggatctacatttctgagatattttgagaactgtctgagggaggtacaatttgggagttagaaccatgactgtgggttagatgacccagagagtccaaatggttaatcccatttctgccttacttacctgtgtggcccttagatggggattgaggatggggtgaagtagaaaggaaaatttgaactaaattaagaaggtagaatttgagaaggtctttgaatgaagtgaagttaaagtgtaatctaatatgactatcacatttctggtttgggtagctggttggctggtgatgacattccccaaat

SEQ ID NO: 70151 - DNA, 1044 bp, Homo sapiens
aggtgaaaaattgtatgtttaaaataatttgagtgtattctctacacacaattggaaggaaatgctcaaaaatttagcaatggagaccagtctgttggattacatacctattttacaaaattcaccatgaatatttattacacatatttaaatgtttaccttaattgagattctcataattgtcttcattctgtttataaaatttaatctcctgtgctaatatatttcgaattactgccaacctttggcaataaatctcagacaatgagaatttttataacttcagcactttggaaaagggctatgtttattttgcctggcatgagttgttattgttagcaggtataggaaaggacttctgaaacacacccaatccttccattgagagacagggtggcaggcggggaagggaaaatagggataagtggttacgagcattgtctctggaatcagaaccatgcttagatttcagctttgacacatactgatggtagtgtggacttaggcaagttatttaaatagcttgtttcttcatttttaaaacagtaataattgtgttatcaagagaactcaatgaaataatgtaaaatgactgccatgtaatatcactgttactatttcttaactggtctgtgagagcaacaacttgataatatgacttatttttaacatctctttgctgttcttcattgtgatcccccttaatgatgctcacacataagacttgtgaaaatgtattatctcttcagtgcttccttttgaaatgacatattccctattccagcaaatagaaaaaaggagtgcactcctgactagcataatcttgatgcaaatacaagacaaaaagggaaaattcacaggccaatctcactgaatagagaaaatagcaaaaatcccaaacaaaccaaattggtcagcaaaccaaattcagcaacatagagtgagaattacacatcatggccaagttggatttattccaggaatgcagtttgacattagaaaatcaggctgggcgcagtggctcacacttgtaatcctagcact

SEQ ID NO: 70152 - DNA, 1076 bp, Homo sapiens
tcctcaaagttctgatgtagcaagattatagtggattctagaattttctttttaaaactctcccataattcttatgcttggttcccatgagtccaggcgaaggttaaggaagccctgccttagggtgatgtcagtagtcatgcaacaaacactacaaacaataggcatggagagctgaaaagatttatcaattgtctgaatgcgagattggtgaaaagctattcctaaagattaatttgatgtttaaaacctagtttggaaaggaagatgatgaattcagttttggaagcctgatagatttgagattttaacataaaatttcaggtatatcagtcttccccaaagtgtgttccactgaatatttgtttcatcagaccattacatctacataatgctagtcccaggacatgttgatattgtgttctgtgaaaaaaatgagtgtcattggactaggaaaataaaagatggctcattgggaaacaccgaattaaaataagtcaaatggttgctttatcataaaactcatggagcctacaacacactaatgttcattgtagagctccaggagtaatacatatgtagcactttcagaattttttcaccacagaaaatttttataattgacgaaatgttgtgaagctaatgttcctgataacacacgtaggaaatgctaaagtagataaggaagatcttttttttattattattatgctttaagttttagggtacgtatgcacaacgtgcaggtttgttacatatgtatacatgtgccatgttggtgtgctgcacccagtaactcatcatttaacattaggtatatctcctaatgctatccctccccactcaccccaccccacaacacgccacggtgtgtgatgttccccttcctgtgtccatgtgttctcattgttcaattcccacctatgagtgagaacatgtggtgtttggtttttttgtccttgtgatagtttgctgagaatgatggtttccagcttcatccacgtccctacaaaggacgtgaaatcatcattttttatggctgcatggtattccatggtgtatatatgtgccacatc

SEQ ID NO: 70153 - DNA, 1073 bp, Homo sapiens
gctgggattataggcatgtgcccccacacccgactaatttttgtatttttgtagagatggggtttcgccatgttggccaggctggtctcgaactcctgaactcaggtgatccacccgcctcggcctcccaaagtgttgggattacaggcgtgagccactgcccccggctgaattattttaaatgtagagatatgctgctcgataacaatcagctttattatttactatacatggctgtatattttgagggaaatgtttaaagacagattatattcttaaatgtgattaaatgtaatccctattttgtaaccagttttaaagaaataatattttatgcattttcaaagtactttaatttattttgtagaaattcaaaggacattatatcttttataaaaagattgataggaactgccttttctattttattcttcttactggtagatttaataattttcctcttttggcatgattttttcgaaagatatttcccaattcatatgaattttgatatctattatgtgtcaccatacaagtaatgagtctatgtaacaaaaagatgaaagcttctatatttatctgttatctacatttgttactaagagtcaacaggatggctttatataggatgatcagaaacaggaaagctgtggtttagaaaatgttttaatctgtttcaaataacttagcagggcaatctggtaaaaatgacatgattaatgactgaagaagattaaaatattttcacattctgtttttaatgacctctatcttaagtttctaccctaaaatttacaactagtaaaatattataggaaaaatatatcattcataatcctcttgaagtcgtgttttaccttatcaaattgtgccttctttttagccaaaaatagcataaatgtaaaacaaattttaactgaaatatagcttttgtgatattcttaaatacattcattaaagtgttaatatttactaggtttaacataaaagatctaagattatgttttcaattagggtaacacttcagtcagtgtgtaattttttaaaatttattcttacagctaggcagatct

SEQ ID NO: 70154 - DNA, 1057 bp, Homo sapiens
taactcttctgtttataaatggcagtagctgagtatgcacagaagagactgaagtctaagtctggatgtgctatttggctacattcaaacagcatgggacaaacacaaaatgtaaggctagtagaatattgacactaacaaattattcggaagttggttattaggaaatctttcactggacttcagtatctttggtttctttaagaacaaatctaaaattttaccccaaaagctaggtagttatatattatttgtattatggctccttcaacacataacttttttaaacttttaaatcaataaaagaagggattctgtctataaaacacaaaggaatacaccaagttaatgttttagttgattagtatattattttgagagtagaaaaaaatcaatgcaaaattacttgctattcacatatatgcagaaaatgtaagtccttggaatgtagcacacattatcattacataatctatatccatatgctgtttataacaagctgaaatgttatacccttgagaaaagaaccagattctggcacaggactgttttgtggcaaggaaagatgaatggattccaaaattttaaaaggggggaaaagcttgatggttccacaaaaaataagagttgaaatggggatttagagatatatatgttaacacaagctgacaattaaagcaattaatttccttctttatctatatcccctcctagctcttctaatcctgactaaggtaaatggattgactcacctttttagcagatgaagataggaacaaagatatctggcattacagcctgtctccccatcccccgccatccccatttgtagcttttttttttacagatgtttttttccattagttagaatagttagttcttaaagcagttagagacagatctgtaccagtcagagaagcagtggttcaagcctgttggcttaattgctttgagtatgttgctaatgatgctggggccacatgttagatagccaatgtgagcgtttttatgcagtggaaaaggtctttctccagacaaatattgtacctctaatcct

SEQ ID NO: 70155 - DNA, 1064 bp, Homo sapiens
ctccatccttaagcaattttctcctttttcagactctgtcctgattcccttgtcctcttcctatttctggaaatgctcttttcttttcctctactgactcttattcttttgcttaacatttaaatacctgcctggttctcctctccgtttatattcatccctcctacatatccttatccaggaccttactgtcttttatgttgtgatgactttccaatctgcatcttgagcttggctctcatttctgagcccacatattcctttgtctcctagatccacaagaaactgattttgttattttctctgtaaaaatgtatctctagcatgattcagctagtcacacaagctggaaacctagtaataatgtgatcctgcccttcttcactgccctgcatgtactgcaatcaccaaaatcagtaaactttgctctcttgattgctctataaactctcccctgcttcccagtcccattaaagcttcattatttctgttccagtacagtctctcatctgatatatacgtttccatgttccctcttatcccgaatccctccagtctgctttcagaaccatttttctaaaatacaaatttgatcatgttactaggctgcttaaaagccttcaggtggcccccaatcatcattttatctagaatgcccctggcagcagtgccaccaccatttacaactactgggttcctggacagctagatgagaaagcaggataactggtaaccaaaataaagttaatttttgaatagtatattgtatttaaattttatttgcatttttatctgcatgaatttttagagtctataggtttatgctaatttcatgtatattgtaaattccctacttttcaagacacatatatataattttttttttttttgagacagagtctcactctgtcgcccaggctggaatgcagtgacacaatcttggctcactgcaactgccacctccaaggttcaagcgattctcccacctcagcctccagggtagctgggactagaggcatgcaccaccatgcccggctaatttctgtatttttagtaaagatggg

SEQ ID NO: 70156 - DNA, 4414 bp, Homo sapiens
tcatagaagacacaaaaaatattttacaaatactgacaagcaaaatggtacaattatgtagttcgattcctttcaaatactcgttgatgtcagtataaccagacatggcccacttccacgtattcagccttagctgcctttagagactattcaaaatttaactaatgcactggattcatagtttgctatatttgagcgtcagcatactaagaattaacaaaacagaaatgtctgtttttcacatacctattgcactccaagatttgttacaagtccacatctgctatccgggtcctacctcatatactttatttatgagaaaaaaaacatatataatgctgaatttttaaatccttgaaatgcagagttggaagagcctttaaagatgttctagtcctgccatccaagtccaaattcctcctcattcaagtctagacacagagattcatagctgaactgcagcatccatacatctttggtctgcctaaagcaagggttggcaagctgtttctgtaaagggtcagaaagtaaatattttagactgtgtagaccatacagtcttagttgcaactacttctgtctgcctttgtagtataaaaacaaccacaaacaacatgtaaacaagtgagcgtgcctgtgttccattaaaattctatttacaaagacagtgggcaaaattcagccaacctctggtctaaagaatttgctgtcaagcatggagcatcaagatgggtggaaaaaatagcctaaataatgcaaataaaatactcatgatgaatatcagcaaaagctgtccctggcttttcagtccaaaggactcagattttttaaataaattgagcttcttactaaatacttttgttgggccttattaagtaaagttcaccttcctctactccacccctctagccaacccaaagataaaagagagaagctgccaggcatgttggctcatgcctgtcattcctgcactttgggaggccaaggcgggtggatcacttgaggtcaggagctcgagaccagcctggccaacatggtgaaaccccatatctactaaaaatacaaaaattagctgagcatggtggtgcatgctactcaggaggctgaggcatgagaatcattgaaaccgggaggcacaggtttcagtgagccgagatcgcgccactgcactccagcctgggtgagagtgagactctgtctcaagacaaaaaaaaaaaaaaaaaagagagagagagagagaagctaacacatccaagcaatcatttacatgcattctggatattcttaagcgtgatgttattttaaaacaaaattaaatacactgtggttgataagaaaagaatgttataactttgtcctaagtggatggcacccaatcatatgcagataatagaggtgatctatgaacactggatctggaagtaaaggcagtgctcagctccacatggaagatcacatggggaagctgatgttgaaatgagggacagcacggcctattacaaagcccatgagctgtggcatcagaaccatctggatttggattgtttctgcaatttagtgattctgaaacactggatatgtttcttaattttcttgagcctagagtacctcatatataaaatggagataataatatttatttctcaggattgttaggagggccacatcaggtaagtcctgcaaagtacctagcacagtgcctggcacacaagaaacactgacattctatacagaaagaataatgactgctctgttataaaacttagccaactcatcaccatttggaaaaatctgcaacctgggacaaaacaaacaaacaaacaaacaaacaaacaaaaaaacacctaacttttaaggaaatgacttgcttctatatttcctgaggaaaatgtcaatgctttcaccttgctaagtaatagttacaatcaagagcttagagaaaggcattgaacttagcacagaagttacctgtttctctcacttttacctttcctacaactctttggctattcaatgaggtttggaattagccagagttagccatttaagtttcctttcaggtgagaactcatgactcagtaaatagagattccagaatgttgtatgctaacgaggtcttcaagtgatcagcaatgagaggaaagtcttacttgttttcctttgaaggcagccctaagaccacccaggagcttgtgacgctcaagaaagtaacagcatgtttatgtaggaatgtgagctgcatagaacatggaacacctgtactctgtggccttcacagacccaattagcttctggaaagaattcagggtagaaatccttaatgggatgccccagaaagtgcctcaattctgaacaccgaaataatttctccagctctgcctgctgtgtataaaacatattcactaaaaactacttagttacccaaggaataccacataagaatctttgacattcagaaaagagacttgacttatttattatgagaacttacagtgttgttacaggaaacctattcggggcttaattggagactttcaaaatccagagccattcaaatagagaattggctgtcctgttaggtagcaaattctccatgatggaagtgatgatctatcagagatattgtggaaagtatcccagtaatggaaggaagaaagatttggctaaattgttttattcttgtgtatttatttaacaagcatttttgagcatctaatatgatctggtacttttgaagttctggcacattgataagggttaagaatataaaggaaaacataatgacattttttcccttaaaggacttaaatatgagatgggaagatagacaggatagccaatgaagactgtagagcagaggtgctaccctaaagaaatgcaaaggtagagtacctcacctagcagataatgatcagggaagggttcctggaacagctgacactgaacctcaaggggttaagtaatgtaagttggtcagatggaagaaggaagcaagaagccattccaggagaaagaaacgacataaacaaaggcacaagaaggtcacagagatgaaataatgcttcagccagtttagaggatgtcattagtggtggatcccggggctctgtcatcaacctgtcccattcatttttgtaaaaaaacttgtgtgtacagggtccctaatgaaaactgtgaatatgagtctgagataatacaaaacgcatttaaatagcaaaatcaagaccccaaataggacacagtaggaatttaagaaataatgctgaatccataactcttggcagggtgattagatgggtgcagaaatacagtatacgggagaaccgggcaaagaaaagcacatgtaaagaaagatttagtaatccgaggtaaataaggcaaagctgttaacatgttaatcttggtgatgagttcgtggatgtctgctatatcattttctgcacgtttaaatagttcataacttttaaaagcacttgggattttggtaactataatacaacaataggatttagttgccaaaattcaaatgcaatttttggctggcgtaagggaagtcagaattcagaaggaaagacgtgtccatctcctctattccatgctgacctgatcccatgtgcacagtctgaacagtccaggactttatacttaggggcacatgttcagctctgttctgaggagaaatacaagtgagtaggggctcgaaactatgttctatgagaaacatttgaaggaatgatggtgcttcgtgtggagctgtctcaagaattctaatcactgtcttcaaaacgctttcctggagacgacacgagacttgctgtatgtagctttagaggacaggcctacagtggtatatgtcataagtgtgtttaatggacacgcattcaattagatgagctctgcaaaaataatcttatttttagagaaaaatacaagtaagtagtgtgggtggctccttcagccattctgcttaatgagtgtatatgtgccccagaatgagcaggaagcaggaagtatgaactctcccatctcaggtccattttgcctctcttagcataagtatctccccagtatgagtgtaattctagctttgtaaaattcatatttttttaaatgcctccatcaccattatgcaaaccaactacattttctgcttttcaaccaaagaaacagtaatcagttccaacatgggcaggaatgctggctaacaactcataggctaataatggttgggttgctttcctgaggaactttcaagaccatgtttggccatattcagttgctgcctcatgtggctttagaaccaaacctcttgcaaaagatacaacttcacaataaaaccaaatgttaaaattgcagggagaatggttttagcttaacccaaggaagaatcctttaacacctaacttctttgaga

SEQ ID NO: 70157 - DNA, 1064 bp, Homo sapiens
aaagaagaaaggcatggagttcaatctagtgaaaacaagaggaggaaaaagaaaaataaaatggaaagacaaagactcataccaagcagaatttccaaggacctcaagtttagtttctttgtgttgggaaaacaggttggagagaaatctgggctctgcactgatacttgaaataagaacactaagaactgttctttaaataagaacagtttcttatttgaagaatagaaagaccaatttaaaactctgggcacattgcacaagttgcaaagagaaacttggtagaataatactagagtttttttctacaaagactaattttttttttccgtggatgccagtgtcctgataacagaaaagaatatagatcagtattttggcagtgacccctagtacctttcattattcacacagtcaattctagtaccctcttgccattaatctctggctgtcaccactgaaaacacaagtggagaggagtttgtccaatgccattagaatgtcagacccaataccctgctttccagtccttgaatccccattccaattgctaagacatagggatagggtgatatcaacagagcaagcctggaaattgcttatatctattagccactatatgatgccgaatattttgaaaaggttgaatattttgggagagtggaccttctatctttaagatgcacatacacttaaccttctttgtctcataccaggatacaaacccatgtacaaaagcacctaccagcctccaatagccctatgccattttgtgtcttcagacatctttcttctatttcttacagcctatggtattttcactcatttttctacacttactcttcttctctctccctttcttttatacacagccaagttctttcttttacattctaggccatacctctgttaggagttatggctaagccattttagtggttaaaatgaaatcttgtttttaatgttatcacattgaaatgttcaataactaattctccaaaaagacatcttaaaagattgttttcctttacatggaataaaacaatttatcattataaagctat

SEQ ID NO: 70158 - DNA, 1023 bp, Homo sapiens
gctcaccgcaacctctgcctcccgggttcaacgattctcctgcctcagcctcccaggtagctggtattacaggtgtccaccaacacacccagctaattgttgtatttttggtagagacggggtttcaccctgttggccaggctggtctcaaacttctgacctcaagttgtctgcccaccatggcctcccaaagtgctgggagtacaggtgtgagccactgcatctggcctggttaccctttttcagatctcaaaggtactcttagtcgataacaaattacagactatctctataatctttagaaaatactaattctttttgtttgtttgtttgtttgctctttcttggtgatgtgctatttttttttttttttttttgctttgcttttagagtaagttcatacgtgcagccttgtaaatggtaacttgtccaaggtaacagtcgctgccaggagagtcaaagggaatgttgattgtatttattttactatctgtgtacttcctgaaagaagggcagtttgataaaatacagtgaagctgctctgtttggggcacttatttgcaagtctgcattagctaattccctccagacttttggattcatgtcatctggacccactgttttgtgtatgttcagatttttcaagtattcctttacctgcattgacagagcatgtatttgacagaataatattaaaaaatataagatggcaagcagatggtcagtcttgactggaaagagatcttgttgaaaatggtttgtgaatgcagaccatgtttttgtttacaggaatgtccttttaaatatttagtttgatcagcaatggaggtcttgaaagaaagagctcaatgcctgcaagaatatgttagttgatatcctctacctgaaataatggcttccttaaaaaaagtaaaaaagtaaagaagttttttatacttcttgctgccagatgtctgtattgctaccaaaatcatggaggtgaaaaaaccttttcctgatctccatgcctgatgcagctctgtt

SEQ ID NO: 70159 - DNA, 1009 bp, Homo sapiens
aagacaaggctgacctgaagactagaaaatgagaatataaaacttaagaagtgaaacttttctaccattaggttggatatgggagatagaaaccaatatttcttgattatctcctgtgttttgggcattgtcccaggaatacttataaaagatgttctgcatggtagccatgatatgaatacactccattctcaaagataccaaatcttaagttaaaccaagtgtactagatgtgagagcaagaagatagcagaaccagattgggaactaaagtatgtttcgtgccaaagcctgtgcccttttcctgaagctgaaagtagactttctctttctaacactatagaaaaagactactttcttctccataattctagaagtcagagctgagtggggggactctatatgtcttttcacatgttccctgtcaagagagtatttctctagagtaagagcttcagactgagacccaagtgatacaaagggcatacaggtaattgggacagatagaagagattaaacctttgtctatggaagagtagaaaggagagctggagcatctgccaccctgcactggggtggcttcatgcagggagcgggagctggacatgtgggggttgttgtctgggggtgaagcaaggggagggcaggcaagctttggcctggatggggtggggaaggcaaggagtgaactaagcaggggcctcagccaggaaaaagaatgacttggtctgactgatgggtttggaaagaaactgggcatgcattgaccagcccttcctcttcattttatttttgggagctgctgatttatgagaagacagcatattgccttactttttcatgttacaagttttgcagggacagacctcttctccggggagaatttacggttgccaaatgcagcctctgactgggttggtcagtctgtctcattctgcaagccaacttgctgataggggaaacattggccaacatcagcatcatcagtacaaatatattttgtattcct

SEQ ID NO: 70160 - DNA, 1718 bp, Homo sapiens
agagggagaaggtggctgttttttaaaacctgaaacatcttgcagagcacagataagcattattctgtgtggctccaaggggtaaatccagcactatggaaaaaacattctaggaagataaatgtgggcaaaatataggatgaatatcacttttgatacctttttgatactcttatcagtatcacttttaattgaggccagtttctgatctggacactgtaattggctctattcccagatatgactggttattttcataaaacatcccttggattgtaagctcagtgtggggagggacagcatctccctcacttaccatagtgcccaacccttagccagtgctagataaagatttgttatgtgggataaaggacaaagcataactggaaggcggagtggcaagagaagagatctttgaggacagtccttctcatagcagcaagcagaatttcattgctatttaaattcagctctttttcttgtttggtaaagtcaaagcaaaatctacataaataaatgaatccaagaacgagtggccattttcgtataacaagtatgggatggaaatgattctagggaagaaaaagagaagttcatttgctttccccaatatatgtgtacatatgtggaaatacctaaagagaaacacaccaggaaatatggtataagaacttcaccagcattgctttcaggtatgtagacatttcagccacatttcaaactatgccatcttggtcccattcagaaaatttgaactttgcaactaaaactatatcagatgttttgctcccaatcaattttctttgccttccttttatctcaaaagctaattcaggtgtgccctgctttaagagagccaaatacagtatactacaacccaaaattgacaacctataaattaggagaatttacattacgaaaagattctgaatggtaacttctcaggagataggcaaacattgaaactaaagtcattttattagaataaaatcaaaatatctccgaaattatgatgtaaaccaatgagaaaacactatttatttatttatttgagagaagatctcattctgtcacccaggctggagtgcagtggcacgatcacagttcactgcagcctcaatctccctgggctcaagtgatcctcccacctcagcctcccaactagctgagaggaaaacattattttaaggacacccatccacttgagacatccttaatagaccaatcagtgccaatagaagtgactagatgtctttggagtctggcaagaaagaaaaatctatgacatgcatggctattgtctaaagggaatcctccctgtgttatattggaggaaattattattttacataaaattgacttatagaaaacaatcatggtaacaacacttttccatggtgcttttatataaagagtcttttgaatcaattatttggcctttggtcattcattcattcattggtaaacattacttaaagcccagtgtccctgagcctaggttgggtgctgggcattcaaagaataagttatggagatacttttgaaaagtccattcacaaacaagtaatcatactagcttgggatgagtgtcatagagtacaaacagtcctatgatgagtgctcgagactacagatggttgcagatggtttgaagtatgatttttctactttatgatggtacccatgcaaccattctgtttttcactttcagtacaata

SEQ ID NO: 70161 - DNA, 1019 bp, Homo sapiens
catgtataggtgatttagctgcaaagaataatgaacatgttggattttaaaatatgttcataggctgcagttggaactcaatagtaataagacaaaattgagttctttgcttgggtgcaaatattaatagctaactgtatgaaccaagagatagagacacgagttagcaataatatgcagtagacagaaattgtgttgcttacagatttttactttcccttctaccttgatgataaaatctggattttatttggagcagcaatgtgttagaactgtatttgccagcatcccatgaagaaaggtttggccatgagatttaaatggaattttttgcacgtaagtttaaagatagctatttaaagggtatttactcatctagaaggtgtgtctcttttgctcttgcccctcccgttcttcctgcctggaacacagatgtaatggctggagctctagcagccacattgtgtcattgatgatggacatgaataagggtggcagaggaggaaggcaagggagcagtgagtccctgatgacattctgaagcttctgttccaactctggactggactaccacaggaatttctttatatgaaaaaataagctcttaactagttatgcctctagttgaatatctgttactagcagaggagctcaattcctgatactgatcagcaatataacatgattatgaaaatgatccacctgatttgagactgcattaataaatgaattataccagggttagagtaaacaaaacaagacaaaaacatgaaacagcaaccacaaaaactgacggatgccaggatctccttctaccacagtactccaaaaaaaggcaaaaattattttctttacatcttctgaggggaaatgatgttgggctgatccagaattggagaaatcaaagaatatgcttggagggtaaagacagaaaaggctggtcctgggaagtgggagattctgcaaacctgagaagggaatggagggatctttgctttatagcaccctggggaagtcac

SEQ ID NO: 70162 - DNA, 1873 bp, Homo sapiens
tggagacccggctgcctggtcctttttgggctctttaaatatgcggcggccgccggagggagcccggggcaggggctacggggagcctggttccccgcaggacggggttaactcgcccagctaagggcgcgttgaaaggagtgtccaagagagtgcagggtagccagggtcgcttccttgtcaggggcccggtcccccttttgcccctggatctcgcgcctcagagctgcagccattaaatgctcttctccaaggccagtggccgggggttgagtaggggacgatcgaggggcgcccgggaccctgcggagtggagggttttgtctgcggatgcaaccaattaagcgtgcagccggcgcttgcagagctgcgctcagcgcgcagggctgggggttttgttcgctgtaatttccaagccgcggcgggcagagttggagcgggatatgtctattgagaacatttaaactccactttctcgggctttaaaacttgctctctgcttagtcttaaatcgcttccttcatggcaaacacgccgattagaaaataatcctagagtcccaaagttgtccgagagcaaggtggggaaactgaacaatgtttgcttgccagtgcattttagaaaaattgagagttgtacctttttgaaatcatcaaaggaaacaagccgatctagaggcccctgagttttcccgctctgcccaagcgacactttacaccgcatttgaatcctgttttacacctcccaggaagtctctgccctcccccacttgtttcccacccgccacccagttctaactcactaattgccccccctccaaaaaaaaaaaaaaaatccaaaagaaattacaatggggtctggaggtgattggatactttacctttgagttaaggcagagttcacaaagaaagaaaaatttgtctccgatgtgtttgctctcgatgtgcccactggtgctagtggtcccacagaagcttgcagggaaccttcccgaattctctaaatgggatgcgaattttcattgaggacgttcatgggttttaagttaattagtctcacttaatcaccgaatctgaatgaaatgtgaatagatgattcactggataaatatttgggatctggaatattaatcatcgcattctcttaaccacttgagtatttactacttggcataggagccatttaaagttttgctaaaccaagtgattgcttccatttctcattcccagacactccattcctcctcgcttttacctccttttagttttctccactccacccccataagagttttctcaaaagaaagttttgaagaaaatatgtttatttttatcaaaagatatttaaatttagactggaggccatgcctgcatctccaaaaggaagtggagaattgaagcaattaactagatgattcaagcaaaacctcccaccatagatttactataattatttggaaattttagggggaatggagttattttgaactgaagaacttgaataattgctccagtatttcactcaaaatgtgtcagttgaatcataatccacctagaaggcaggtatacaaagatgattaaaggccaccttttcaatatggaagattgttgaaatatctgtgatggtagcttcgtatttctgttgtttgaaatgctagtataatgcagagtggtgttcgtttaaaatgcctattattcctatgagttgccaaatgcatagccctgtaaactttacaccttaaaagtatatgactttctttctagaacatgcctcttcagtctttgttaccattttaggtttgaagtagaatctagttttcatatacaaaatagagtttcctctttgaacccttgcattaaaagtatagttattt

SEQ ID NO: 70163 - DNA, 2730 bp, Homo sapiens
gttgcggggggggcgggatgaaaatgacacaattaatatttgcaccagttgtaaatagttaaaaacaaatcaaaactatagattttgcctggtggtaaagtttttgcaatttcctctgaaaaatgataaagattgatttactttgtgcttattacatggctactgcaaaccaaatccccctattaaagtactttgccaaatagacgataattagaagtaaatctagttgtgggatagtggaaaaattccatgaattttgcagctttaattgtgataataaagtatactgtttgttttacaataaacctgcagtatagtatatcataatctcaaaatgccttttcatcaagtgacatagaaatgtctgaattggacaatgagactttttaaaacaagtatttggctcatttaatatctctttttgggcagaatggaacccagttaagtgtaatattcagtgtttatcttaataagtttaaacttgcagtttaagataacttcaggttggctgtgtttaagctagcaaagaggaactatgtcagggttaatgcatgtatagagaagtaccagtcacttttttgactttataaataaattggaaaaaaaagtttctgcgttgtatttgtaggtttgtgtagtaattgagaacaaagtttcaaaaatcagaactaaatttggatataccttttcaccggttttgggtactccatgtacagtatttgttagaaaggactatatgctcatcgtttggggattaatgttttgtgtgattttctttgtgactgtgggtactaactgtaatgtatgtaaactgccatagcaactaatggtacatataaagttatttaggaagttactctgagttcttgtctgttttaacagttttgaacagagttgaggagcatatttttaatatatttaaatttaattgcttcttagagtttagatttaattgtttcttatttaatcaataaactttaaaatagctctaagtaaccttgttatttaaaaatggcaatatataatctggtatttttaatatgaatactttacatttgtttcattttatctcatttataaattaactaaaatggactgattttaccaaggagtttttctatgttgtgtaagtgtggagtttacctaatttacttttattctaaggagatgcacaaatgaatatcttgttagatagctgacacgcatttaagctgtggtataattcctctgaaaaacacatcatgataatatctcctaggaagaaatctttaaatttcaccataaataagtaatttgaaatttaatactaaaaaggaaaatgaattgtctcccatattttactatatttcatgttttttggatgaatagatagaaacgctcccatcgcctccgcttcattttaaaaagcttaccactgactaacaaaatttgtattgagaaaagggaagctgaagctagtgcctagtttaccacctaaagcaaaatttttaaagttgatctattcctaagtaagggttgatttatttttagtgactctagtgacaggcatttgtaaatgacccccctacgccgctcatctttctgaaaattcttcatgtgtatgcatacattattccaatttccaaaacagaagtaggctttcttttttctaaagattccttctccagaatctttcattctttcagacacaattatttcctacaatggtgttataaaaatccctcttgtaataaaaatgaataaatacatttgcccataacatgacttatttttcttcagttttataaattacgcttcatctggagaagagaataccttgcaaaataatgaatgacattgatgaatcgttcatggcatgtgtaaacttaaggtattttcactttcaaatcagaatttgttgagtatgttactattctatataaatatgattttcaaacatttgtttattaagcatatattgtgttctaacaaaacatatatgttcgtcaggattttgcaatgcaaatctttttagaaaaagttatattgttcataacatgtaagataaacataccctgtgagactgaccagaatagatatgagaagtcttctatgagtaacaaagtgagtgttttcctgtaaactgagacccatcacaatgcaaaatacattgcaaagactggtaagtatatgagaagaaagaagcctaaaattagaggagctgcaatgcacactgaaatcctgatggttatatacttaaaatttcttgctgcttggagtttcttgacttacaaagtttatatttggattcagtaattggccttgggacatttgaaaacaaagctgttgatttgaaaattaacagtgtgaaactggacaatgcatgcagaatgttgcaagaccaagtgaatgactactaaattagccatcacttcaatttcaaaccatattcagtagaaaattgatttatataatatgtaaaacaaagacatttataagaacacaatttcctatgcttggaacttttggaagagaagataattattcttcaatctacttaatattccattaaaactaattactatgcatgaccattgtgtaatgattctagtcattcctcagaactccaatctgagtgctcaaaatttgtccctgaatcagtttcatatagttacctgaataaaagaaatcagaagttaaagttttcctgaataattcatttgtccatgtgtgtatacgtctgtgtgagca

SEQ ID NO: 70164 - DNA, 7484 bp, Homo sapiens
gccttctgcgactgatacccacaagacttctggttcccaaataatatcatggggctatgtctttgggaattgtaacacatccagaagttttcttctttgctaaatgagagggctaggtgaaattatctctagttttactgaactctagaattctgatgataagagggaaataagacacacatataaacacttttccttcctttcctcttgccctccctccctcccttcttcctccttcctttttttccttccttccttctttccttccctccctcactccctcccttcctcccttcctccctccctccctccgttcctccctgcctctctctttgcctccctccttcccttccttcaacaagtatatagtgaacacctcctgtacacgaggcactagtgctaagcactgttttcaagctcaagagatgtatttgctagtgaatttctttcctaattagtttttaaaatatgcagtacattgaagagcctggagtacagaacttcttagagaaagaaataattatatttcccatttaacatttctcctaatcttcatggacttgcttctaaatatatcataaaattaagtgtacagttttgaatctgaagtttaaaacataaaaatattaatgagggcaaacaagggagaaatgacacttttaatgagatatgattgttgtaaatattcgcataatagtgctggtaacagtctgaaatttcagttcttaccaatgagaattccgaccatatctcccttttctctcttgatgtgagcaataaatagtgagaattagttatgcctctgttatacatgggtttgtagtataaagccaaattctattctggcaaaggaaaaccaaatatacacttctacagtattgcatatgttaaaacaaaacaagcctcctgaatgttttgtttgtcttttttgaaaaataatatcctgaagagcattaaacacaggaaaacaatattaaagctgatgttttccaatatgtaaaaatcctggatctaagctggtttacaaactaaaaccctaacttgttttgcagcctttgtggagtttgattagaatgattaaataatgtgggttttaaagaacaatgaaaacctcccagattgacgccacacagcacagctaatgtgtttcttctagatgtagtctcagaagagggtttcagtttacatgtaacactggcctgaacgaccaaggagcaagtttgcttttaacaagtccgagtgataatcgtgatattttgccctttagttaatggtgcaaattttatttctcaataggctttttgtaaatgagatgctcatttaaaagtcatcttatttgcagggctttttctgtttttgagagatttgctttctctgattttgaaatacagtgaaactctttcagaaaaaaaacctctctcttcaatagattttagatacacccagatcacatcatggcccctgaaacataacaaccgtgcagaaaaagcctggtgtagcactgttaacttctaaggtcaataggctccttctcccaccctgacttcacacccccttttcaataaaaaggatttctattttccatgtttgtgtaatttactactgggttaactgtgcaatcttacagttgcttccaaagattaagtcagatgctgcttctgtgctagagaactccacactcatgtataactcactatgcaatagccaaagggatccttaaaagcctcattctaaaggtgacagatgggtgtgaaggaatacttgcattgaccaaggcttctgtgagaggaaactaacttgaagaaaaactccctttctgggaggcagaggcgggcggattacgaggtcaggagatcgagaccatcctggctaacatggtgaaaccccgtctctactaaaaatacaaaaaattagccgggtgtggtggcaggcgcctgtagtcccagctacttgagaggctgaggcaggagaatggagtgaacccgggaggcgcagcttgcagtgagcagagaccgcgtcactgcactccagcctgggcgacagagcgagactccgtctcaaaaagaaaaaaaaaaaaaaagaaaaactccctttaagggttccatctagttaggagtgaaagaacacttatggagcacctcatgggaggcaggaacttctaagtacttctaggaatgatgtctcacaggaggagtcatctccattgcacggatgaaaccaaattgaggtcttcaaggacctgcccaaagtcataaagctaaaatggaagagcaggaattggaatctaagcgttccaaggtagagtctgtgatcttctcagggcacctccctctccatgaggcaatgctctgaagagggtattatttacttgacactctgggctttcgctaaattcatgcccttgggactgaaggtaagacaatgccactaacctctgacaacaaatgattcctttgtggagccattcaaaagtgataataaacaatgattcagagtgtccaaatcagatggttagatagaacccctaaaggctaccaggttttcttttgtcctgggaaattaactgaatcagtgacaattttagtttcctaaagtatttttttatggtagcaaatgcttgtatactaccgggtagtagcattgttaagaggctaggagcacagtctttacagttagacaaaactgggttcaaatcccaggtctgccacttacctgctttgtttgtgaccttgagccagttgtatacctaacctatctaagacttagttgttcatctacaaaataagaggaataataatacccactttataaggctgctgtaaggattaacgtaacacatgtgactgacaatcgagtgcctgggatattttaaatgctcaatatttgtgagttaacattacagtcatatagagtttgcgttaattcatgggacctgttggatagtaatgccagatcagggagatactatttggtgagaaatgttgtggcttattttatctctcatctacctgtctgtctatctgcctatccatctatctgtttgtcaactatcatgtaaagctatttgtttttaccaggcagattgaagagaaaaagaggaaagtttcatttggcagtgtagacagtcaatatcactgtaccaagtacccccaccggctgctaactcagataacaaaagtaaaatgtggaacaaggtatcctggttcaagttacctgtatttgtgtgttaatatagccatggatgattcttatacatgaaacaatatgtactaagttttctttatcctaaaaagcaggaacacgtttttatagatgtatgtgatatgtgtgtgtattggtgtgttgttgtgtatgaagattggactagggctgacaaaaacggaaaaactaattgctttataaataatgttaacaactgtgatatcagaaaaatcttctgtgaagtaaagcaatgaaataaactctcaagatagaaatgtattcatgttaagtgtgggattatggttaataaagtacatttttaattaatcattatttctaggcacatatagttttaatcactgggacaaactgatgatttctgcctgcttttttttcctctgctttaggtgaactgattgacaggtgattgtttcaggcaaggaacattaaattaaacatgtagaagtgtgcaaatatttgttattttgaattagaatgcttgtgtattctttttcacatttatacttgcttttgactaccaatataggtagaagagctttgtaaattgtaaagtaatatgtcaatattaatttttgcaactttagttgtgacatggaaagaatcttgatcatcttaagaaatattaattttctaaaatactaacttatgtagttacagaatgtggggataatgtttttaatatggacagaaataaaagcaaaatagcttttgaaaaagcattttcatgtatttcagaagagatcactacagggggtgtcttttagggcgaggggttgcatagatacctctttacatcatgcaatgaagaagaatctactcagaaatgtggaaaaagattaaccttagaggagacgaagtttgttaaaaaaaacaaaaaaaaaaaaaccgatacgtcatctgcaaagcagaacattcttacttcaaatgtgtcccttggtgcagtacttataaacaatgtcaggtagaaaactataatgacttcctttttcatttgcagaaagcagaagccactggagaaaaacggccaagaggcagacctaggaaatgggtgagtaataagatataatttttcttcttttttttaaagaaaaatttctgttgtattaaatgagaaaagttttatttcgtcgattacatgaatttccaacttctggtttgatgaatctttgaaagggttaagtcaagagacaaattatcatcacttcctaccactaggctccaggtgtttacgtagaacacttttctttcctgaaggtggactcatttttctatctcttatcaacatcaaaagaggctccactcttccttcaaatagggtaacaatgagatgatttgttcagtagattgagtaactaaagttaaagggtattatgaagccttggaagttgattacaaatggtgttaaaattcatacacaatgtgtatgtgataactttttaacgtttttcttttttctttttctttctttttctttttcttttttttttttggttttctccatggcttttgtttggacacatctcattttctagatggtttgtgttttctttttcacatggctttgttaggaagcaagggtttattttgagtttttcttgcttcccttagtagtcattctccacatgcaaacattagagatagctgtatccatacaagtgcacctgatcctataggcacacagatcctgtatcttttgaggccagaaattcagtggtcactgaagagctttgctaattttactgcttgaactttgttcccttgtttgctgtgttacccatgttcttctggtctgtctttcccactgacggagaaaagaagtcctaaaaatgaatgaaatcgtttctcaagaaggatgagggcatcctttatacccagtgttgcatatgatgggttctttggctttgctttttcctcttcctcaattctttcttcatgcttcaaattttaaaaagattttttttttctgttatgctggattatatgttcctgtttgccattcctttctcctctagagttctgcatcactttctatttatactttggtattgcctttcttttaatttattcatcttatatttttcctctgctcaacatgtgttgggattagatttcttagcataaggaaatgggatgatctttagatgaaaaacatctcagtgttaaaatgtgaccttaaagtaaggatatttcattcaaccttctgttcattaaattagttctctccaaacctacttatcaagtggtgatcatctagcgtgcttgattacctttaaagttagggaacttgctacctctcaaggctgcctctttcttctaggaaagctctgcacattagaaaattgttccatctgactacctgtaacttccgtccactgtctctaggtcatccttctgggaatatatagagtaattgttttcactttcactcatgatagccctgcaaacggttgagggcaattaacacatactgtttgtatgtatctgtgtttgtatgtaacacatactccagttttctcattttttccccataaaggaacattcttgttattcttttctgaacatgtttgttcgttaatcttttgaaagatgtcacctagaactaaatatcatatttcaagtgtgggttccataaacagtgggtttatcaccttccttgttgtacatatggttccagttatcgattgctgcatagttaaccactctaaaacttaatagtgtaaaaaaactattttattatgcatatggattctttgggtcaaggataggcagggtagagcagaaagtcttgtctctgctccatgatgtctggggcctccactgggaagactcaagcatcaggggatgactttaatacttgggatccagaatctggagctgtttcacttacaaatctggtgctttatcaagattggctggaaatctgggcggatctgggagtgcgtgcactggatcacccatacatggcctccccaggataatcaggcttcttacatgcactcaggactacctctgggaattttctggtaactgaggaggaagctgcaaggccttttttgccttagactcggaagtcaaaaactgctgcttccattatactctaatgagcacattgttgactaagttgatactggcatacatatcaaatagagatctgctgttttctaagcatcagaactctgaaaggacatcccataccattgaactaattaataagaaagacgtgtataatctttctaataggcaacataatagaaaatagatgagttctttgaagccatgggattaatgtggctaaaatgaaattaaattgcaagcgaatacagtggcagttaaccagcaaactaacctccatcatatggggcctcttaactctctcagcctttcatctcctctgcccttgggctgtcctataatggtcaccaattcacctccataggttagagtcctgtcttctccgaaccttcctatggctccacatctggccagctagttaattacagcctgccctagtacttcgaagtcattcagtttacatctacctttctttacagttttctttctcaccacacatccttaaacagttgatgattcagccaagcaggagtaaactatagagcaattaaaggatatatatgttttttttcttaacggattcttgctaatttaggggggatctggatttcaggcatcagatcttcctgctgggtaagaagcacatgtgaggcccccaccacagaaatccttgcctttctgagaatagctgggccattttctttgactctcctggtttctaatttttactggctgtgagaatggaaaatattatgtggtgaattgttacaagtccctgatttggtccccaaagaagagttgttctactgagaagaggaaataaaaggaaattgtatattttttctagacagtgtgtttcctctttgcttgtatatcttctgttgggtagagtatgcagccagtcacagcaaggcattccgttcaatggcattctttgctggaaagcttgtgctgaagaaataaatcattgcgttttccataggaaatgggcttatactttatagcaagttcaattctttccaacagtgtcattcaccgatttccttgagttagagatatatttttgaaccgactggattcattaggtatatgggttagaagccaaattgttccccttttattcttgtgggatattttgctttgttttaaagttcttgtgcttctaaaacttgttccagtagatattatag

SEQ ID NO: 70165 - DNA, 1016 bp, Homo sapiens
agagctcaggctctggattcagatggcttgggttcaaattctggtccgtcacttagctaactggagtcttaagaaaatcacatgacctttaaaggtccagtttcctcatctgcaaaaggtatatttctcatagagttgtaaggattaaatgagataatgcatgcaaagggcttaataaagagcatggcacataggtagtgctcagtaaatgttggaaattatgattaatttcactgtacactttcattttgacattagctgtaggctaaaccttaattacttacagccaccagtagttacacatagaatgaagtaacagagttatatgtcagactaaccaagtacccttgacagtatcattatgtcctcaatatatttatgctgaatattaatcaagtttaagaactgcttataaataatactaaagaacattttaattctctttgctattaaggaggagttttacattgcagcttagaagcctttcttccaatagcagagatttggtgtcatgtggtgttcatcagtttgaaaagaagtatttctgctgtttgcctcaagatgtacatacagagatgtgctgattctcagaacttctatagaattccattagccagtcctgccaattgaaatttggcatttaattatttgcatttttctattcttgcctaggaaaggagctcgtcacatacctagtttagtgatggaaagtatttggagaaagttttagagagtggggctcaggctcaagaatacaatgaagtaataaagttgttaacctcatgtataaaatcctccatccagatgttgcttagtgatgcagctagtgcttctggaggaaaagaagcaagaaccaaataatgaagactacatcaatgggaacaagtgatacttttaggtgttttgttctcagaatattttaaaagaaaggaaattaacaacagaagaaaaatatttccctatatgaattaatggtttttataagaaaaatatctttctggagatactaagattga

SEQ ID NO: 70166 - DNA, 1364 bp, Homo sapiens
tatgcttatcaaataatttttaaatcaccaggtcttatagcaacttaattatatactttaatatttctgaatagtgcagccctttgtgttttaaaatgagctctttgagggttgggtgcatatctcctatttatctttttaacctcagcacctaggacataggagggaattcagcaaagtgattaagagctcagactgcctgggttcaggtatcagcttaatcaaggcaagttgttgatcatcccagccccagtttccctgtgtgtaaaacaaagggtaatcatagtttttgtctggtaggattgtttcataagaattaaatgagaagccatcaaaaaaactttattcagcatgtgtcaagctctcaataggtcataattgttgatgttagtacagtctcaggcccataatggtgcttactaaatgttcggtgagtaggatgacagtttttctttagtgtgtataaaggatggcctttgaatttttgttttccagtaatgaatgtggatttgaattacattctttgacttaaaaaaatccaaactaatgatttgtatttccaaagaggctacagcaggttttttttaaaaagcacaacctataggcatcaaagcagtatttgtaataattttgaattccatcttatgcctctccactaaagaagtaagctgctagccactatcacccaggcccaatagaaacttcgaatgtcttgccctatgttaatgtttccattccctcactcctggaaatagcattctgctttccaaaatagactcttatgctgtaccttagaaggatttttgtcacaattttggatcatcagaaaaacagaagacagctttattggccaaacctcatgaactaattttctaaggtagtttctctttctctctctctttttacaaaaacttattttaatggcctatttgtgtcccattttctttctgttaatttttagtactaacatgagaataaagaaaagtaaaaagtcaattactctatttgtttctttcaagggcatttgaaagcacttaaagtgatacattaaggcagtagggtgtacaactaaagatttactggggacaacaacctgaaatcctaggcttatgtcaacatgggagtaagtacttcagttagaataatagctagcaatgttacataacttaaaagtttaaggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgagg

SEQ ID NO: 70167 - DNA, 5882 bp, Homo sapiens
tatgaggcatttactctttttccatttccatctgctcttatggttgaaaggctaaaactgacaactttcagatgtatcacagagacatatcaaaagaattccaacatgaaaggtattgggttcatgtgcagaagtagtgaataaataagcagggttgggtgaggttaagagagtgccacatgatctatgtggtaataaataggtgaagtgcccaggagagagagatgagcagaagagacctctccagtagtagacattgaagaggaggattttagaattcgtctcttaagacattcactgccaagttccaacagaacatcatggacaaaacatatctaaatgagaaggaaactttgggacattgaggatggcttggagtggaaatgacctggaaggttgcagtgatcccaggcaggagaggacaatggccgtgtctgcagtggtacagtctgagggggaaggttgccgactgacgtgtggggaactgggagtgtggcactggagaagaccagttggaaaattgattgtcctggctgtgacagctgaaccatgaggactgtctaagagcactgaaactggggagaaaagaaagtagcctggacatggtaatgcttaaatgaatacttacatgtgataccgtaattatcaacagatttaaaatctgttgaatatactgttcaagtttaaatctgttgaatatactgttcaagtttatagaagcaagaaacttccccccatatttgtactgtattaatcttttggtttccttgcctcaattcagttttgtttcatatttaattatggggctgaaagtacataagtttgagtagtctagagtggaatgtggttaaatatccctgcagattactttatgtgtttcagtattctaataaaatcagccgcagtgatccatatgggatttgtagatgctgttttcccgaggcccttttctctatggctgtctgtgaccttagccattgactcgcttaatcgtttttggcctcctaagtcagtgattctgagcgggcagagtggtaatgtgatgtcatgtctggggcatgagcctgcatcctcgccgcacaggggtcccacccttcctggtctaggcagctcaatgcacagtgcttggcgcatcgtgagtgctcaataaattcagttgcttttcccgtctctctctggatctcaaatagaaatatccaaatttgagaatgccaccaaagcattaagttccctaattaaagtccatagtaaaagctgaggcagatgtgtgggaatgcagttccagacactgtagttaatctaggagagatgatcgcactgtatttacaacaaggcttcccatgctcatgaatcataagaactcttacaggattaatgagttttaacttaatgcagaatttttaaactatgtgtaatgctgggacatttcaaagtgtttgtcatgaaaaatggctgatgaaggtacacatttcgagatatcctgtgttccacctacgttgtttgttatcttgttgacatcttctgttccttttacaaaaaggtcagaaggaagtccctccacattttctgtagattgctagataagagaaacatcaatatagaaaggaacattttgatagccttacacatttatgtttttcaaaataaaaaaattctttaaataaaactttctttcgtgccctttctctggtagagagaaaaattagcccccttttctttcagagacgtgccttgtgggctttgaccagttttcccctaatgctggcattttgtaaaactgtagaacaagatctcaattaggatgttgacattcacacaatccattcatcgcgattagatttccccagtttcgcatgtacttatttgtgtgtgtgtatgtgtgagcatcaagttatatacaactttatcacatgtaggttcatgtattcactaccaaaggtattattattttttaagttccagggtgcatgtgcaggatgtgcaggtttgttacataggtaaatgtgtgccatggtggtttgctgcatctatcaacccatcagctaggtattaagcccaacatgcattagctattcttcctgatgctctccctccccactccggtattcttttaagactgtcagttgctcaggagtttgtggcacatcccatgatgacatacactaaatttgtcttctctaagtacacaagaactttgcatgactgtaggaatgtggggagaggaattctggcccatggttcctgtctttggctgtgcagttactctttcacattccctcattataaaggtctggctggccctggcaaaatcataggtgggctttgcacacagctaactgcttgcctgaagtaacttacacttttgtactgcattcagagttctgccaacttcagaggccaggaaagaaagaaaggattggcctgggagtgtaacacacctgcttttcctgaaggcacatacaacaggcgtatttgagtacctgcttgccctttgggatatattgaaacacatgcctgtttcgtcctgaagttgtggatgaataccttcatcccctggaaattccttgtttcacatagattttaaatgtccttgcgggcagatattcactgagaaaactgtcctgttaattgtactttggctatctggcccagtctctagaacaattatagtagaaccatgtcatcttgacacatttaggaagatccacatttgagaatgccactgtaatgtttaggttccccaaataaaaatttcatattacaactatgtctctctctttcctttctctctccctctctttctctttctctctctctctctctctcacacacacacacacacacacacacacacacagagcaaagctgtgctaagatgcaaacactaggcagatggccaagttgcccctccaggctaaatgtctcaggcctgcactctagtctgagaaaaaatggatttgcaaacagttcaaactgtgaatattaacatttaagaatggccaaggtctattgcattccactagtcactcttagaatctgagtgtttgtttaggtaaccagaacacagatgatgatgatgatgatgatgatgatgatgatgatgataatgattgatcataataactgaagagtaaaacactatcaatgtgatcattatgggattcttttggagaatacatttagtatatttggaccaaaagccctgttggatcctaaatcccagctatgctgtggcatacaaagagctgttttttctttttttttttttggactaatgctttttgactattggcacttcaaatatctacgaattacaagtgatattctttatttttggtggtaactattatcttatttaaacaaaaatcatgcttttgaatcagctgtagacatttttgacaatcttggaagtgcagaaaaagttatatttgaaagaaaataattatagaatatcagcatatgctgctgttgcttccatagcaaactcctttgggccttactcaaccaaaataaatgtggccacattgctgcagtaagcatggcttgaggcaaatggaagactgcagttctgtttcctgtgtcctgctttctgtccctgaggtccaagcaatgccagaacagtgaatttgaaagtattaaaatgttggtctgtgtggtccttggtcttcccatctataaagctagacttggtgtagagattatatagttaaatcctcttatattctacaggtgacaaaatgaaaacccagagcaattgtgtccagttcaaggccacacaaccttgttagctctgacaagagccaggtttcctgacttctagtccattgcttttccctgtagcgagccgcttcctcttgcctcacccgatcttccttggatttccattgggaatgttgaccacagttctgataaatctcttccttcaggtcctgtgttagtttcttcagggctgccataacaaagtgccacaaacttgggtgctttaccacaacagaaatttgctctttcacagtctggaaactggaagtctgacatcatggtgttggcagggccgtgctctccctgaaggctctagggaagaatctgttccatctctttcccttcacttctggtgctgttggtgatccttgatgctccttggcttttagatgcattgctccattctctgccttggttgccacatggtggtaacagcagttcctgtgtgtctgtgtctcttttcctcttataaggacaccagccatatttgattagggcccaccccactgacttcatcctaccttgattatatctgccaagaccttatttccaaataaagtcacattcatagagacaaggtgggttagggcttcactatatctttttaggggacacaattcaacccataacagttctttataactttaaacctgttagaaccaggctggtatttgtaatgcataatgagaaactgcagtgaatttcattaagtgtaaagcatcatatccaacatttgtagtttgttacaataacacattcaaaagatttatagactgcttttggtgtgatttttggattaattccctcttttgaagacatttgttgggcttagtttattttaaggaaggaatgaatagacctgaaaacacctaatttttattttcaatttagcctggaagctagcaaaagcttttgcagagaactgaaactgtgtcacagagcaccagcactgtatttgttatcattttggccttcagttttattaatgcttgtttgatgtgttaagcccctagctaagacaaaaagacagaactttagggtttttgtttgttttagcagtaataaagtctagaataaaatgtttgctctataatatttaatggtgtgtattcaatttttaaaccaaaatttaaaagaaagaaatcccattctcattcagcactgtcaaatgtattcattcccccagacttcactggttgaatataataatttgtgtgtataaacagtcttcctgactgcattctctttaatattcatttatcaatttgggaggaaatttccaaataacctttatttgcaccttaaaaaaatagttttaaacgaagtcatgggaatggattgctctgtcttttactgacttttatatatgtgattccaaacctccctttaaattaatgtcttttagcttcaaatatacctcttcccataaggctagtccccatttcctataatcttacagacctaggagaacaatattttcccttctgtcgttttgataattacatcctctgtgctcagtggtggcctattaactcacatgaataccatgggcttgcaaaatggcctcaaatttccatatattggaactgtgagaactttctataatggtgctttagcaataatgatggaggtgcaggcatttcctgaggattaatgaccagctgggaggaaccagtggcccttggctctgcctcccagccagccattaattctaaggaaatgtcttttgctgaggtcgttactgctattataagcttaaaatggaaaaacataataggcatatgagttatttttatgggttgatgcagtttccaatggtgtgtactaatttgagaaaatgaatgtgtatacatacaagagtaagtcagattgttagactcatccctcagtattccatatgttttgtgactgattttacagttctctctacctttctcatttacaaaaaaaaaaaagaaaagaaaatttgattcagcaattcctaaaagtattgtattcagtgacatctttggaaacaccagtttctgttatcaacttcaaataatagtcaagttttatgtatgatctaaagggaaaacaagtttgtttttcaatcctgtgataatttttcttttagaatgaag

SEQ ID NO: 70168 - DNA, 1050 bp, Homo sapiens
taagctacagaactaattactgtgaaaagacataaaggaatgagaagaccaaaaccgtatcctcatgatactgacaaatcagttggactgagcacacatgaatcaactgaagaacacttctgccaagttcaagttgtgtaaaagtggaggatatgagtcttgtggggacacagagttgaggcatgagctattagtcagagccgtaaggctgcctgcaggagaagaactttggatggagttttgaaggaagtgaggaaaagatctgaattaacgtattaacacataaagcttgtcatctgaacaggactataagcatctcgagggtaagaacgtgccttttctttcttacacattcccagaagacccacattcctcattgggctctctgtaacagtatttactaagcacttgaataactggacatgggcaccatgttgctaagttgattaaaggttggtcttccactctgccactggccacagcacaaagtgaaaacagatgtcacaagcaccttgtagatctgtcccttttttcttctgatgttcaccctccttttgagctctttctttctccaacattgcttacaaaataatctttatgcatctgagagggagcaaatattcagtaactttctgcagctgtcctcactaaagaggagaatctgttgaatgccactggaaatgtaaggatctcttgtgacagtaacatctcaaggggaaactagtggttaaattgttaattctttgagtctgaaacttttttcatttgcagtgcagataagtgcctgatcttgcagtatcacgtttctgacttctttgttctggcttcattttttttttcccaaaatgccattttcatttgttcttagagttcagaacatgtcaaagagcttctttaagcagtaggtggttttacagagcccacagagaaggaaaactaaatatcatcccggatgcagtccactacgatcgtggaggagtcagattactctccgggctttgctgtgtctgcttgtgaaacaggaaagggagaactgaggcaatgagtcac

SEQ ID NO: 70169 - DNA, 1102 bp, Homo sapiens
ctcactagaatctataggaactgttagcatcaattttaataagttgtcaactaagtgattagtggtatttattggttatttttgacaaaataatggaatcatcaaattttgaagttgagaagtaaagtaaaaatttgtgccaaaccccaaatgtagacaaggtcatattataaacattaatgctgtcccaaactgccaatgcattgcgtagaactgaggttagcaggttaccattgatttcctctacttatgctttaagaggttggcattggtaagccgctacactttcttggtcaatgaggcagaaacccctttgcaaaactctcaactgatgaaaagattagctagaatgactctaggaactgttttctaaggatctgactcattgattcctttttttggtagggttctctgggccaagttagttcgagtatttatcatttaaattaggaaattaccatcaccatcatcatgtacattcataaatcaaagcaagattagagaaggaatatggtggatcacagagcaactcagaaagacgacagcaacaactaggaaatgaaacaccatggttgtatttcaggaaccctacccagcagataggaattaccatagctcctaaaattccatctgggtggttgatggagcctcaattaatctgacaccatagcccatgctcccctcttgctacctgctgaagttagcagggaaaagtcaaagagggtgctgtcagtggggtcaattcttagggatcatagtgaaccaccctccattgcactgactctttcccacaaaatgggctagagatagcagctctccttatgtatttaagaaagaatggtcaaaaaatacaattcacattttattctggtatataccattttgacagtgtttcacaatgtaggtaatatgaatgggagtatttaaacacaatcctgtttaatattcttagccagtacttattaaatgcctaccaagcctggcattgttctagagacctcaaaatacacctttaaaaacatattttattgacagttgtataaatgaagaaaacaagtctcagaaaattaaagtgacttgcacagatacacaagctagaaag

SEQ ID NO: 70170 - DNA, 2157 bp, Homo sapiens
ttttctgctccatgtggccaacccagttagaaaggttataaaaaatcttaacagtttttcagcccttctcacacttagctttaggattaaaagtattggtcatgatttgcaaaaaaaaaaaaagtagtgcacaatattccagctatattcaataaacatttgttgaatacaacgtatgtatatacaggtcattgttacaggtctgtgtataagtaaacacaatatggtccttagctttaagacctttcagtctaggggtagatatgcatgtgcatacaacttctgtttatttttgaatttcaactatgtgtcaggtgttaggctgagcacattatgaacattgtcttgatttattatttaaccttgtacgagccttgtaaggtagtggttttcgaaatatttttgccaaaatgtaaatagtaaaaaacaatatgtgaagcctttattccaactaggtaaaataaggaaggctttacaaaggagatgaatgacacttcagctgagccctaaagaatgaataggattctaatagaacagctgggggcaggcgtggtggctcacacctgtaatcccagcactttgggaggccgaggcaggcagatcaccttaggtcaggagttcgagaccagcctggccaccatgcaaaagcccgtctctactaaaaatacaaaaattagccaggcgtggtggcacatgcctgtaatcccagctacttggaggctgaggcaggagaatcacttgaacccacgaggttgaggtttcagtgagccgagatcgtgccactgcactctagcctgggcagggggagactccatctaaaaacaaaacaaaacaaaacagctggaagatgacatccctgggacagggacttccatgtcatgtgaaaagtaggagtaaatcaatggaggcagggaaatgtagggtgtatttaggtaagagcagctagtttggattggatagtgtacattagagacataccatgggtgagggggtggatgtggacagtgaacctaaacgctttgtggtagcaggtcacaggggccgtgcatacatgcttaaggagattggatgttacaggaaatgggaagctattaaagatttctaagcaagagaatgacaggtcaaatccgacatgatttagaaaaaacgtaggctcagtcagaagccatagtctaatgaccaatgcatcataattacttgctacactaattttcttctttagaagtcagcttttaagatatgtgtttataatacagatttatacagttttacatggttgaaacaaagaataataatatttattatgtaagattcaaatttcagtatcaacaaataaagtattcctgggcccagccgcacctattggttcacgtattgtctatacctgctttcctactacagtggcagagctgagtacctgccacagagaccgtctgcccaacaaagcctgaattatttactctccaacccttaagagaagaaggttgctgactcctgctctattgtgtctttctggccctcttaatccatttatataggtttcttccttttgtgtgtgaatggaaaatgaatttaagttcattagtagaagcaagacacctttagcttggcctccaggtattatttgttttccttctcatgagaattttgaatgttctatatctagattctcgaggctaaagaataatgaagcagaaaatgttttctccattactatatccccttcctatggggattctgaaggtgcggttttccctctaggtgagagaactacattcctttcctaggcagattccattttagttcacactcaggctgtcagatgcacagaacaatgtcacatgggcttcttaagacctcttaaaaatcacttccagtttgacttctgcccatactttactctgttagttttcctcagaaaggcttggcaatagcagaataatctttgattaccaacaatatatttaattttcctatttgataggctgatgccgcagaaaataaccaattgccttctgtgctttgtagctttgtgctccactgcatcatcactttcttgggtttaggggtctgtgggcatagcaaaaggtgtgacagcctgtccttgttagactgaagccagtctgaagtggcagggaggcaacaggatgccagcca

SEQ ID NO: 70171 - DNA, 1119 bp, Homo sapiens
gcttctgcccccttcatccttcctagggtccccctacacaaaatcctctaaataaggttgccagtaacctcttaactgccaaatccaggggacacttctcagtccccgtcctgatgtctcttctgaaatatctgacacatcagccgtgcctccttatttcacacttgccttccttggatgcctgaaggtaaacctgtcctgtgtttcttctcttgtcaagaagttccttgcacccgggaggctcttctttctctacctgccctctgcacgtcgctcgtctccagggttatatctgaggtcctctatttttcattccatgtgttcattctgagttagctctgtggtatctgtgtttcagtcactgcctgcattgactgactgtattcgtagcttatctgagtgccatcatacacccggtcatccttgacttgtcagtctccattttcaacatttgcaaagttctgccatttattactcctaaaggtgcctggagctatatgttttgagttttcttttcctacattcccactgccacattctttgtacaagtctttatcatctctcacttaaactatttgcaccagcctcctactagttttcctgccgcctctacttttctttgtccagcttacctccattatcactgcaagtgttttcttcagaacagacactttatcactctcctgccaaacattttcaatgactaccattcacccaaggaagtctgaacttcttatgttgattatagcattgggcctagtttctaatcttgcctcctactacccaccagttgaaatcttcacttccttaggacagaaagacccgtttttctgaaacttccattaggtctttcacatctgtgctctggttggtatagtctttacctttacttccatttggaccaatctcaacacatctcccaagacccagttcaaatacggtgcccccgccaacctctcttgaaattatttccttcctgtttgcctcatgggaatttgcacacacctgaggtaaaggacttttacccgtctactataattatttgtttacatgtttttcatgcatgaaactatgtctcatctatctttgtattttcaatacagagcatagtgtgtgtct

SEQ ID NO: 70172 - DNA, 1710 bp, Homo sapiens
gaaaagaggagagatgtccagtgtcactattagtgaaccacatatattatactttaatttcccttataaatatgaaaagagcttggtagaaagtaagatatataaagcatgtctacatgtgttttatgatgtgtatacatatatgtatgtagatacatacatatatttaaatgtgaccattatcacattactctgttatattttattatattcatcctcacaaaattcattgttaaagacagggaactgaggatttgttttcaagtcttgcttgtggtatttgcccgtgcttgcacaagagtaacaataatggcagaatcatttattagatgactgaaaagagcaggcacacatggaggtttaacatatggtcgctgtccttatggaattcaaaaatcagacaccaaaaaaggtaggtaacaatatagggcagtttgaggtatgccaattaatggcccacagttagtgagattttgttttttatctctctatagcctactattgcactttgcacacactggataaacatctgctgaatgagtggacaataaaacagaagcaaatttgtactaatttttcaattatgttttcttccttgtatgcattattgttgacaccagcttgttgggaataagagtaagaatttatcctttacagtttcatagatctcatttatcacctacaagaaaagaaaacttatttttgttttataaacttaaaatgtaaattaataaatatataatataaataataaagctatataaataatagatatatgtaatacacagaatttaaagctatataaagtctactacttagttgaagactttgtcagtcttgctgagacacattgagtgaaaatatatataaaaacctttaatgatgtgaggtgaatactcaagaaattttaatcatcttcttttcagtggtaacgaattacgctcatacaacaaagcctaggtttccagcaggagggaaaccatttgaagatgtggtgccctttagaaattgtttagaatcttttcagaaggaggtgtagtgtgactccaggtgcctctctagggttgttgaagtgagtgcaggtgacctctatgtacttgttcttcaagctgctttataataagcagcttgctaccctgatttacccgcagaaccaccttaagacttggcaagatatcttttttaaaaaaataaagtaatggataatcatagttcaaactcatttgtttttctgtatgtatacatacaggtaaacattttcacaagtacgcttaaaaatagtagaagagtttaaagatttgccccaatgggctcatctctcccttttccagtttggtgctccatctcagaaaaagagagtcacattttgagacagatgtagctctttctacagatttttccagagcaagaaaattgggatctcacacatctgcagtacttattttatcttctcatctccctttattcaaccagaaaggttccccgcccccccagtaatacccttttagaattatcatgtagcttgatgctatggccataatgggttttgtcttgttttgtttaatcacagatgtaaaaataaaaagaaatgcttatatttattagagttaatacaagtaattgtcccaaagtagtcccaaattaatttttactcccctattctcatatgagaaaatatactgacagtggctcagtacctgcttgctttgc

SEQ ID NO: 70173 - DNA, 1989 bp, Homo sapiens
ctatttacatacactagagcttgcagtttatgacaactgttagtttattatttcaaagactatactgtgttgcaaagaaatattttattcagattttcatatattcagttttgtctgtttgtttgtttgttttgagacaaagtctttctctgttgcccaggctggagtgcagtggtgtgatctcagctcactgcaacctccacctcacgggttcaagccattctcctgcctcagcctcccaagtagttgggattgcgggcatatgccaccgtgcccggctatttttttttttttttttttttttttttttttttttttttttagtaaagacaaggtttcaccaagttggccaggctggccttgaactccttacttcaggtgatccgcctgactcggccttccaaggggctgggattataggcgtaagccactgtgcccggccttgtctggttttttaatagtaggcctacgtatgccattagtcaactttctgtgagtttgaactaccaacttggtggatgtttttctttttttatttgctttttttctttgaattatttttactatcattagagaatgtgcaaggttacttagtagagaatgagctcatctctgcttcttcagctatttttagaatctgattttttttaaaagtggttggaggaaagaaatgaaactgcattcaactagactgaacttggtcaccattatcatggggattggtgaggttttctctttgttgatgtcttcagttttcaacaaaattgcttctttggaagtttttgctttttctcctaaactggttatataggaatgtagtaggtacaggtcattccattatataaatctgtgtttataaatgatttacttagctgttccagcctgttagttaaatatgtatttaaggcctgttttttcaaaaaaaaaatgtatatatagaaaaaaaaatagaagctcacagaatggatactgagttgctgaaaattagtcatttgaatttaaatcttttcaggagtttttgcattaggaatttacaccatatactcactctgaaaccatggcataaaaagtataattagtcacatctattaaaacagtgaaagaaaatatttggtaattttctattagccaataagttactttgcataaggcaattgtgaatactctttctcttcctaatcttaatatgtacacaactatacattcaatatttctttcaagaaaaccaaatcctacaaccccagaaagagattctaatttggttgttctccatttctctttatatcatttataaagcacgcaaaacaatttctggcctctgatttttgaaaaccataaaatcatttcaccacttaagcccaaactttctaaatcaaatttttactctaagaacaaatactttcaccatttataaacctttcaaattaaggttttgagtagagctttccagacagcctccggaaaccataccccatagcaacacatgtccctaaagcacattatattatgtggtgctctaccatagatgcccagtatttgccacagaaggaacagaacttgtcttaccccatgagtaggccaattggtcagtggaggagtgacaggtgagcagtcagtgaggtgctggaggagggtggatgtggggggtgtgaaggtttaggagtagaaaaaactcacactcggggctctgggttgctgggtgctttctttgcagccctggtttgtgaagtgatttatgggccatacatcaccttcctggttggctttgttgacaccttgtcacattcttgcttgggcttgaggaattcattgttcttgtttgaactgataagaacaaaaacaaaaatgaagaaagaaaaaagaaaggttttctcactgagaccttgggaaaagctaagggggtggaatgttgacgtggagcggcaggctgcactttcccaagcaatgcagccctgcgtctgctggctgctgcagcagcagggaagcttt

SEQ ID NO: 70174 - DNA, 3051 bp, Homo sapiens
gttgcccaggctggtctcgaattcctgggctcaagcaatccacccaccttggcccccgcaaagtgctgggattacaggtgtgagccaccatgcctggcaataaagcacttttaactaaaatatatcaaatttgaaacaaactatatataaagtttttttcttctaaacttcatatttagtaagtgcatggccagaaaaaagagaacaagagtatgtaccaagtaagcaaaagtgtgttatgacatttttttcctgaaacttttctaggtaggaataaacattaatttacatcttcatttgcatgaacacaaaactctactataatctagatgctatacttctcaaatttaaaacaaaagtacaaaaacaaaaacagtaaacactttaggtgaatgttgtgttaaatgtctatattgagcgtatatgtacacatatatttatgcatatgtggatgtgtgtttatacatatattctatgtatatatccttgggtgggaacagggtgcaaagatctaagcataacatatctccacagggatttatgttcttttcagtctggtatcttttaacttaaaaacaactcgatgaatagaaatcataaaagccatccttacaacagcattaaagtgctattctattctgcagcattccaagtgaattattgctgtgctgtcaaagaaaacaaaaacatttgagaaggactgtttattttacagtggttgaccaaaagtatgcaagtggttataaaaaaatgtagacagctaacgatgggaggtgccacttgcacattctgaaatccattcacaaacctttgacactaactcttgatcactggagataatattagaagcaaagcatttttcacggggaaaatcctagcactttgaaagcatttcaggtcaaagcaaataaataaaacctctatccctcatcctgtatcactggcatctcctcactcacagaacctaatggcatgattgttttttcccaagaagagcaagaaaactttgcaaaaatatttctctcagaggttatggcaatgaaggatttttgtgccatgaaacacgtgttgccctttgtatttaaagattaaaataaaaactgctgttgacaatgttaatagattctttcattaaacaaatatttcattttagagctatatgggaaattagagacctcaaacacagtccctgtatattaaagataacaaaatgtatacttagggaagataaatgacttgcttaaggtcacacagcaggtagcatggaaggatgagttagaagtactagttcagtgtttgtatttgtatgttttgcctcagaatcagacaatgtacagttaagacctcatcgatatctcccggtaaatgcttatttaatgtttaagaattttcactggtaaagagattcttattccaggagtctaggtcttggggtttaggtttcttttacttaaaaaaaaaattcctctgataagtgaggattcatttaactttctggtggatcattaggtacctttcaagaaatgagaataatcataactggctctatttatcttagcatgggttgaaagatatgaaaagttccttgatatgactggcacgattctatcccataaaaccactcgtaaatatcagttgaaataatgcctgtagggaaaattttcaaatgtcctttctgtcaatgcagaaatgccagtgcagcttgttttctgggtggcatgtaagttgtagacaggcaccacattttagacatattatggtggtgcggtgaattgacaggcagtttaccaccatttccatgtattagattatgtgtacctctggctatcctgacactttgcccccaaagtggagatagtgaaagagaaggagagagggagaagaactcctcgcatctgtgcccctacctcagcagctcctcctccttgtctctgagggtctccagagtttgagagtttggtgtcatgttggcccaagagactgttgtccttttgacagctcggctgtttgtatctccagaatgaaacataatcagatttttttcagatgtagcatctgccttccctccaacatccttgggttaatcacgtgcttgctggccaggatatgtaaataagacttggctaaaaaaaacccttaaaggattatgaagcaatcttgcttaatagtagcagaacaaaacaaaacaaaaaaccactccaacaaatcctcctgtgtgctaccaagtaatggaaagatccagttatgactggaactgtcctggcctgagtattgtcctggacccagagggagcgaaggagggagggagggagggagggagaaagagagagagagaggggagaaatatgagaggaggagagaaattgctgaaggagagcttcactcactgactccgcacacattccctcccagtggttgctaatgaagagcccgtgctggtgaaggaagcctgctgatcccggaactggccttgcgcgcaagtggtgggatgacagacacattcccttccttgaactgcactcttttcccttgcactcagaggtggcccgagagagccccggtaggtcccggagtatgtttccatgctgcagaaggcatggagagattccaattgcgggggttcctccgtagcctttgcagctgaacgtctccatctcctgtccctgggcggtcagtcgctggcatggctctgtggagttttacctcccagttgtctatcaccaaagctgtccaccttgtccggaggggaatgagcgtggaaacccctggcggctgtactgacaaaagcaaccttagtcaatgacagagctgggcaggcggcgaggtcttgcgggctggcctttctgctgctggtaggaggatcatgtgctgctatttcggaggctcctgccagttggcccctgcccaccttttctgttcatactgaagcagccaggaactgagagaaagaggaagcctcggctgtgctccgggctgcgctgccagggttgcgtctgtagcaggtccagcagcaaaaacaaaacagggcagagcccagggaggccccagcca

SEQ ID NO: 70175 - DNA, 4532 bp, Homo sapiens
ggattacaggtgtgagccacggcgcccggccccgtggtgtgctaactcttatgacaatgatgacatagggacccagggaccaccctcccgttagagatgcaccatgctcagcccgtctaacttcgagcctgctctttccaccaataatcagctgccttctgtgtccacactaggaggaaggatatatgcttgatatcttgttttattatactgttgaatttcatcatcaccctactcttacccacaaaaaatacccaaagtcttaaatgtttcttaaaagaaatattagttgtgcccattttaatctcctgaactttatgacccttgtccaatgttcaactagacatttaagatttctttcatttggcttttggtaagactcatttttggaattaatacaggatcactgtttgttctcctcaagtcccagaaaagaaaaagggactttttcctacaaatcaaacttcagcataccacgagctgccagtgttatttgctatttgttccttgtcttttccaacaaagtgaccttagcactgaatcaggaatgcttagatgtagatgtgcacagaggaccctttgtagtaaatatattgtaaatacatatctaataggtaaatatacgtgtatatgtatatatacccacagatttttaaaaagtgaatattctagagagtttccattccaagaatgctcattgaaaacacagtacacaaaaggccaacaaggaataggatagaatattccagctttgcagaatggtgagtgaattgggctttgactttaaagaggtatgtaggtgaggagttgctgacaaacctgtttgaaagtggtttatgtcatgggaaagtacgtatcagggctgttgcgaggattatcttctttctttctcacagcaactcagtgcggtagactctgttatcatcctcatttcactgatgaacaaaccaaggcacaatgaggtaaaggcatctgctgtaggactcaatagctgatgaatgaaagagccaggcagggcagactggcttcagaattgtactgttttgcttcctatttctccctacatcctagccccactcacatggaaatcactctgaaaaattcttctgtcttattccctaaagacagtccagccatcttcctcctaattcttacccacttgtatttcttctataattgctacaaaatggtcctatacaacaacaacatcgtcaactcacagagtagaaaaaaagcaaagaaccttacaaattcctctgggctaattttatcagcaaaacactcagcaaaatgagagttgcccaagtcctgaaaatcattatgccacaaagttagtggttaccaagttcagcccactatttaagtatagtcatttaaataggccactatttaaaacattgtgttatcctcatatactcaactcaatagtacagagaccatgttttatgtctctttgcacgtccagcccttagcacagcacctgaggcatattcctcaacaatttatgcttgttggatgaatgatggactgaataaattaataggtgttagcttttagttttttcaaaatcatgcttacttattcattaatatattcttgtgatttgatcaatgcaaagaagagcaagatcatcatctagcattatcctgaatactatttaatatatttctataacgttgcctaaggtatatatcttttgttttgttgttttggaagctatactacacaattgactcaagcaagctacatataccatgaaaatcagcattgttctccctcacaacccccatgcacacgtactcagctttcagatagacctgaactccatgaaagggaagtccttcttggattaagctgagattgagaggactattttaccgcttcttcagtatattctttttttttttttttgagatggagtctcactctgtcacccaggctgaagtgcaggggcgcgatcttggctcactgcaacctctgcctcccagtacaagcgattctcctgcctcagcctcctgagtagctgggatccctggtgtgcatcaccgtgcccggctttttttgcattttttgtagagacggggtttcactgtgtcaccatgttggccaggctgatctcgaactcctgacctcaagtgatctgcctgcctcggcctcccaaagtgctgggattataggcatgagccatagcgcccagccgacttcttcaatatattcgtatatgtgaattgagccttccatttcttcctttacctcctctttcatccattggaaccagttgactttttaatgtaaagtatagaaactcagccgctctgaccctgttttgattccaaacccttgtacctaccagaccatttaggaagactgggataaataagcattataactccagggagctttctgatttcatgatccatttctgtttcttaggggccagacagtgctaggcttacaggagactcaaaatctgtagttaaccacagcaataaatgaacacaaaggaaatgcagatgtaagtaggggataaactttgagtggttccatcagtagtgattcatgatgttgaactacaataatattttcctccacacactctcccagttcccattgtgacactggagcagcatttagggaagacagttaggcttgggggtgcgttctgtggtcatggctgtggaagattggtcctacggctgttaatctggctgacaaatgtttcatcaacatgcattgttgaaagtgacatgatgcacagtgctggttaagagtcgcgtaaataataaaatgcccaagatgggagaagagcagttttcctggcttctccaagtttgagctgcagaatcagaagcagtagaatagagagagaagagacaggacactagcttgggttccagccccaactctgctgccctgtgctgcgtggctgcagcaagtgacttatctaataactgtgggtctcagtttcctcactcatagtattaatgatcatttctcaggagtattaaataagagcatgagtttaaagagcccagtcccgtgcccagcacaacggaggctaccctccaaaggtcagtccctttttctgtgtgtttcatcctctcttggcagcctgtttgctgcatctctcagctgacttttgtcccttcctgctcacttagtcaattcagagattacagtttgtacaataatgcgctgccttgtcttctcgctggtgaatctggaccggagtgctctgcctctgcgccgacactcactctgatggtcttggctggaggacagaggctgctggcaaaaacctaagagggaacataccgtggtagcagcatgaaagaatttggcaaggaggtgctcgtcacatgattgtgattcatactgtactctcaaaatgtggcaggagggctaggagagacttttaatgccagcacacagagcagagacactcattttcaaacatcacattctttttatagtacaggcatgcctcacagggaaaatattgaacttggcctgccagcaccacgagagtcgtcccaactgtgattttattgcttgagtcactccctgaatcagatactggctgcacggaggaagtcttctattagggatgctttgaaattgtgtttttaattaattaacaccaactctggacaggtttttcatttactcctagctgactcttttttgtcttttctttttttgcctgaaacttgttagacatttttgtaaggtctcagttggatcgcttttaagtatcctggtgaaagagtcatctgtgttgggtgaccaaagcgaggggacccttcaaagtagagtttgtcatctccgagagaatctgatccatgggaatggggtcgtcaggaaaacggtccctaaaagtctggcatagcactttttgatgccttcagccgtcctcaatccattcatcctgttgttaaaacttaaaactagagctggccagctgttgagaaaagtcctcagttttatttcaaccaaatgatgctgcctcctggggctggaagggggctgacttcaagcacaattataaatgtgtagctctttcaagcggcggaaacctacaaaatggccttgattcacagggcccctctggctcaaagactctctgcttcccgtgtgtcataaatctgtatctgcatcaaaaagtgtaaagacggcagtgtatggaagtccctcttcctctgcgagtgtgtctatgacagatttatactgatggctacactgcaccccggtcacaggctcctattatagtcatgccccactgactcagcccccatttcctgtggaaggggagacaaggtcctgcatgaaggagggtgaaattacagctcaactctcgaattgctgttagtacaggaggacctttaagggctgcagcaagacccattttgttcatagcaacatctactgtctcctcaccccagtgtggtcacagctaaaacctaaggcatttagtttcatgacaagatatgccatgacagggtactccagaattcaacaaggccaaatggata

SEQ ID NO: 70176 - DNA, 1277 bp, Homo sapiens
tgtagactttagtactataaagaaatgatacatagaggggagtaaaaacttgtctagctaacaattggtattataatggttttgaatgcacagttctgattaaattttatacatttcttccgttggccaacttatcgtgagcctggttgtatgcctctggtgtttgtatgatattcactgcatttttttctaacgtgttaaggattctattttaaatagaaaatcagattgcagtttgaaaaacttagttttaaaactctaccatctgctagatttgtggaagaggatctggtaaatgaaaattgtgtgtgtatgtgtgtggtttattttataggcactgcatatttctttgatgatctattttccaagctcattcttatcttttagaagatgtttcaaggatttatgcatctggcaagatttcagagaactctatagtggtggagatgtacactccatttatagggaatcctgaatcagggtcattgagagcatttattttgttttgcgcttaaatttatttctgctctggacatttctttcaaatggatcatttttacatggtcaaatctaagcattttattcataagaactctaataataaagctttttcagtccagacataggtggaaatttgcaaaatgcatcaggaaagtatggcaattgcttttcaagccatcttgtatttgagaaagtattgcattcattagtgtttgcaaaactacctttaatggtgcaaaagtaaagctgacctctcccttttggtgcacagatgtataaactttatggaagtacaccccaaggtagagacttattggagtaactcttagaaagggcaaagttggccataaacagtgatgcaataaccccacaattatgtatgctcaattatttggaagggaagtctgggagaagtgttttatatgattacatgggcaaataagaagtgagtgtggagaagcacggtccaaaggtttgcatttgttgtgtatatcccaaatagcaccctaatacagctttataatgtaaatccaccggtaccagtaaaacagcatttaaaacaaattgtaaaatgaacaacatttgcaaagcaataaagaaaccacctttgcaatcactttactacagttttgaaaaatgttagtgaatagctctccaaagatgcaagtaaataatattttattagatttcagcctaggagaaaggggaggaaaaccttcaactagaattacatgattattgctttgctcctccctcaacccagcaaacattaaaat

SEQ ID NO: 70177 - DNA, 1051 bp, Homo sapiens
actttttcctaccagacaaaactgaaagattttgtttctctaggaaacatacttaaagaagtatagtagacctggcattccttttgcatgctctggtagaccccggctcttgtataataaaaacaatataggcatgttatatttgccatatgttagttagggggtttcagcaaacaaatacctccttgtgcacagaagtagatgaaagcaaagcttactgatgtctactatgccttaacttaccttctttgtcctacatagtctgcctagcagacttctttctggttggttgtatgcatatttggataatggtgatagctcagcatattctttatgctttgttccgctctgaggacagctagtacactcgattcagtattatatgctttcctatttccttgcctgatgcttctgtgttatgctaaatctcagtttattctgtcagtaaagttgaggagagtgagtgaggagtgcgtttgcatgtgtgtgttttcttatctgtaaagttttaactttggcttactgtttaaccaggaaactcagcaggacaaaggagatctaaataaaactatattcctgttgagaatctccaaggttatgcaatactataaaatggtggtttgagtagaagttctgtagttcatccttatcagactaatggttttggggtttttgaaaaggaatgtttcaaggaggtctttgaaaaccattttcttcaaatgttcattgcatctgagatcccatttttgtccctttatttgctccagaataccgcccaactgccaacaaagaagggcttgtgctcccaggaattttctgcattcctctctggagtaggcatttttctcagctacaaaggccctttggcgaattccctctaatcattggatttgccctgggctctgataggtgccattcatggacttggtctgctgtttgatggggctgaggcattaatgggatcttttcatgataaacaaaactgggtaacattaccagagggatcacaaagctgctgttgtagggggagtgtggtgctttctctctcttt

SEQ ID NO: 70178 - DNA, 1984 bp, Homo sapiens
ctacttgagaggctgaggcaggagaaatcacttgaacccgggatgtggaggttgcggtgagctgagatcgcgccattgcactccagcctggatgacaagagcaaaactccatctcaaaaaaaaaaaaaaaagttaaatgattcatccatcggaagggatagcacagtgccctcgtgtttccaccagccactgatgctaattcttcattttaattttgccttgacttcctggctaagtgtatgtattttaatatgagtttcagcctccaactaaataacaaacaggacaccaggcttctgtctagccaaggtgtcgtgatgctgtttaacagcccccaaatccctacctcaatacattttaaaatatccaggtgctgtaagtcggatgggaaaaagtttgaggagagaaagtcattaccttcggtagagcagcactttattcattttttttttcaggttttgctttttgattaatgctttttgttatcatctgttcagtataacatattgtaaatcataaactcagggttcagatctttcagagacttttgcaacttgaaaggtggagcttcccagcctcaaggaaatctgcagtggctagtgtttcccacagggccccattacccagtcctggaaaggtgctaacgaggcatctttttttttcccagtgaagaaaacatcatgcattttaaaatatcggtgttatctgatattcacatgtttcaaacatatggttatagtacatattcaacagcccttaagggcttaaatatcctttgtatgtactataatcctggtggtagccactatacaatgagcacctactatgtccagcgcatgattcacattatccttaatcctcctagcctccctgccaaatcatgttacgattattcccattttaaagatgaggaggccgggcgcagtggctcacgcctttaatcccagcactttgggaggccgaggcaggcaggtcacaaggtcaggagatcgagaccatcctggataacacagtgaaactccgtctctactaaaaatacaaaaaattagccgggcgtggtggcgggcgcctgtaatcccagctactcgagaggctgaggcaggagaatggcatgaacccgggaggctgagcttgcagtaagcggagatcgtgccacggcactccagcctgggcaacagagcgagactccgtctcaaaaaaaaaaaaaaaaaaaaaaaaaaaaagatgaggaaactggggcttagggaggttctggtgttaaaagacaatggagtcaatttccaacgatgcctagcaagtggcactgactgtgttcatcctattttgccttctggtcagtttataactcgtgcttccgaacagatgaaaacttaaaagtttagttgaatatccaaatgtttccaaatatccttatatttcatagcttgtagtttatgacacatttgggagcaagtcctttccaatgtttatttattctctatagtacctacatttaacttttttctcccataatgacttccgatcctacttctccctgattcagtattcactccattacttcactggctctcttccttattatctgtcacaggacacacgcactttggaaaaatctgccttgtgatatgataattgcaggatgttttctgaattgcagaaggctggagtagagggggatgagggtttgaatcaagtttatctctggatgagaggaattttggcctgggaaaggaactggaaacgttctgaccagctttccgaatgctggttaaggaaaagcctaactcactctagactgtgctctgcattctagacattttatcatggtctgcacccttcaggatcttatattctgaggaagaaagtgattatttcccaggttgtgttatttttatgaagataattgaagctcttttatctctggatagttttcattttaatttatagatatcccactgcatcttaggaaagctgatatttttag

SEQ ID NO: 70179 - DNA, 4096 bp, Homo sapiens
gtgggagaggtgaggggactgtcaggggtcacttggggggtcagtgcctccgatgatagcatcttatgggcatacagatttgttgccattttatgtgagctcttgaaggttgatttctacagaaatgggtccacagtagcccagcaacattcattaataagtgtgtaggtacatctttgtgtttattcatgggctctgtagctttagaaggaaaaagctaagcacaagtgtcttgctagtatgttgtttcacttcccatacttcagcaagaaggtgactctctagtcttccctatcatcagcatttagaatccgggtggtgagttagttcaactcatagaatactcttggggatatttttgtttgatgctgattagggctggtggtacccactagaagggtagagggggaaagaaacagggcattagagaagaagatcataaagaaaaaggttaaaaataacaaattatgctaaacattaagttctgtagagtaaggattttaagtttttttattattctttgtttagattgtacgttctttgagggcagaaaccatgcttataagatattacaagtctagaagctgatgttattgtctaatagttattctggaggttcaacgtcaaatatagtgtcctaattgctacaaacattaaagatcaagaccctgtggaaatgggtttcttttccaattactgatcacctccagtgtgccaggacctgtgcaaggctagcatttgactccaaaggtgtatgggcattccctgtacctgaaaacgagtgggagccaagcatgtgaactgttaacttcaattaaaaggggttgctgggtgcggtggctcacacctgtaatcccagcactttgggaggccgaggcaggcggatcacgaggtcaggagttcgagaccagcctggccaacatggtgaaaacccatctctactaaaaacaaacaaacaaaaaatacaaaaatgagccaggtgtggtgatgcatgcctgtaatcccagctactcaggaagctgaggcaggagaatagcttgaaccagggaggcagaggttgcagcgaaccaagatcatgccactacactccagcctggacaacagagtgagagattccgtctcaaaaaaaaaaaaaaaaaaaaggtggggggtaaagtgctctgatagtcatatgctgagagttctgggcctctcagcgtttgtgcaaagttaggggatcactcaacaatcaattaactagcataaaagagcaattcagagaggagtctatgcccctctttggagggacctaggaggcctattctttggggagttcttcatcaatgacagcgatttgagaatagggaaccgaaagatagggtggccacttacaaggcacacaagccaacgtttagggaaattggtgattaacaggaaattattggacaagtgcttaatttttcaagtaaggatgtttctaggtaacaatcctgttgtggccgcatggttctgggaagtggtagacatgggattaagcagctgcactggatagtaatgatgtaattgggtttccaacataatttccagtccttctactgcttctgggtggtttcaacgactgtgtgacctaagtttcattttggcagtccatttcagctgtaccattgcttttcaaccattacaaaggtagcttgactctctttttacacttaattactcaaatctttgtcctttaaataaaattgagatatccgtagagtctgccaattaagcatttagaggaaaccacacactctttgtggagaaaagaaggccaaattagacaatcaagtgtaccaagaatttgcctaaatttggtataattttgttgaagattaatttattttcatggtgagttatggtattgcatgaaaagcacactttactttacttgtacctgactgtcaaacagccattacatgcgaagggcagcctgtatacaggctgggtttccccttcctgcttgggaacaggtacggggaactgttggcatgagttgttctccttagctcggcatatctcacacacatattgtagttctattctccagtctgtctgttctactcagtgtgatttcttactcatacattccaacatctctagatttttcctaatctcttcaaagtctcattcagttgtcttccagatatttcccttcacatcctttcttttttttcctttgcctttctctttgttattaccctttctacattttcaaaatgagtttcatatgtctccagttgttgctgggaagtagaattagatggtcctctcttcgttcatccacagccattttagtgcacagtgttaaaattatttgtttatgcatctatttcttccttgaaggaactttcatccttaatgtcttccttggcatctaatggggacttaatagatgcctatgtttttaaccattgtaattttagtaagaacgtttattctgctttcctgatagtcaattcacaaacagacttttgcaacccaactcccatatagactgaggagtttctgcaatgtggtcaactacagcaaaaggctttttttgttacaaaactctaatcttcatctactttggcccgacctgaattccactataattacctttacaacatatatcctaccatcatcttaaaaaggcttacttctgaacacatccgctggcagaagatttgttttgctttcttttctaggaaattgtagcttagcaaactatgagactgtctgactttaatttttcttactttctaactgttgatctaatttttttaaagtaaatagattacctttaatttgcttattatgctcaataatcacacattagcaatgtaataattttaataacagaaagtacatctaaatctctactgtttgtatgtaagtcccatacctgggagccacaatactttcaaaagtgcacatcaaagtaattgttttgtctggcgccagcacaaatttctgctgggaactgccccatttaatataaattatattacctgtggaatttaaaaggatataaggtgtagtgtgccctgcaggcaggaaatttaaactatggattgccttcttttttttttaatctctgatttattcctgtaatgtggaatatttagcatccctaatttccatttaatctttttacaggcatattttgaatttttcagtcatagggaagacaaagttagaaatgctattattctctcaggctaacttgagaatgaaaaatatctaaagctaagggtgaagtgggaaagagatgtcattatctgaaggagtctatttagaaaccaaccaaccaacaaagaaaaaaaagggatgatgaagaaaaacagggaactttgacctaatttaaccaaaaaccatcaagcctcaaacctgatgtctttgcctcttttttgcctatatagatgtgaatgtaggagtagcacatccacgggcatgaatatggagatataacctcatctctgtaaatccattgaacatagttttataccctgcttagaggaccaagatgttacattttaagcctgtaggagtaaacacatgcaaacccagctgttcaggtggagacctctggcttccacattcacaccctcggtgacctatttggctcacgtagtcctctcttaggagatggctgcatgcacatcgtcttggatgttgaatgtacagaatactttcactaggaccagtaaaaagggcaaataaagctaacagcacaaaagaggatatattgaaaagaggtagagaggaaggaaggagagagagcatacactagagaagaaaactagaggagctaaagaccaaagcaatgaagacgaggctcctgtccacctcccctctttgtgttccaggtggttcttacactcatttttactcagccacagctgaaaacatgctcctttctctgcccttagtcaggggaagaggcctctgctcagtctcttaattcagtcattgcctaaccattctcatgaaacaggtccccatcaccaagagcagataccttctccaggtctttttcttttttgttcaataatccaagtattctctcaaagactaatattgcagtcatgaacaa

SEQ ID NO: 70180 - DNA, 1315 bp, Homo sapiens
cagccttctaaaaaccttaatatgctttcagtcttccctggaaacaggtgatagggtaattagcatccacatcctctactcaacagagcagcttctctgctggcacattgcttggcaggactccagggaaagctgtgtgatgacagcaagattaagatccaggaagcaaagccgggtcatatgctctaagttgtccattccttctattctcttagcatgttcgattccacaaacacggcttattccaaaagccaatcctcctaatgagcattcggtcattagaattttcatcaataccaaacggaattacatttggggccccttttggtctttcttgtcatacctgagatgatgagatcctttattctctaagtgccccttatgcacacacagaaccagagcatccgtgtagaaataagaacttaccatggtaaatgatcagtattgttgaatctccaagatgtggggttcaccacatttaactgtatgtttattaacaattccattctaaaaattatgttacaagcatggccaaacagaaatgaaactatgatagtggcatctctatactaaaagtctactctctatggatctggccatatctacacttatagataatacgttgtatggaagttctagtgtcagagcttcaggctggtgatccctgatttagatactgtattaactatatctttccactagtctttctgtttatgttctctttacaatccccaaacacccaatagtttgcaacccttaccatacttcacagaatgattcttcaggtaaatgataaatattaaatttttaaatttatgcatattattttggtaagctaatcaaattttttatgttaaagtgaacttgatatatttttatattctgtcatttatttctccattaagtgcacagctttaaaaattttcagtgctgcaaaaataggccaaaaagtgtgacctcatctattttaaatttaaataaatgaatgaatatgcaaatgaaagaaagaatgtcccctgggagcactcttcatggtgggcctcagcaaaataaagaacaaaagcttctagaccttgcttcctgctcctgctctgtctagaacccttctgaaaatcatttcctccaatctgtagagtgtcaggggagtcttagatacttgggtcctttgcattgtcctgttcatgctgaattatcagttttatttagcagttataagtgattcacattgaagttaaaggaacaacctgaggaggtattgttcacagacagccaacactcagaatgtgattgaaagcataggttttgattctggaaa

SEQ ID NO: 70181 - DNA, 1048 bp, Homo sapiens
cacactgacttccacaatggttgaactagtttatagtcccaccaacagtgtaaaagtgttcctgtttctccacatcctctccaaaacattttttaaaaagcatgttgcagggggatgaataaagacaattatttcaaattctcaacattgtgttcaaccctaggctccataagtgccaggaaatagtgaactgatgtagaggagagtataacgaaagggaagagcaagggtaaccaacacttcttagagcactggtgacacatcaggaacactacacacatcagctgtgatggggaccctgagagacaggtcccatgaaccccacctgacagatgagggaacttacgttcagagaagtcatgagctctgagtggggtcaaacagctagtgagtaacacggcccagattcaaacctaggtctaactacacagtccatattctttcaattacaccctgctgcttattaaaaggctgaataatacaccttatgagaaaaggataaaggaagttctataactcatgcttgataaaaatgactgaaaagtgatataatgtttttgaagtactgtctaggaaggactaacctaaaggatggtaaccagctgttttgaaatgggctctgaagaaataagattagaaaatgggcttcaactgcaacaagaaggcaagtttccttaccagaaggattgcacttattggactcagtggctgaggaagactgggggatcttcttcctgtgcagaagtcaagatgactgaccccggagaaaagcggagaagtgaagtttgtttaaaatggggaagaccactgaaggagttgaccagagaaaaggaaggagaggcaaactgccgcagaatggtacaaaatggcagaaggaaaaaatagcacaaaatggtggaaggaatggaggaacagaagaactgttgtgtggagaactacacagaaaacaagagactcatgattataagtaattaattaaaacctttttgttttaataacgtctagtgtaactgtgcttgtgaagcaaattcctaccacatctcctctg

SEQ ID NO: 70182 - DNA, 1034 bp, Homo sapiens
ataaaacaggcagaagggagaaaaggaattgagaaaaagaaggacaaggaagagacagaagggggaaggaaagagcagtaagaactgaaaaaggctggagtttcctggagtgtgcagttgtggagccctagatctgtgggtttggcccttactttgctcgtatctctagttgtttctttgacattcatcttgtgtctgtgatgaaactttaagtttcttagtaaagacaagaactactattgtgtatctctttagtacctaatacaattctacaagcatttactttattcttgataacaggtggagagaaagaaagcaggttttcagtaatttataaaagtgaagaattatctagaaatgtagtcagtgaaaacatccagttttgataagtcaaactaaaacatccattcttcactcagagtaggcttttaaacttggattttctaagtaatttactcaaagccctctctctcaaagaccctcttgtgaaatgcccttgtgaagtgcttgtgaaatggccttttgagttagctccacaaaatgtccttcctaatcttagcaaaatgaagaaatgggtcaaaatgatttgaaatatgcttctctgtctcttccttcacctctttttggtttcattttcgtaagagtacctgtcagcatttgcagaagaattaaaggcagtgtcgttctggagggaaatcacatgttcctttaattttgtgatggaaggacttataaagagaagtggagcttggttagaaaggggagatgtgcacataggaaatgtaagcagggctggtgagaaaacttggtggtggcgtttaattaattttgaaactgggaaatagttctacagttaatctgtaagtttttttatgttgaatgcttggaaaatttcaacttttttattttcagacactttgtatgcagtgatgacataaataagaaaaatggccttgaaaacatcaaaaatgtaattttcaccttcttatgctttaaaaacacctgaatgcacttttctcaaacttttaagaaaa

SEQ ID NO: 70183 - DNA, 1043 bp, Homo sapiens
aacaaagcacataaaaaatcctgttctggttgccatacatattcctgtgcagctgaaactagaattccaaacgccacagaaacggccaggcttaagtgactaacttgcaaatcagagagtgcaggttttacattgataatacagagagacctgtaatcattcatcacagtggtactacatttattgatactgagcactgcaaatcataaacaataaggattacatgaccactgctgctacggtgactactactgccatcaccgccaccctccctagtgctattgaataatgcttattaagttctttcagccagcaactgtgctatgtactttagtgtcattcatcatatttaatcaccccagcaacccaatgaggaatccactttatagaattaaggaaattgaagtttaaattgctaccaggtcacacagcttacgcatacctggtctcatacttgatctcagaggtctttctggccccaaagccctgttcttcccccactatcttgaacttcctttccctgtatgtgaagggaatggaactcaccaggtaccaagatgtcacctcctaacccttacaaagcccagtgagttatttggaggagaatttttcccaaggccaaaaagctgcccgtgtaatactccaaagtaacttccatatcctggaaagagcaactacaatcaaagatagcaccttacaaacatccttcttttatttaaaaaaattaatttttttttaaaagctaccaccaccaacagttcttcccaagatcagagatacctgcacatctggcaataagcccagacataccaaactgtgtattatctagagccagggacttgaataccactgcatctgcagagagacaagcatctcatttcaatagacaacttgttcctagagtgggatactcccctgctgaactgacagggagccggaagagcggcattgaacaaagagaatagttatgactgggcagcagacggccccaagcacaaccccaggttctgctcttcttcaacttaaccaagcagaactgcagt

SEQ ID NO: 70184 - DNA, 1133 bp, Homo sapiens
caacataatgaactcaaaatctcagtgcattgaagggtttgcatgccaagttgaccaagtgcctaaactgtataaactccctatgtgcacacttagaattggatcatcagatttgtctaaacaacttgaaaggctttgctatctgttcactgaacagtcattatgatgtacacacctttaagagggactcagcccctccacaactgataatgaaggaagaatctccaagtgaggtgaggcagctggactttgcaggtctgactcttgtcccctgcgattcacttttcatcagcaacctggaggaatcagaactaggccctgctgaacaatctggagatgaaaatcaaagccgggaagtacagcttctcctggattggatctcgatttgacttttttcttttttctttttttcaaggaacagactgggtttcttcagagcattatatcagggattaagagaatcagtagactcgggttgttttggttttagaaaaagatctcagacgattatttaaattccctatgccttggtttccctgtgagaaaatgaaaacagtaaggcctggaccctcccagtaacaaaggggcagatgttaaaaatataaaggattctagctttcatataggaaatgcatgtgcaaaatattactcatttattaaggtgcatgaaaatttactgttaacaacacagaagactaatatgtatcattgatgttattcaggtcttataaaactctagtggccagtcgtgtttttaatgccaagaaccccgaggagcaactggtttctaagaatcaacacttagttctgagccgagagatgccccaaggaagataagagacttacagtttgtttggcgtccaaaaagctttccagacagcagtttgtttcctttccctttttatgaatggtggtagtattatgcttcagtctgcgttttctaccaaagccattcataaaaataaaaacaaaacaaaataacaacaacaaaaactttctcggcacagtctggagccattgggtgccagaggctgggaaaacatcctggcagccataaccccaaccaacattgaaagtattcaagggtctgtttgtttggtggtctgaaaagtatgaagtgctgtgtctgaggg

SEQ ID NO: 70185 - DNA, 1049 bp, Homo sapiens
aggtcctgacacttcaatgaggggaaagacaatgtctgaatctctgccagccctggctcccggcctagtccgtgtcacggaacttctaccagctaccctcagacacagcacttcatacttttcagaccaccaaacaaacagacccttgaatactttcaatgttggttggggttatggctgccaggatgttttcccagcctctggcacccaatggctccagactgtgccgagaaagtttttgttgttgttattttgttttgtttttatttttatgaatggctttggtagaaaacgcagactgaagcataatactaccaccattcataaaaagggaaaggaaacaaactgctgtctggaaagctttttggacgccaaacaaactgtaagtctcttatcttccttggggcatctctcggctcagaactaagtgttgattcttagaaaccagttgctcctcggggttcttggcattaaaaacacgactggccactagagttttataagacctgaataacatcaatgatacatattagtcttctgtgttgttaacagtaaattttcatgcaccttaataaatgagtaatattttgcacatgcatttcctatatgaaagctagaatcctttatatttttaacatctgcccctttgttactgggagggtccaggccttactgttttcattttctcacagggaaaccaaggcatagggaatttaaataatcgtctgagatctttttctaaaaccaaaacaacccgagtctactgattctcttaatccctgatataatgctctgaagaaacccagtctgttccttgaaaaaaagaaaaaagaaaaaagtcaaatcgagatccaatccaggagaagctgtacttcccggctttgattttcatctccagattgttcagcagggcctagttctgattcctccaggttgctgatgaaaagtgaatcgcaggggacaagagtcagacctgcaaagtccagctgcctcacctcacttggagattcttccttcattatcagttgtggaggggctgagtccctctt

SEQ ID NO: 70186 - DNA, 1053 bp, Homo sapiens
atgtaaaacaaatatttaatcttatcctatattttaccaattcttaaacatcaaattttgtccttccaactgactgtctatattctgttgacaccagacttatatttaatgattcatgactggaaacatatttcttcattgaacaatttcataatatttgatgatcccaaaacactccaaagaatgctagaatacttggaaattaagttatactaacgtgcagactgatgcattcttagatcttatttaaataactgaatcacagtctctgaagtttttggcaacatcaaattggaaaatagctctacgtctcttgccccatattcctggagcaccttgtcctcactataatctgtacatagaaacattaaaaaaacatatttattgaggaagcatatcttgaagaaaacaaaactgaagtataaattaaccaggattgctaataatgtgagccagtattaaagtataagaacgtcctgctgttctcttcccttctgtatgtaaatagtcattggagatccaggtggtatcatgctgaacctgctaaaataagtagtaagcagtgtcatgagctatcaaattaagtagaactctttcatgtaattttaagtatccatgaaatttttttccctagaagtctttacaaatctaccttgcatcctgttttcttaggtcaatgttgccttgcctgggaaggaccacccgggcaatcttatatatctactgttctctaaaaatgccacttagaagagaattgaaacttccaaacacatgaaaggatccaaggaaagtgtcttcaaacaattacatatgagctttaagtggaataaaaacagagttaccatgaaaaaaatcattttcattgctgctcccatacctaaaagctaagagtgggagaggggtgctaaaaaaaacccagtgtttgtgcgtctttaagcaatatttaaaaatatatacatataaacaaaaacttgacattttcattaggagaacccaaatatatttagcctctcatcctttaactgtacaaaaatcaagagaaagtaaattgat

SEQ ID NO: 70187 - DNA, 1255 bp, Homo sapiens
tccacttgtggcttctttgagattctgaattctcttgggaaaaacaactgtgatttcacttatattatttcttgatgtattaatgtccaacttgcaatcagttctagccatattaataatctccacctatgatgtatttgttcttgcctctctacctttctatatgccattcatctcatctgtaatttctttcccttaatttatgtttcagttttcccttctgcaactcaacaacaacaaaatcaaacaaaacaagaaaattccagtcttatcatccccttgataacctgaggcattccactcattcatctgtatcccccgtgtgtcccatacacattgacattctgtggtcatttgctcaacaaatgttcagacatcttctcatgtgttttcatggagtgtcttcatctctagttgcatattaaactcacttagggagttcataaaaaatatgatggatctccagaccaaataaacagaatcgctgaagggtggggccatgctggggaggtaaatgtttaactacttgctcctcaggaaaaaaaaaagtcctgatttgtagtatttgtcactttccatggtgtaaatactcccaccatagtggatttcaagctacctacttgacatcactgaacacagaattcagaagagatgttcactatttgctcacaagggctggttccagcataccactggataggacacaggcatatacatataaatacatttctcagatgcagtgactgtttttctttgtttgactcatcttccctatgacactaagcacaagggctgaatcaatattaacaaaccacataaagtgattaatctatagttcacagcctgtgatgcaaatgtgaactctgcctcatcctttgactcaaatgcacagaattatcaatttactttctcttgatttttgtacagttaaaggatgagaggctaaatatatttgggttctcctaatgaaaatgtcaagtttttgtttatatgtatatatttttaaatattgcttaaagacgcacaaacactgggttttttttagcacccctctcccactcttagcttttaggtatgggagcagcaatgaaaatgatttttttcatggtaactctgtttttattccacttaaagctcatatgtaattgtttgaagacactttccttggatcctttcatgtgtttggaagtttcaattctcttctaagtggcatttttagagaacagtagatatataagattgcccgggtggtcct

SEQ ID NO: 70188 - DNA, 1645 bp, Homo sapiens
cagcatggccccacccttcagcgattctgtttatttggtctggagatccatcatattttttatgaactccctaagtgagtttaatatgcaactagagatgaagacactccatgaaaacacatgagaagatgtctgaacatttgttgagcaaatgaccacagaatgtcaatgtgtatgggacacacgggggatacagatgaatgagtggaatgcctcaggttatcaaggggatgataagactggaattttcttgttttgtttgattttgttgttgttgagttgcagaagggaaaactgaaacataaattaagggaaagaaattacagatgagatgaatggcatatagaaaggtagagaggcaagaacaaatacatcataggtggagattattaatatggctagaactgattgcaagttggacattaatacatcaagaaataatataagtgaaatcacagttgtttttcccaagagaattcagaatctcaaagaagccacaagtggattgagttgatcttcaaggatcaatctggctatcttacagaccctgttccagatttgccctttataggagagttcagactcagaattataaaaaagaacatgagctcattgggctacctaatttatattgtgtaatgacacagtgatgaattatataaacatgaaaactacgtgaaagttcgtggaggataatgtaaattttacactacattcaaaagaatctcttccttttccatctgtttctttcaaaataccctcccagatggctttcccatgaggcaatctggattaactcagcctcatatccttccttcaacagcactttgaggggttacattcagaatcgcttttgaggtggtaaaaattttagcacaactaaatattttacatctaaagaaaagggctcagcagtgtgtaaacagacctacgtttttctttctggccccatcactgggctaattaatttctctttgctctatttatccatctaggaaatgggataataataatgccttttcccttactcccaagaacattacaagagatgcataattatataaattccaggtagcattattacattctgacttatttttgactgttaagtttttcatttccagagatttatagtctcaaaaattctagaatcctgatttattccaaagtacttcctctttgacgtcaagtgttttcattgaatgttttttaaggcaggaattttttagctggaggaaattttctagtaattgctccatcctactgttagggctaaagcattcagaatcatcttcctagcatttatgtcacacgtatacagaattacaaaggctctgtggtgaagtatcctcatactgcccaatgctgaagtctcctcagaacttcaagaatggcccttgttgaacctggggtacaaagcagcagagtttattctgaggagacaaattcagaattatgataaatctcagcacctgcatacgcacttgtgtttgtgtatacaagtacatgcatctagagagaaatgaaaagtgaaggaccaccctgttgcaggggtttgtgtttgcgaaatccaccaggtgtcatcagctgcaaacatcaagtgtgtcccataatcctaatgggagagttaatagtctcttaaaaa

SEQ ID NO: 70189 - DNA, 1170 bp, Homo sapiens
gtcttgccggtcacttagctacagatggaacttgaaaaactggttcctggtcattgctgctgaagagagccctttatttctgttgtgacaggactgactcaagatactcatgaacgtggaaaactcctaaatgtgtcattctgagttcctgagaagttgaacatacacagatgacaaaaaagaatgccatttagccataactaccctttctagattaccaagtatttgtaggtttattggcaagatagcttaaattacgtatgtatttctggcctgcaacatcatgtaatagaagagttgcagaattctttgcagttaagaaaaaaaaaaaaagataaggacttattaaagctgacatggactgtgatttttgcactccgtaccacacacaaaggagggcatcgtggtgacaccacccctgtgtttgtatttcttggttccatttagaattcactggcctcttctactgcagacctgctgtttagtctgcatctggaaattaaacccagagcttcagctcttagcattaaatattgaactttcttccagcacacaccctcatccatgcctgtatagtaagtctgattaaactcaagacattttaaaattccatcagccttaggagttaagtttggatattgggctgtcttcctcctcctttttaatctattagaagaagtgtacccaaaggtatatataccacatgcatcatgttgaaccaaattaaaagaacagtgatatgtgcaaactatatttctgggttttagtggagtttttttccaaacttagctaaaacaatgagttacatttatcaaattccttttttcatgaacaaaagaaaaactaaggcaaagtaagtgcacttttccagtagttataataaaaatatagttttccaactctgcccacccctgttccccactcatcagttttctgccaagaaacctcacatgtttcggcccggtacctcacttgtctttgtaaagtagctgcatgatggctgggagcttttcggtgtttagaggccttagtggctggtgctcataaaaatgtcaccgtgcacttgcactttgaaaagtcctttcatctgaacattcctgaagccccattccaacaggtaagccttcttgaccaaagagtggctgtttagccttcccaccctgccactag

SEQ ID NO: 70190 - DNA, 3900 bp, Homo sapiens
atattaacagaaggtgcctaagcatctggtaagcactctaaaaataccagctattattaccagtatctggagggtgggttcatttataccttaagaaaggatccccctaactctatttttcttgtgtgccggtttttaaaactgatgaatggcatgctgtcgggaaaaatttatccattcctactttttttctaattggtgagtaagcgtgcattgccctgacattctctggacagcaaacaattgaatttgctgaccagccgccatgatgtcaagccttaagtcaacagtggctaatgaccgctctgggaaaaaacaacaccttgattcctcaattacggtttaagaagccctgggaatgagggctcgccagtcatcgtcatcctcttttgaggcaagcataatgtgctgtggaaacaggttacctctgcactgttggcaagagcagcccacacagtataacgattgagcgtcatggctgtgccctttgtgtgttccaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagatcaaggagggagacactcacaagtcattttgttgcaccccttgcacacatcttggcacacatgtacataaagtgtgttttacatatcatactccttcaatcaactgccctgagctcgcctttcagattttgacatttaattctacagagacaatcttagaagaaacatgaagaacaagctgtagctccaaactacagaatttttacttcaggctagcacctacaaagtttgtaagggaagtaactaatgcactagtcgtctttgaagtaacattggaaagagatccggaagattgatgaataagaaatgaaagccacgaagagtctcctagataggagccttttaactctaaa

SEQ ID NO: 70191 - DNA, 1037 bp, Homo sapiens
ccctccttgatctgttttgaccaaactttattactcatttaatggaactgtaacaaagagcaggaatcaaaacacatggggatcacagaggctgttatgtttattgtgcagaacagacagtgataatacactagagaaatattttcaacaagcaagcgattcaaagtacaatcatagacagcaattctacataaagaacaaagaataaagttagaagacactcaaaggaacagggagaaagtcaactgcagttaaacgtcttgatacttttctcctgcaaacatacctaacttgcagaaatggtagaaaagttaaatgtccagtcttatgtagctgcgaccaacaacagcaaagaacagtcctataaaatttatctcccacaaaaataaactatatatataaaaattttatgatgttcttactgttccattggccacaagctttttttttcagtatgaaaaatgaggtatactgggacttaagaggtagtagtgtgttttgattgtacaacatacaggaaataaaagtgtaactttaccagagatggaaatcactcggtgcaccatgtttggccaacatgagcaattgcttccattttatgagctggccaatgaggtttctaaaaggcccatccaaagatatggaatgcgacttttatttttatgagccactgtttatttgcttatttaacgcacagttaacagtaatgttgagttttaattctctccatagctcctttggtgattcacaacagtgagcgatctgccagtctcagagaggtatgtggcctttgaaactacctccctgaagcagctggaagagagatggttttgagtttcatttggcttcagtactaaaagccatactgacaaaagccgtcatgagaaactacctcctggcccagttgataataccatgttaaaaagtcagcacactcactaggagagaaaggcataaaaactctacataagaagcgtttaaaataaatctggttgagacatattacaaaaatcacatttgtgtaaaatacatgaaaa

SEQ ID NO: 70192 - DNA, 1029 bp, Homo sapiens
caccttttttttttttttttttttttctgagttttctctcagcaaagaagaggaggtggctagaacttgttgccaaggaaaagagcctgattagagtgtccaattgaagagttcttattggctgccaagaacactgttatatggcttgtagaaataaatcaaagtctcgagaggaggccagaaagtcaaagaaatgctgttaaatcttgagtcctgtatgatgctgaagaaataaagggaaaatatagggtgtaaattgagttgtaattccaaccaagtcaaggcagtcagttgtgatggccaaacaacagatgcatgaaggctttaaaggacaaaaaatgttagactctggctgctacccaaacacccttgccgctgaaatcaaagagtccaatattcttgcagagacaaaatcttaaagacaaagcagcagacactcctggctaaaagggtttgcaatggatatattgccagtaatcttaaacccactcagcagagactgagtaggcttgggaagcaaacaggttttgtagaatgacgaattttgtataatgcctaacatattattggcactcaatggcctcattattattccttcaagtattagttatgtagcacaacagtatatgaacacaggactccctgggtggggaagaaaagaaactggcacgatttcttcaagtttcccctgctggttccacctctgggggtctgggctgaaaggacagagaaagtcaaaaaataatatctgacatctttttattgcttactataccccaggccctgtgctaaatttatatgcattatctcttttttgttgttttgttttgttttgagacagtgtttcactctgccacccagactggagcgcagtggcatgatcttgggttactgcaacctccacctcctggattcaagtgattctcctgcctcagcctcccgagtagctgggattataggtgtgagccaccacacccggcctatatgcattatctcatttaaccaacataataattctatgaggcttat

SEQ ID NO: 70193 - DNA, 1052 bp, Homo sapiens
atttaattgtgaaaaacgaaatatatttttaaataatttatatgtggaatgctgtttttcaaagtgggtaatttagtttaatggaatataaccactcattcatccttccatccaacagaggcaagtttggacttgccttgcctttttctgcttttaacatttgtattcaaagttgtacaccattgtcaaatgtataatgtagcagtaaatcattagaggaagtaagttaagtcctgttaatactgttctcaaatataaacatatttctttaatctcttccctatagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaa

SEQ ID NO: 70194 - DNA, 1056 bp, Homo sapiens
tattttcatagaagtagagaatttctgtcctcccttcccttctccccaccaaaggggagtcttgaactattagtttgctatgtgaggtaaaattctttaatttaaattacagccatatggcaaatatcctaagaaagtagttgttatttttaaatttctttattgtataatattagtatactaattgcaaacattattcaaatgtgatagaagtttatatggtaaaaagaaaaagtttcccccattcattttgggctcttttctttgtcttgaggctcctttctaccttgtactcctcaaattttccagatataaaataatttgatagtttggtgtggatcattccagattttttcccctgtactttcataaacatataaaatagataaattttattaaatttgataatactgctcatgctattttttctttaacttgaaacacttaatattatgtctttcagtcctgccttaattttgctgtttgccctcggatctctgggtttgatttttgcgttgattttaaacagacataagtatccccttaacctgtacctactttttggatttgtgagtactctgactttctctattcccttaacaattattcctgagttttaaataaatgcatatataatacatatataacaacggcagaacaaaattaatgagttttttttagagtactttaggaaattaattgtaattttatagtcttttaaaacttttaacagtttattagtttcaaatattagtatgtagtggaaaaaatgctgaattggaatagatgacctggctttgctgctatctgattatgtgacacttggcaaggcatttatcctttctgtgtctaagttttttcatatgtaaaatgagaattttaaagtagataaatccttgtgataccttctacctctaatattctattattttctttggagaaaattatgttgtggctttaatttcataaaattcaaattctttattgttaactcttctttgttattatcttatcactctgatcttttaaagaaccattttgctcaaattatgtgca

SEQ ID NO: 70195 - DNA, 1033 bp, Homo sapiens
gttttactatttttgaaattaagacataaaaaaacttaacgtttatatgctttctatttctccttttcagattcaagatataatcattcttttaaaatgttctgcttttagtcttttgctatgttgtatcctgctgtgtacaactaggcatttaatacatttttcattttgatgaaaacatttacattttggcccactaattttttttaggctcatgctttttggagagaggtttagatatctcttacaatttttaaattattttggaagctttgtattcttgtctagttttagttatacattacattattaggaggaaaattaggaaagaatacgtgtaaaaaacaattttttaaagaggaaatttgattttactgttctatgataaatggttaagaaaatagtaatgtaattttttttctcttttagcctttctgagaaaagtctacagcattctttctctgcaggttctcttaactacagtgacttcaacagtttttttatactttgagtctgtacggacatttgtacatgagaggtaaggtaatgagatggtaatgaataattttcagacattgcatatgatcaaaaaggcatattataaacaaaatccacttttttctattaacttttgaggttaaaatgtaaaaaaggttcatttactcttataagcctgattagttttgtttttgatgaagaaaaatactccacaacatggtatttacctctgaactttttagctttagtttcttagggttaaacccttggtaaaaattaagaatttttactgcatgccatttttaaaagtcttaagttttaaaaactttattagactatattccctgtgctcaaagcctaagacagtacttgaaaaataaatgtgcgttcattttagttttggctcatgactagcataatttcaccaagaagttttcaaaagagctccacatgattcatccctgatctttaatcagggatgaatcataattatttccatgatacagttttgttatattaaaggaaaggagaacta

SEQ ID NO: 70196 - DNA, 1036 bp, Homo sapiens
tttttccttggaaagcaggatagtctgcggggctcagactcatttatttgtcttgttttcaatctgaaactgtagtgattattttttcctccccaggatagtgtactctatccaatacttctttaagaattggcctctctttggaagtactcagttttagacatggcatagctcaggctccagaagccacccctccagaaagccttccctgctgttctcatctttagttagaggcctgtcttcatgctcaaaccacacttagtgcatacaattactgtattactggcatatagcagatactcaacaaatgtttgaactacactgatttgcagtatttctcttaagagtttttagaaatagctaaataaagtgtttataaaaaatgtgcctcaatgatataggcagattacctcatcagaaagaaatatattaaaataacattaccatatttggctaatatttttgctttttaaaggcttccttttaaaaatgataagctatctaaaacatatattggcatttggatagtctttgcctctgtgaaacatcatctcttcaaagagatgaggaatgaatatattcttgccagaacttgaaatatggaggaagggcaaagacattctaactcaatgatgtcagacattttattctagctatttttctttccttacagcctaaacatgcattgaaatagaatgtctcaactttatcttctcttgtttgatatgtaattgcaaatgctgccactctatttaactctgttctggtacaagttgtaacagagtaacaaaattcaagatatgaccttgtgtatatcagtcaggataaactaagttatgctgcagtaacaagcagcaccaaaaatctcagtggtttaacatagcagaggcttactttttgctcccaggaagaacactgagagtccagcaaactctcttccatgtagtgactcagcatttcaggctgctttgatcttgaggcagccccctgtcaacttgtagtgaattgtgccctggttcttcagtgtttctggctg

SEQ ID NO: 70197 - DNA, 1034 bp, Homo sapiens
ttacaccaaaaagttcatctaatttagggagactatagaccctgggttaagaatcccagaaacagatcctttccttaattttgttcttgtctttctgtatatgtaggagaaaaaaatgcagtgtaagaagcattggaagaggtttttatctgagcttgaagttttactactgtgagtatgttttctctggaatttcctcctctttgtgcctgggtttcatctctgttcattttttattttacagcacagagcttggcgtgacatgtaataaatttgggttggatgttagaacttcgaataaattttgatatctgctttagtatattccttaaagtacattttaaaatagatcatttacataattcacttgaacatattttaacaggaaactgtcacaaggaagtaggttaaatcatgtgtgactaacatggctgaatagtaatacttagaacattagagtggtctatatttcaccatttcctccttccttagagaaattccagtctagaagctgtttcatcagtataactctattcaggaagagagttttagacaaagaaatcaagcgcttttgatgtgcatattatttttctggaattcactcctgagtctgagagtccttggagacaaattgaaatgacttcgttttcatatacatattcatatctgcagctgtgcagccttcctcattgaaggcctctaaccctgtagagttcacttgtcatcctttacaaataggaaactttttcagatttttttttaaccaagatgtgaagtcgggaagcagggaggaagctgaagagagaaggcattatactgaatccattttcttttatactgaagaccagaaatcaaaatagtagaggctaatcatcaaagcttacatatcacttagtcaataaaaaatgaaatccaaaattgtaatagtaaaaagtttttacatgtgagttttatttattggcttatgaaagtaagattcaaacattgcaaaatttcaaaagtacaaaagcatagaccaggaaaagattttctcc

SEQ ID NO: 70198 - DNA, 1028 bp, Homo sapiens
gtaaatagcaataaaaattgtttgtccttgagtctccagtgtcttgctcatcctactgagcctgctgtctcataactttatatattaacctatgacaagctgagcagcaaccccaatgttcatttttgagacatgagaaaattagaagcaacatctcccacatttcttcttctagacataaagaatcattcacccagagtaaataccccctgtcggtgaatttttttctatttgccctttatcttcaacctgtccaaaagtacatgaatacacctttgctgaatatcaaggaagactgaatttaaaaggctgctgctgcttctgaaccatttcccagtatcttgaaaaaaacttgtagtatgcttttgacttgggcagaaaaggagctgattgcttacttgtttttctgatgaaatgaactccataggaaaagactctaggttttacttagttctagaggggcggggtgacctacccatagacgtctgtgcctgttgcagtgtggcaatccagcaactgctaatggctttgtagaatcagcataaaattaatgcacactcatgggacctgaatatagagggaccatgagggtcttcagtcagtggagttatccgttggaattgctttcaaagggctgaggtggccacccacaacctaaaacaatccctcctccactcagcttgcaaccaacactgagcacactaagtgctcaaatatatgttttactgagtaaataaatatctggaatgttgctaaacatatttgtcctttggtctaaacttaaaataagtattagcttattttaaagccccaagcagcaatagattaattttattaagtttccttttgtgtgactgagttcatcaaatcctttcctgaatgcagagtttgaagaagaaagaaaagagaaggtgttggggttttggctcttgatgggagatggggacagagggtcactaactgaagcaaagggagcatcagggcagggagggaggcagaggcaagctctgcccatgtcccgttctttt

SEQ ID NO: 70199 - DNA, 1022 bp, Homo sapiens
gcagaaaggccaaaagttcaatggccgtggaagggactgatttgctttggaacaggcagggacacattgatgagcccttgtgaaaccacagttctcaaacaaatgcccacagccatggatctccataccctgacacatgcctgggtgggcacattctatggatgggttacattgaagtccttgaactctttggaacactcagaaaggcaacaattgtcagcagccccaccaccaagtaaaatataaaatacattgctagatgcatttcaagccttgtctcttccataatattcttgtttctgatcagatctctctgggtactctgtatctttgttacctgttgggcattctgtctagcagtgttgcttaaatgatttttatagttctgcacatccagacaagttcctgggatagtgacctggaagaactggcctcctcttaagttgtgagaccacctaagagactctagaacctttcagtttccacctatatcctagacaagctgcagactttcactagagcccagcttgtcaaacctagttcctcagcctagtcagaatccaaagctgcattccatcccctgctcaccacagtcctcattcttctgtagtctcaccttatcttattctccaaccttgtcctttcttttccaaccaactgatttctcttgcttttactatatacgtggcaattctttactctgttcctttgaacaaattattgcctccaccaggaatattctctccgcttctttcaaccaatccactgcaatgacccactttttccaagacttggcttggaactctctaacgagaggaagccttctcagaccaaccactcagtgggcatagttaccattgcactacacattttgtgtttgtgttatctttctgatcaccaggttgaaccttcaaggacaagactattatcatcactgtctctccccctgtggtctaacacaatgctctgcacacaacagatgttctataaatatttgtgaagtaagatgaatgggattgtca

SEQ ID NO: 70200 - DNA, 1053 bp, Homo sapiens
gctaaaaaatgtcttagtaatttgaactcttcaaagagaatgttataaaaacaaaacctgcttccaggtggtggaatttgagaaggaaaggacttaaagaaaagaatcttgaaaagttgcagcctatattcttggccaaagaccctcacatttttattggagaaacgaagatgtttttgacttacaggatcacttaaaagcatctgaaggcagtaaacttccttgttatttccctcctagcccttagtgagcttaattgttttcacatttatgaactattttaaatggaaatgcattttatccttagcattttccatcccagacatttcattcctgctaatgtttccaaagcaaagagataatcttggtgaacatttctaatgtttcctataaaatcatgttctttaatcagtattgccatttgtctcctgccaagtgaaacagtctttcatacaagggaaatggtctaggaaagaaacaaagaagaagccatttgcttcaaaatggacttttttttttttttaatggaaattgatcagagatgtaaggtcagagtgagtgagtgcatgggtaatttcctctccaaaagactagaaaaactgagtggttgggaagagggcatagggggccacagattggcccctccctgccaccaggacacccttgcctgaagacccaggctcctcctgcctttatccccagacgggaaggttggagcccagctcagtgtttaacaggcatgtcaaagcctacagggaatgcaaagtgtctttctttgtttgactgataagattctttaatcagtctcctccctttccctcataaccccctcaaaaagcctatttttatctttcagaaaaattttagatatatataattctttttcctcagatttttcctgttttcccccagtgcctcccctcttctaaaatatccaaatatgattttttctaagggatgccaaaacaattaaatatgacataaattaaaatttcccctattaattctatttgccaccactctaatccccaacattcatttacttatatacat

SEQ ID NO: 70201 - DNA, 1034 bp, Homo sapiens
ggcatggtggcacgtgcctgtaataccagctacttgggaggctaaggcaggaggattgcctgaacctgggaggcgtaggttgcagttagccgagattatcccactgcgccacagcctgggcaacagagtgagactccatctcaaaaaaaaacaaaacaaacaaacaaacaaaacaagaacaacaacaaaaaactggcatttaagaattacaggttgggcccaccatttccttattcccttccaatcttccacatattatggttgaagtaaaaaatgtagagacttgcccaagttcacaaagctagttggtggcaaatctgaggcttaagtcaggtctcttggtatttactttagtgtagtttcttttatacctggttttaagtcacttaatttactcctcaaaataaagggcgttagctaatctttaagatcccttctaattcaaaattctatagctgaactaatttcatgaaaatgaaagaatattctttataggtagagtgataaaaggtaaaaggaaagattattcaaacttaatttaatgtctgtttgcttctttgttattaggttttaaatactcttgaaagtactcaagccagcttgtattttgctgaagatcctcccacatcactaaagtccttcaggtgtccttctcctctattcctggagaatgtaccaagtattccagtggaagatgatgaaagccagaataacaatttactaccttctgatgaaggcctgaggatagacagaatgactcagaaaactccttttgaatgcagccagtctgaggttatgtttctgagcttggacaaaaagccagagagcaagagaaatgaggaagcttgcaacatgcccagttcttcttgtgaagaaagttggttcccaaagtatatagttccatcccaggacttaaggccctataaggtaaatatagatccttcttcagaagctccagggcattcttgcaggagcaggccagtggagagcagctgttcctccaaattttcctgggatgaatatgaacagtacaa

SEQ ID NO: 70202 - DNA, 1050 bp, Homo sapiens
gtggagggagacagaaaaagaggtaggcagaatgcagtgttacaggcaccctaccagacatctttagagagtgctgtagggagattaaagatagtggtaagtttgatgaaactttgaggaaacggtttctaaataatctccagagttaacttttgtgggtttttgtttgtttttttttagtttctatttgtgatgaaaacacacaagagacatgtaaagtgtttggacgttttccgataacaggtgcttggtggagagtgaaggtacaagtaaagcctgtggtgggatcaaggagctatcaatatcaagttcaaggatttccgtcttactttttgcagtctgatatgtcaccaccaaatcaaaaacatatctgtgctctctttcttaaagagtgtgaggtctccagtgatgatgttaataaatttttaacatgggtaaaggaggtatcaaactacaaaaacctaaactttgaaaatcttagggaaacactaagaactttccacaaggaaactggaaggaaagatcaaaagcagcctacacagaatggtcaggaagagttgttcctagacaatgagatgagtcttcctctggaaaacacaagtaagtgtgatttttatcatcaactttcagtgtaattgacatacttaataactacagtgtttaaaatgttaccactagcatagtattctttttaaaaatccatttggtgaaaaatgtgtttatgttgcttttggagtatgccattgacatttcaggtttctcatctgtagcatgaagggattatatgagctgatctttaaaatcttccagttcctttccacctctaaaactgtgattttaatctctctttctaacttttgtattcacagcgattaccttgaatcattaataaaaaaaaattcagttgctggccaggtgtggtagctgctcacgtctgtaatcccactttgggagactgaggcaggaggatcacttgagcgcaggagatcgagactagcctgagcaatgtagtgagaccttgtctctacaaaaaattttttaaaaattagc

SEQ ID NO: 70203 - DNA, 2037 bp, Homo sapiens
atatgaattttggggggacacagttcggcccataaaaggtatggagggctcaggagtgatgtctccattaagaaaaaatggagccgatagatgacgtgctcagtagattatagtgaagggagttctgtatctcttctgcagagtttaggcagaattgttgatagacacatagaaaactaaacaagtcaagaaaatgaggcagatgttaacttcatgatacacaccgagttcaacagaaaacttaatgtaacagagtacatcctgtcactcagctgtgaatcctatttgcataagcataataaatacctatttaaccaaaattgaacaaaatgtatactacaacatttttcaaatatagaaaccaaagaaacacctgtggaggtaatggtataaaatagagtgaccttccatagagatagactttccatagtaaggagttaataatgaatatctaaaatcttttaaaaatcaaggaaaaatatctatagtacttagaaatatggaagtaaattctggaagaaataactaaagtgttggagatgttgcctttagaaggcatgagaagggataaggaaaggattcataatttttttgataagccttatagtattatttcacttttaaaactgtgtgttagtgtgataaaatataatttttatttaaaaattatatagatctctaattacggtgcagccagttagaaaattagtgatgttctatggtattttctgtaaattttgttgaagttcatgtcttctgggatttaaaaaattattaataaagaacatattcataaacacttatgatgtttataaaccaacctgaactttatttcttaaagataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagccgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtaaaacctttgacatttcatctgtagataaaacatttgtcggccgggcacagtggctcacgcctgtaatcccagaacttttgggagactgaggcgggcagatcacaaggtcaggagatggagaccatcctggctaacatggtggaaccctgtctctactaaaatacaaaaaattagccaggcatggtggcacacacctgtaatcccagctactcgggaggctgagtcaggagaatcatttgaacccaggaagcagaggttgcagtaactgaggctgcaccactgcgctccag

SEQ ID NO: 70204 - DNA, 1043 bp, Homo sapiens
agaacatcactattagattactggaacgtatctgttatcaaatgcatttatttatttgttttatattttgtacacttattttatctatttgaggctgtagattcttccactttcagtaagacattgaacatgattgaaaaagggactaactacaaatgtctaaggcctgttttttttttcccctaatatgttgactaaaacatatgcctgtacccagtttccctgtggttataggtatgaaagatgttctatttagattttgtcaccttattgtgttattactatttttatatcttttactgtttaaatgttgttttttgtaaggtatttaactttaaactgttaaataattttaaacaatcttgggggtattttttctcagagtaagtcttgctactgtatctttttttcttttaggtgacattagacagttacccagtattgaacctggtaacttgctgaaagatctttttgagactcttaagtcaagaaattgtgctattgagctaaagacaaaccatagagcagaatctcagctcattgtggacaatgctacaaggtataatattactaagagtttgcattttctgtctgttgtattagaaatttaaaaaatggcctttgaattagaatgatttagtacaatacattaactacaccttttagcaaaactcttccatccttcaactataaaccttttgccctacagttagaaaagcaaagttaatgtttttcattactggtccagtataagttattattgaaatttaaaaatggatgaggtttcctgattttaaaagtatgtatatgaattaaaattgtattaagcttaaggactagaataagcccaaggggaatggagatttggaaataagttcatttacgtgcaagggagaattggggaagaaatatcccctaatttttgtgggagaaagctgaaggcaaaataattgaatgtggtatttcactcctagatgaatcctagaggcacccatggcatcttacttcccttaaatagaaaagaacccttctcttcccttcgt

SEQ ID NO: 70205 - DNA, 1543 bp, Homo sapiens
aatgagacatagattttaaaaagcatcatttcctttgttgctgcttaaatgtagaaactatagaagtggttgccttgtatttgttctcacagtgtagataccctcactgaaagctgtgaggaaaagtaaactgcaaagaatctactcagacttatgtagtcaatacaagaaatgaatgtatagacttcaaaataagaaataacaggctgttcttcacagagtcaaattgaagataagtttcaaagactgaaaacttctatttgtgtttattaaaatatttaggtatagatatattgtttgtgctgaaatgcaaattttaagccttttgaaattcttaatggtaattgtaattcttatattttatgtttgacccaaagatagaatatctttgaacgtatttgaacgtagaacatatttgaaggtatgcaaaatagttctttggtttggtgacaggatgtaactgatgtaacttttggaaagagaagatctttgaccattaataatatggctggcctggaagtaactgtggattttaagaaactaatgaaatattgtcgcataaaacatgcatgggcaagaactattcacacttttcaggtaagaggagacttttatcaaaccttttaaataatttaccaaccttagagcgccttgcattgttttcgtaaatttttgttgcacttattagcaaacaaaaattaggaaacaaaatacacaaaagtacagaacataatagagaagacgccacccttttgctcttttttgctccagagctctctttatttttagaaacaaaggcattataggtaaagtctcctccttcaggtcttcccctccctgcctgagtctccagtatggcttggcatggcactgtactcatcttatctttggttaaattctgatattttgttcatcatggatccttttgtgccttaattttgatttacaaaactgttacattaaaatgtcttgatttatcttgattgctgagtttcttgggaacccattaaattttgtactggaggtgagttcctcacttgccttgccctagtcctgggtctgcctcccgccttcctccaaagtgacttctgccccgaatttggtatatatcactcctattcatgtagaagcaatatatatgattgttttctgtgttactgaggcttatgtaaatggtgtaatcatgtttctatacttttgcaactagcttttattttttattttttgccttatcaactttgtggggtataatgtgcatacagtttcattataaagttggttgagttttgacaaatgtatcctctctctccatctttgtgaggcaaccttttatccccccgcccccaacttatgtgggaatattgttaggtttacagaagagttggaatgatactacagagagttttcatatacctttcacccagctttccttggtgtttaacattttataactatggcatatttgtcaaaactaagaaattactattgctgtaagactgctaactaaactatgcatattcgaattgcaccagtttttccatta

SEQ ID NO: 70206 - DNA, 1578 bp, Homo sapiens
tttggatcagagtaactatattgctatacagttttgaccattctctatgtgtgtgtgtatctatctatctgtctatatatatatatagatatatatatggtttttaaaatgtggctttaaagtatctctgatgttcacaaaatagtatgtcaactgtgtatatattatatatataagtatataatatatattcacctattgctacttaaaatttctatattttatcattacatgtaatatttttatacatatatttatatataatatatctatatgtttacctattactggctacttaaagttttcatattttgccattatatgtaataatgggttaacacatttacacatgaagcctgtaccatcatttcagtcttttattaggaaaggtttaatactgcatgcagtctttaaaatttgctgctgggtttctacaagccagttgtggacctatgaaacctgaacttagcagcatgtttagcagtgtgtttagagttcttggaggatgaataaaaatggaacccataaaatggacacataataatagtctggccaggtagaagtgcttgagagcactttgaacacttgtctcctttccttgtctgtaaactgtctgaacctattttatagcatttagtcttcacaccatatttttcctgccaggggtccgaggagcaaacagttgtctatgtggtggggaaggcgggccgccagcactggcagcatgtctacaccgccgtgaccaggggccgctgccgagtgtatgtgattgcagaggagtctcagctccggaatgccattatgaaaaacagttttcctagaaaaactcgtttgaaacatttcttgcaaagtaagctctcctctagcggcgcacctccagcagattttccgtccccacggaagagctctggagacagtggaggacccagcacaccgtcagcatctccactccctgtagtcacagaccacgccatgacaaatgatgtcacctggagcgaggcctcttcgcctgatgagaggacactcacctttgctgaaagatggcaattatcttcacctgatggagtagatacagatgatgatttaccaaaatcgcgagcatccaaaagaacctgtggtgtgaatgatgatgaaagtccaagcaaaatttttatggtaggagtgatgtttccatgttcccaagttttatttaaatatcgctaacttcggtgtgcttataaatgactgtgtgcttttattagtgttgcattgtgctgttggacttaaaaacaattgtttttctcatttctgtcaaatttcccttacctcactgtctgatttccccttcatttcctcactccttttctccttcccagcctctaactgaagacaactccccaaagctcagttcttttttcctttgagaactgactcattctcacagtttcagccatctccttggcaccagtgatttggctaacaaagttttgactatagtaacatttcaggcaccaggaattagagataagtgagtgacagttctcactctcacactgattgtcatggtggagacagtcggctatcagtaatgtggtgatt

SEQ ID NO: 70207 - DNA, 2296 bp, Homo sapiens
tactgtatagaaatgcagtcgatttttatatattgatcttgtatcttccaaccttgctgcacttgtttattagttacagtgggtttttagtggattccttaggattttctatataagtgatcatatcatctgcaaatagagatgcttttagtgcttcctttttcatctgtaggcctttaatttcattttcttgctaattgccctggttagagcccctagtatattgttgaatagaagtggcaagagtgaatatccttgtcttgttcatcatattagggagaaagcattaaatctgccaccattaactgtgtttgctgtggatctttcttttaagtcctttattgagatgaagaaattctcttttgttcctaggttgttgtgtatgaagggacattgaatttcgtcaaatcctttctctatgtattgagatcattgtgtagttttgtcctttattgatgcagtgtggtaatttttggatgttaaatcaatcttgtgtccctggagtaaatctcacttggtcatagtatacaatcctttgtatgtgctgctggatttggcttgctggttttttgttggggacttttgcatctaaattcatgaaagatattggtctgtagtttctttttcttgtgatgcctttgtttggttttggtatcagagtaatagtgaccacatagaatgagttgtgaagtgtccccttgtcttctattttggaagagtttgtgaagaattggtattaactcttctttaaattaatctggccctgggcttttctttgtggggagtttttgttttgttttgtttttgttttttgagatggagtttcgctcttgttgtccaggctggagtgcaatggcacgatctcggctcaccccaacctccacctcccaggttcaagcgattctcctgcctcagcctcccaagtagctgggattatatgcatgtgctaccatgcccagctaattttgtatttttaatagagacagggtttctccacgttggtcaggctggtctcaaactcccaaactcaagtgatccacctgcctcagcctcccaaagtgctgggattacaagcatgagccactgcacccggcatgggaagttttaaagctactgattaaatttctttacttgttataggtgtatttagcttttctatttcttcttgagtcagttttgacagtttttctctagaaatttgctcatttaatctatattttttaattttctgacatacagttgatcatagtattcctttatggttttttaaatttctgtaaggctggtagtaaagcctctgtttcattcctgattttagtaatttgagtctctttttttcttggtttagctaaaagtttatgaattttaatctttttaaaggaccaacttttggtttcattgattttctttactgtcttcctattctctatttcattaattttaactcttgtcctattacttttaggagggcctcttaaggaggggtcgtatgctgacttaaattgagggttggtcaaagttcaaaagcctgggggaaggaagcttaatattttctctagatcagtaagtacaagcaattcagctaagaatttgcttcatttatgaagcaaagaatggtaattttcaggacagtctgtgtctgattttgttataagtaaatgggggaagggagataaacatctgtgagtcttatctaagtcacccggggaaggatggttctttataataagccatttcctggaacacgcaggcgatgggcaggggggttactacaaccttatagaaataaaatttctttaactctgcctatatttcagggtatagtcctcaggtaaagcttcacattgtcaagaagaacttgaaaataccttttttccataaaaacacaatgaaactaatactatgtaacggaatattccaaagcactagttcttataaataactattggccaaaatacaaataactgacccaattcaaaattctctaagatttcattaagatccttttgtagttcataagcctgatgcatgggtgttcacacgcatgtgtgagatgtgcctccctcaaaccttgttatggcgccagcccattaccggtctgtcatgaaaaaaaaaatatttcagtaaaagaggatacttctagtatcctttttaaaatttgaattggaagcaaatagtatttcatcccagcatgttaaaattgcaagggtcacctaccccagcttaccatttgctaaacacgcatcagtcaccagtggaacacacatttccaatgctaaaggtcttgactgcttgg

SEQ ID NO: 70208 - DNA, 1051 bp, Homo sapiens
acatcagaggaaattttttacaagttcatcttactatcactttttaaaaagagaaacatctgtttgaaaatattctctgtgatgatttccttaattcactttgaaatcagtttcttactatgaagtcattaatgtaagaacttggccaacaaagcttttcttctcataggctggctctactaggggaactagtgtttggtaaactgctgggactaccacaatgggaggggtacaggtataaaattaagttatcttaaaatgtttcagcaatgatgcacgtaggagaccataataggtggtggtaaatgttttgcccacgtataggaatgattttaactaagatgtatgctattccctatgcaacaaattatcaaacaggatatgtcttgtgacctgttttttttttaaggacacatttttaatagctgaaaatctctgataatgaattagagtgtgtagtaaacatgagaattagttatattatcttatttttaaaattcaagactaagaacttcagagaatgaagagtctattaaaatgaggttcatcttaatgataggcaaaccaaactcatactgcttgacatgttttgaaaactggtaatattgagggtgtacagcacatgtacttaaaaatgacactggactatcttttgctctgagccatgccacttaccgaaattgtaaatacatttttcacaaatgcattgccaattattaccatccctcaaagcaataaattgtgacagttgctttaaatgtttgtcagcaactgttttcatttgttcagatattttgaatagctacactaataactgttattatttggtgaacataaaaaaataaatagatctgtatattgatggtagactctccatattgaaatgattattttccaaacattttcattttggtcaataattcaaactaccacttaggcaaagtattcgaacactgtgtcctttgtttaaggaaatataaaaaaaaaatcacctttctttttgtgcaaaaaaaatattatttcaatcacatttcagaaccgccagggcaag

SEQ ID NO: 70209 - DNA, 1096 bp, Homo sapiens
acctcccagagattgtattttgagaacaaagtctctgaagatctgtttttaagcttctttgcttggctgagcccataggaggataccattgccatgcttacatctcggcgtacatgctatgcagaatggctgccaaatttgaccctagggaaagaagagaaagcttactgaccttgtgcagctccacaggagttggagacatgatctcctttatttcttgtttcatttttctcagggttactgacttcctacccacatctgaaggcagggtgttgctccgagttgtttggctgtagtgcggccgcgagctgctgcgctcctggaagctggcctgtcgccccagctgactgcgaggtgttggagcctcatgattcaaactcatcgtgctccccgacatgattgttgcctgtggcattgacaatttttagaaacaattaagccatggactaaggaaaggatttggtgctcaacagtaagcacatttctccttctgcgaggtaaaaatacagtctcttcagggcaaaaccaaaggctggaaaatggatgtactaattgaactatgaaagtctggaaaatgctttgcaagtgacatttataatgcacatctcaaatccaatttaagtacttaagccattgagtttatttaatcaaataccacccctggcagttttgaggcaaattgaaatgctctaacatttgcttactgtaaactacattttaagcattcactttccactcagtgggctctaacagatgggattcatgaggccaccttgaatatatcttacagaaacgaattaagaacttctcaatggacaccaggctgcctgtacttgcaatgctgcctctatctccaactgcagttaacaatgggctggaaagggatgactgatataaaggcaaggggttcttcccaagcttcgtctagactgtatattgtctttcctttggccaagtggcctgtccccagagtttgtagaccagctaagtctccatattatttgatacagattaagtgtttcttagaaatactctttgtataagatcctcagagaaagtaaaaataatcatttattatgttattatattcaacttt

SEQ ID NO: 70210 - DNA, 1014 bp, Homo sapiens
atgactctctttctatatttcgtgtgagatgaaggagagatattctgaatccaaaaaaaaaaaaaaaaaaggccgggtgcggtggctcacgcctacaatcctagcactttgggaggccgaggcgggcggatcacgaagtcaggagatcgagaccatcctggctaaaacggtgaaaccctgtctcgactaaaaatacaaaaaaaaaaaaaaaaaattagccaggcgtggtggcaggcgcctgtagtcccagctactcgggaggctgaggcaggagaatggtgtgaacccgggaggcggagcttgcagtgagccgagattgcgccactgcactccagcctgggcgacagagagagactccgtctcaaaaaaaaaaaaaaaaatgtctggcaagttcctaacccagcctgtgtttcttgacaacagttttgcaggggctgccgatagtgcagagacagaacaagaggagaacttctggtctcaagcgctggaggatttggaaacctgcggacagtcaggaattctgagagaactggaggtagccttggtcctgctacttacttttattgtttctacattcattttttttggtccttttaagtttgcatttctcacaccagttcatttaaaagctttaaccctttccacaggagaaagctgacaggcgtgtgtctttgagaaacatgactctcttggtagctaccctttatgtttatatttttgcttgtgaagctgccttccctacccccttgccttctggacagcaatttgattttatacaatgcagtcaaaagtatatccccatctccacccctcaagcttactgacttgtggcttctgccattgctccctgctaaccctgattgtatctgtttcctaccaaatcgctaaaaagcgagctaagtctcccagcagcggcgcatcccattctcttagttgctttagaaaggtttctttggcatgttttcatttgtacctggaatagaaattaatgtgatcgttaagaggaacataaga

SEQ ID NO: 70211 - DNA, 1053 bp, Homo sapiens
tcatcatgccaacccaacactagattaaggttgaggaccagcacagcctcaccacgccaggggccagatttagtttaattatttcttcaaagctgaagataggattgtttaaaagtcacaaagcccagatgcaaatggctaaagtggaaaaaacatgaaaccagctagctcaactccctttttcttagataggatatagacacacaaagagacaaaatggcctaccccaaggttccccagctggtgctcagtgatagagccaggactaaaacccatgtaacctgaccctaaggccatcctcttaaagcccccacaatgatccctggtttgaggagtagggagccagggtgcagggatacactgatgttattatagaattgtgatgaatattgagagattcatttatctttttcaactcttgctaaaccagaggccataatttaacctcccaccattgccattcagtttttatgcagagacatgatctattttggaaatgctggtattcctggtgcttgctccaacctaaagtcagtattttctgtttgttcctctagtgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagaggtgagacactttctttcacagcatcattttctgctctgcgtttctggtacctgctatctttgaatggctagtaaattatgaaacattgctcaatgcaggaaatgcaagatatgatgaactgtcttctgacaataaaattttatgttcttgatcaggtttgaaaagagtaatgagcatggatgcctttaactagcagattttgtccatcaagggactagaagctatattaattaaaaaggagaaaaatccataaaataaacatatcctgaagttcaacttcaatagtttctgccatgggggaatatacat

SEQ ID NO: 70212 - DNA, 1052 bp, Homo sapiens
tttagccacttcagaatcagtacacgtctatagacagaagtcagaaagctgggggagtgagcagaaaagtttggaaaagcagcaagaggcaaattttttcatggcacaaaatcatggggggtggaaagggatagtattaaaaacactaaaagggggaattagccttgaaatggaaggaaggatacaacctcctgtagtgggggaaaaaaggaagagggaacaaataatgataaagagaaattgaggctaaacagaatgttgtttaaggaactctcgtcaaagggttgcatcttttcagtcttataggaaatgaggagtaacatttgaccatgatttagggtagaaacatttgagacaaatcctttgtggaatgaaataaggtgtcaaaatatcacacaacaaataatttaaggacctaataggattgtgaattcatagtgacttttcctagcacccttcagcaacttagtaacaacagtggagttgaccgggcattaccatagaggataaagtattagggtataggaaaatcccatgaggtttaggaatctttgagcctaggagatgcattattaaaatgctcaccaggggtccaggcagagtgtggggaaaatgatgccagcaaagccagtgggcgaagacaatggctttccacctgcacttaccagatccccacatgaggccagggaaaacctcaggggtctcccattcccacatcaactacagtagctgtttttatctggaatacaaaggcatcccttatatgttttcattttaagggggaaaaatctgttgctaaaatcaatagactcaggagacaagtgagagggaatgggactgaaagtcataaagaggagacagattgcaggaagtgggagagatggctaataaagggtatgtgatcaacaagggggattcagatattgagatcttgaagatctattcattttgaaggaagatggagaccaccatagggctctgctggcagagagtggaagtagggtggtattgctaggaactgacatgaagagagttgaagaagcataaagcca

SEQ ID NO: 70213 - DNA, 1059 bp, Homo sapiens
ttattatatcagaattttgcttgcttagttatctgtcccagttatgccctgaaacttgaagttttacactctgtttatttatgaccttccatttctctctctcctgcattatcatatgatagacagatatgctggaaaattgtgtaacggagctgagcaagactaggaggacttgggagatcagtagaggattctgcagtctttatggaaaattggctcccagcgggctcagattttgaatgaataaaataagaagttgaaatttttaagtcgagcttaattactttaactgtttatcttctgtaaatttaaaaaaaaacatacaaaaataacaagaggagagatataaaattattaacaaaaatttctggaccaagattaataaaattaagctatatgcttttgggtttgcatatttttattcatttaaattgttactatgtatactagatgtgtaaaataagagtatgtagtatgtagatggacatacatgttttaaaaaagaagacaaaagaagacattcacatgcccatcacccagcttaaaatacagaatattggtaaccatgttaagcccctctatatccctcaaagatttcatcatcctttatcttcccaaatataaggttgtcctgtgtttttaaacttatttatctttttttattatttatttatttatttattttatacagtttctactctcccatcagtgtacattttggttgtttccagattttgccaatataaatgatgccccagttaacttccctctacttgtcttatgttacacacacgctaggttccctggaatgcacaccatgaagcggcctggctgggttatgggcctgcaccagtgcagctgtgctggaccaggccagactgttctgtgtcccctcccatcagcagcatgtgacacccgttgctccactgttacttagtttgctcaggctgtcctaacaataggtcatagactgggcagcttagacagcagaaatttattttctcacagttctggaggctggaaagtctgagatcaaggtcccagcaagatttgattttc

SEQ ID NO: 70214 - DNA, 1105 bp, Homo sapiens
ttccccataatctcagtgcccctggatattatgaacttctttaatccatgccaatctgctgggtaataattggtatctgtgtttattttgcatctgcttgtcttgttttatgaattgcctttactttgttttgcgtatttaaatctttgtctagaatatattttgttattacatatggtcaaagcctagtttattttaaaaaacaattccacttgcctcccttgtaataacctgagttctcatatatacttaggcttcttgactttttgttccattgattcatctgcattatttctgtgctattatcactgtattttaattacattagtcttaagttgaatatcttagatgggatggggtagagggttaggaaggaggtatgcctattcttactcatttatccttccaaatggattttagaatcattgttcataatttgcaaatgttagtctttggattacttagatcagattcttaactgcccttctgggccctgactgatccctttcaacccattctccacccggcatccatagggttcttcctaaagcaggaatctgcttctgtcatttgtgtgctgaagacaccatgatggctccccgtcatcctggggataaggctccgactctttaatatagtctcattggtgacctggctcttacttaacaatctagcttcaatttctctctctgccctaccacacacacacacacatgcaccctctttccccttccactgtactcctttctagcagtcctgaactgctgctagcccatggactgcaccaggcacatggtgcctccctgcctttcacatgctggagttctagctggagttccctcttgctggagttctctcctctccatcccccttttcttctgtaaacctttctttccagccttgatttagatgtcactttcccaacaccaccctcctccctgcaaagtctggtttagttgttcctgttgtgttttctcttggcacctgtaacatcccctaggatggcatttaacactatattgtaagaacctgtccactggcttctctcccccacgagactgataaggtcgtccaagctctgtgtcttgtttggcattgtaattca

SEQ ID NO: 70215 - DNA, 1022 bp, Homo sapiens
ctttggaaaaagctcacaagattaagaaataaatctgtcatggtgcttcttgtctcccccaagcagcctgagatacaggtggcatagatggacttgggcccataagatcttttaagaatacttttaagagtattcttctatcagtggcttaaactgaggtagagatttctgagaactgcacaggtggagtgggatgccctcccttggatgtggagctacccgccgttgggcacttggaaggaaatggccagtggagacggtgctggcttcattcagctgccgttgggcacgacaggcaaagtggacactgtggtgtagtggaaataatatgagctctataactcgctagacacattctcctagagcctttaaaaactttctgtggctcggtttaccctttctgtaaaatagatacaatagctagccctaaaacacaccactttggttcataacatagaatttctagcctgctcttccacagaaggaaaggagcccaaggaaatctgatatattcctacatccatatgtgtgtgattttactatttaatgtcttcaactgtgtttcttcttcctgacatatcgattttcctcatttccgtgtatccgaaacctacgtctttttcatgtcctagtttaactaccctgtctaaaatgaaactttaccaatttccatcaaacagaagtaatttccctctcctctgtgtttcagccactcttggggatgctcgatggcatttagcatgcctttccttgggttacattcatgtgctgcttttatctttcctactgggctacaagctccttgtgagggaaataatgcctagcccatctttgtatccctatacggtgctcagcatggttccttgcacattgtcagtcaataattgtgtgtttaattgaattgaatgagagggagaaactgaacttagtacaaatttctggacctttttctctgcccagacttgagggactcagcttatctgactgagtttgacttagcctaaggtgataacaaatacaga

SEQ ID NO: 70216 - DNA, 1050 bp, Homo sapiens
tcctcaaagttaggtccatagagattttccccaagcaaatgaattttttttcctcattacccagtattgtcacattctacttaacatgttgccagtgtgccggtaaacagttataggcctacagatataatcctaatgtgcttgtttgctcttttccccaattagccatggtgtattaaagtgaataaaatcttttaaagtctttcagcagctacatttgctcaagtgctcatatccacgttaaaagaacaacaatcatgagtattctctgatttggaaataaagaggattgagaatgctggggaaaaagctaaatgacatcgggagaaaagcagtccctagagcagaacacagtatctctcaaagcttaagatttgggaaatagtttaaattttgctgatgcctctcctccagcctcaggcttttctgagctctacagatgattccagtgtgtgaaataaaccaaatattgatcctgctttagggtaatcccttcaactatggaatgtaaatttaaggagataaatggatacagggaatgaaattctaggtttcttttcttggtgcttaatattccagagttgctataccacctgttgactaggtaggctggaatcccctaaaaccaaaaagtatatgcatcatgataggaaacaaatgttctactaggaggagctagcacatcatctgggtcatagcaggcaataataattactaactgtgtacagtagtactatgtacatattgtcttaaatattttactcatattaacccttttagtccttacagcagtgctatgagttggatatttttaccatgctcattttggagatgaagcaatttagggagagagaagttaattagtttgcccaaggttatgctgctagatttgaagctggtcagtgtggtgtcagagccagactcctaaactctactgtgtgttacctttctacattgacaatagagatttgttgaataaacaagaggcagtagggtagtagtttgagggaagagttgaaccctcaagattatagggttggccagtcctat

SEQ ID NO: 70217 - DNA, 1044 bp, Homo sapiens
ttaaagtagttcttaccaaatcctaggaagggacgggcttgtataccacaaaatatggaaaatgcatcatgaaataattcacccaatcatctaaagaaaggtgtgcttctatgcttccctttggagaagttttataataggcacaagaatcttgactcatcagctgctagcagaaatatattaaagttcccttttttgccctcaagggaatatgatactataaaaagatgtgaagttaaacaggttatgcatgatttccaccatactgtgtttaacttgtatagacttttgagggccaggagtgtagaatggggaagtggagagagagacttcagaggaaggagaggaaagaagcagaatttttgactacagcaggcaatgaactgagaaaataacaagggggcagtcaggattaatagatattagccacagttagagggaaaacctctctagaggggcattttgaatggagtaaatctcggtctttctcaacctgggttactcatctgaaccgcagaaccctgaaaatgctttgattgattgttttcttaattcttccaaggttggtacacaattaatatcattctacatgcgcaggagtatggatactttagaataatagggctccattctctcactgaacccagggtgggaatggctacagtgttacgtatgagaaggaaaagacctttgttctatataaatcatttctggccaaaattttactatcccaaatggtacacagtgaaatcttgaaatgattacattaagtgccaaagacttctggatgaattaatcatttgacttaaaatgtcttaaggatagagatggaaagaagaatgggttgataactatagaaatagaatactggccattgtacaggcttgagatgatactacagtaatgctaaatgtaaaactagacaaaaactcagaaaaatatttgcttgagaaaacgaaaatgtatgaattatctgatctttcctacaactccagtgaaattttagacaacaccaagggtaagatatgtgttacatggtgttta

SEQ ID NO: 70218 - DNA, 1055 bp, Homo sapiens
actttgcctttttctttgttgctcttgctgcctctgacttcagtgaacaactagctgggctgtatgtttcttcatatttggtgaacaacagggtccttatgatcttgtcagaagcaccaggaatgaatctgaggtgtgctctggaaaggtgggcacaaaacacatgccttttcctttttctcctctgcaaacagttaacattcaagaatcatgttatttggaagaattttctcttaaagtggcagagctattgttgtttttttaaagtaatttatgagcgtcctcttttccataagagttttacaaacagtattgcatataaaagaaatccactagaagggaaatcctttcacatttatttattcgacaaaagtttattgaacattggcgctatgtgctaggtactgttctaaacaatgaacaaaatagaccaaaaaatcctgccctcagttttaaaaaaagccatgggcagggagcagcagacaataaacagaaaaataatccaaataggtagcgtgttagatggtgattagtgacataggaataaaataaaacaagaaagggtgataagctgggtatggagggagtactgtcaataaactacttcatccaacctgttttagaaatctaatttcttcccttgatctaacctagctgctgtgcgcacatcactgctccttatggttggggttggatttttgaagtagctgtgtttctttccttcctagtagcgcataagcccaccaccgctatatcctgggagtgtggaaaatgaacattcttttaagacagctttagtctatgtattgaaaattaatctttttaatttggataaatatagaacctctccctattgggtttccacttttctttattattcaaataatgtgcttttatctgcaaattgttggtcaaagtatctgacataactcagctgtatgatatcctaaatccatgagattatttatattaaagtacttattaatttagcccttaaaaaaaaagaacaaaatttgactagccctacaaaatttgaaaagtaatacttccccctg

SEQ ID NO: 70219 - DNA, 1050 bp, Homo sapiens
ctatattacaaatggaatggactctggagcctcctaatttttcagtgtacacacaaatacacatatatttgaatattattttcatagccagtcgtactctttgtaaagcacttgaaaattgacaaagtgctttcttatttattatctaatttgatcatcacagcagcccagtgaaattggtaaattcagtactgtaacagaatggtagaactgtaaggaattttagagacacaactgccttattttgcagatcaagaatctaaagcttaaaaaagagtattagacaagactctttgatcccaagtgacagaaatccaactccaactaaattagcaaaatggagaccatactgaccgaagtaactaagtccggtgtattagggatttagaaatggatgaatccggatgttccaatggcatctccaggaatatgtcactctccatccctcgactctattttcctctgtcttggtatgattcaaagtcagcttttcccatgtggtgataagatagcaactccaagtacatagcctgccattcccagtggaatgcagactatcttctttgcagcagttctaacaaaagttctgggattacatctcattagcatggcttgtgtgactgcctatttctggaccagtccccgtgactaagggattgtatgttccacttagtcagccttgatacccatacctggaggggtagacgtaggggagtgccagctccatgcacaccacatggaccgagagtgggtccgcaagagaaaattaaggtgttattccctgaagaggaaggagcccttgatgctgtttaagcatgagcaattcatgtggattaactgacctttggtataaatgggttctgtagcttttaagttaaaatttagaactacatgtttagtattgtgagttagaactttccctgtgaatatacttttccagcaaaggaattgtattttttttttcacctttttacatccagggcccatcatggtggctggcatagggggtgtgctcagtcacttttacccaagatgaaacagccaatatgt

SEQ ID NO: 70220 - DNA, 1017 bp, Homo sapiens
tagattgcatgctgggtcagcagttgaggagtgctttgagaaaagtgtcttccccctatgagcaaggctcctcctcacacatggtcagccccacttctccacccagaggaggtagagcctgttctaggaactcctgttgaacatctaacacatcgtactgcactggcagcctgatggtctttatgacttggttagagacagatgatttggaagtgggaataaaaagctttcttccttattttaaaaagatttgcctttgttttatgaaattataacaacaacagttatcagtaagactttagtgcttcagagagatgttggacctcagataagacacaaaaggagatctcacttagccataccctcagcctgcaactagctctgcccttaggctctgggtatttcctgatctttgggatgtctactgtggtaatccgggaactggttaccagcatctattccctgggatatggaagcatctcaggaatagtaatgacttataattttatacttagaaaaccaggatgtcagtgtactaggtgactgtgggttggggaagaatattagacctcagaaataataagttaatatcaccagcaatatcaataatagtattactgtttatcacgcactatgctaaatactttactaataatgtaacataatcctcacactagatatttttattatcttcatttatagttaaggaaagtgatgctagcagatgataacaacatataataatacgtactgagcatttactgtgagctggcactgtgcccatctgccaagatcctatcagaatcatgattcaaacccttgtttttattattataggatgaaatctccttggggaagaggtaaaggatatgtggaaactctctgtttccacatttttttgcagcttttcattaagtctaaaagtaattcaaaataaaaaagttttttaaaaactcaaaactacaaagctcataatggccactctctgctgcctcctctggataatggcctcaagta

SEQ ID NO: 70221 - DNA, 1240 bp, Homo sapiens
agcagtgtgtctaaaacacagtctctgggtaaaagctttcactgagttaggcacagtggcatgcacctgtcatcctagctactcaggagcctgaggcgggaggatcacttaagccaaggagtttgaggctgcagtgagctgtgatgatgcctgtgactagccactgcactccagcctgggcaatgtggtgaaaccccaaatcttaatttaaaaaaaaaaaaaaaagctgccactggcactggttcccatcacctgtgataaagcccactctctaacatgccactctatgtgctccgcagcccatccctttcctgcctacctccccagcctcatgctttgccactcccaggctgaacttttagtaaaaccccagaaatgtcaaagcacctgttgctccagcatacatcacaccatgcctcagatccattccttcactgatgcttttccctctgcctggaacatctttccccttttctctaactttattttcctaacgtttgtttatcctttgagactcccccaggagttccttctctggtttcccccagcccccaccacaatctgggttgtatactcacttctgctgctactacaatactctgaatctctaatgattgggcagaagaagagaagctctccctgccttgctgcatgatgctagtccctgacttgcccctcccaggaggtggactcaggtatctaatgtgttcctttgtgatgctcagttcctccctctctcttctctttgggagctggtactccttgactccttcccgcccttcattctacagggcgggcctcatgcaggtggatgtggttgttcagcactgctagtgacattagcagcttaagtccctgtgagtaaggatgtgccattcagccctttgaactctcatactaagccactttcttcaatatcagctttattagtaacaaaggagatattttgcttgccatctgcctgattccattatatacctctctgtattagtctcttctcacactgataataaagacattcccaagactgaaagaggcttaatgaactcacagttccacacagctgaggagacttcacaatcatggtggaaggcgaatgaggagcaaagtcatgtcttacatggtggcagtcaagagcaaatggaagagtaaaaggggaaaccccttataaaaccatcagatctcatgagacttattcactaccatgagaacagtatgagggaaaccgcacccataattc

SEQ ID NO: 70222 - DNA, 1083 bp, Homo sapiens
tcggtttagaataccaagttgtggacttagaaattacaaagtaagacatctggtaagaaattttaaaataataatgaattgatatgtcttgttaaaacaatccttcagtgtggggaatttgactgtgttaggtcacagagtgagcaatagggtgaatttaaatgaatttttttacccttgcctatctctaaagaaattcccaactttgtctatcaaggagcttttaaaatgtttccatttataatttagtaaatgtttgctgaccatccactgcatacaggctatgtgctaggtattagatactgaggtgaaaaggacctagtttctgttgacagagctgctaggccagtaagggaagcagatgtataacaacatgataagtttctgatcaacaaaaacaggtataaagtaaacagtctgagaaagaaggaattaactctatgagagagaaggaatggttggtagtttccttgaagaggtagcactggagtcgagtaacaaaggatgcgtctggtgggtgatggacagtggaggatatttcagataagctgcacagcatgagcagcggcaccaagaatggggggttcaagagataaatatcttgacttttggtctctactgctgcagattctgcttctactgttctgagggggaccccaagaagctgcatttttgacaagcaccctggggactctcaggcagagcttagtctagctgagtgcagtcattcttaaattttaaattccttgagtagagattgttgtacttatcactattcttaataccttacacactacctggcacataataggtgatcaataaacaaatgttgaggaagaaaatcactggctagacatttgaatcataagagatgctctatttcttaagtaccttctgctttggctctgagtaaacaagtttactgtctccccagtcttctactttgagaaagtagaaggttgactgtcataaagacaaaaattaataaatgacatttttgatggaaggatattaggttattttagtggaagaaaaatagtctgctggtctgttttctaccttttctggctcaaaagtttataa

SEQ ID NO: 70223 - DNA, 1149 bp, Homo sapiens
ctaatttaattttgtttatcaattgggtacattgaattgaagtgcaatctcatttatagttaaagaaaagaccaacacaatgactgttcaatatgcatcaccattttaaggcctaagcagacagagagagtcaatcttacaatgatatgctgaagattacatttttaattctcttttcaacggcactaatagaaatcactttggcaatacatttcttggatttacataatgacagagcatgacaagattagttatcatttttaaccactgagttttctggcacgatgcttgtcattgcatctgtgtatacaccctttgcaaagctatggtgacatcagatgcgtacattttctaagccaaagaaataaacaccttcctgggccatgtggtgactttttttttttttacagtgagcaaaaattcaagcccattataaatgactaaacaatattttgagatttaaaagggccattacacaaagatgtcataaagcaagcattttctttaaaattggcatataggcttttacttatacagttggcatgtacatactgccctctgtctacaaaattcaagaaaaataattttctgccataagttgttgttcttctgtgataagaacaggctgttataaatatgtatgttctataacttattggacttttctttctagggtaacagaagagagagttttccatctaagaataagttttgtttctaaagatcactcctgcctagggtttttggcactcagaacatattctgttataaaagcagagttatataaatagtaatcaggttctcagcaattttattgatttcttgcctgggctgtgtttggttatgagaaggatgaagagtggagaccacttaaatagctgaactagagtactcagaacaagcctgagtttcctgtcttaagagttggggaccatggagttgatgagggtgtcaaaaaattaaagtgtttcaaaacatggaatttaagcctcccacctgccacctcgattttcttcccttttctgccactcctaagtgcctcccacctgtggtgacacacctggttgtgcctgtcactacagagtcatggtgagtgggagggggatgttaaccatctagatcttaattcagtctattggggcccaaatg

SEQ ID NO: 70224 - DNA, 1003 bp, Homo sapiens
atatttttgaaatttgagcttttttggacagataattataattcttgtaaactcaggagattgctatggatctttagtaacagaaattgtaaatataaacttaagcaataaatgatgcatttttcaaccattgttcctgctcctagaatttttaagtaagctacatacacacaattcaaatattaagacatttgcaattatagctatttatgaaacaatttgcaggattctaaaaccactactagccattagtgatagatactattttatagtagaaattcagagtggtggagctgtttatgacgctaggaaatgtttgtgctttttaaattttacggtaaaataaaaaccattagtatggcataaatttattggaaagtagattaaaatagaactactaataggtgtaataatttcatagttcagtcattttacagctatcaagtggctattatatatgagtcagtctgctgtatgctggttttgcgaagcattggagacagagttttctgaatattcacttaaatagaagataagacaaggaagaattataaaaataaagacaaatatgtaattttctagttatcgctatgatgcatacaattttccttaagatatatgctatagtaaagcagtgattaagcttgagtcttatagtcagagaggcttaagtatgtattctggggctgggtgcggtggctcactcttgtaatcccagcactttgggaggccgaggtgggtggattacgaggtcaggagatcgagaccatgctggctaacacggggaaaccccgtctctactaaaaaatacaaaaaattagctgggcgtggtggcgggcacctgaggtcccagctactggggaggctgaggcaggagaatggcatgaacccaggaggcagagcttgaagtaagccgagatcgcaccactgcactccagcctgggcaacagagcaagactccgtctcaaaaaaaaatatgtatcctggttttaccttccatcat

SEQ ID NO: 70225 - DNA, 1044 bp, Homo sapiens
cagtggcattaagcaccttcacattgttgcacatctcccatagttttaaaatttctttattatgacctaattcttttcttgtctaccatagtatttgacaccaagtagtgctctagtaatgtttgtgcagtcagatagattttcaggtaacaagtagtcattttcccaccatgtttatttatagtttcaatgattaaataaggcagatattgtataaaaggttataaacaggtctcattggacaactggataacatcttacttaacagtaaatgctcttatccaaaacattgcacagtgatcttatgtggttatagcaccttcatcccacagtccctaaaactaaatgtaagacatgtaaaaagtcaaatgtcaaaaatcattttatgacacaatttaatatctcttctcagcccaatgtgttataataccagcttaatgatagtccaaaagtggttttcatctttaatctcttttaatggtacttataacaaagacttcttttcttttttatttcattctgttttgtttgaatccgtgaaacctatttctttcttctttagcaatccagtaatcctccttaaaataatgaaatccacaggcagagaaaatatctaatgagatctctctaagaataaatgtgtgtgtctagaaaacttcatgggctgtatgactccaaagccagaagagtaggcttatagtctccctttgttatttaaccaacaatgataaaaacagcttttattttaaggttaataattatgctttccacacttgcttagtgtcttttcttcccaagaatacagaatattctattgatagaatgccattaaagtttcaggcattaaagtgacagggcagccaaaggcacataaaaagagagagagaaaggtaatatacatttttttttcaaatttgaattaagtacttttcctgcataacagttcagtactgtggtccgtcaccttctccccagcacactgggcatgggaaataccatgtatgagttttttttttttttttttttgtagatgaccctcttggt

SEQ ID NO: 70226 - DNA, 1081 bp, Homo sapiens
gagtgcaagatacagtgaagtgatgtggcaatattgctaacttttaaaaatattgtcaaagagatactgagttcgaggaagaggaagatagaaattatgctggaaatgctggagagataaggagtaatgagatgactttctgaggtgagctcatgcctgtaatcctagcactttgggaggccaaggcagatggatcatgaggtcaggagttcaagaccagcctgaccaacatggtgaagctccttctctattaaaaatacaaaaattatctgggtatggtggcacacgcctgtaattccagctactcaggaggttgaggcagcagaatttcttgaacctgggaggcggaggttgcaatgagctgagatcgcgccactgcactccagcctaggtgacagagtgagactccatctcaaatttgaaaaaaggagaaagagatagagggtagcctggaaatcactagaggtgaaacagaggacaatttgcagaacctagaaagaaaaaaacgagtcagtcacagtgaactgcaacctaagcaaacaagcatcttatgcaactgaggggaatgacatagtaacccctgtatccaagggaaggaaactgacccttgtttagccccataatttattcaacccacccagatgcacacatgatcgtggccagctcttctaacattagtattttttgccgcttcgcagctgtacctgaaaatccctgatgaatagttgtcagtctgcagagcccagggaatgttagaatgtaagggttttaacacaatttcaaaaaaaaaaaaaaaaatgacttgcaaactgtatatcaaagcaagcactgatgtatattcaatttgcagactacttttccagaaaatgtcatagtggatcttgtctagttccaatgtatctttatggtatcaatttatctacctagtgaaattctttccaaatatctttttaaatttttcatataactttttttcagggacttttagtagcagatgaatatcaatttaaacatttaaaatatagttgacccttgaattgcatgggttcactagtgtgcagattttcttccacctctgcca

SEQ ID NO: 70227 - DNA, 1101 bp, Homo sapiens
aattgttagagaaaggggagctgtttttctgagcatcattcttcacaaccaagcccgtttcaaggagccttggtcaaattggacattttttttctttaattgaatttctagctttgaaaattaaatgtgcatacattgaaagcatatgtgcccatatcacatatgcatctggctatgctgagagagaatatgaactcctccacccagggttgagaaagaggactttggttggctcctgcttccagcatgtcctagctctttaatcttagtttttttttttatctctccaagcctaatttttctcaaatataacgtttaaataatctcattatatattcatgagttgttgtgaggattgcatgagataattatccaaggcatctagcacagtgtctggcacattagtgctccataaatattaactgctcttatagatgtaagtttgattctaaatacagtcttcatttacctccctatagtttggcttgtattcttctaatgggatgaatcaacagaaggctaagtggtttttccaacatctttaatgagttaaaagcacttttggcgttagaactcaggtttcaaaccatctatgccatgggccaggagccagaaattatttctggccacagttcagattctaggagaaaaaccggagtgactgcagtcttaacatcctttgttgaagtcaagaactgtacactgatgctgatgctgacatttgtatcacttatgactcataggcacggacaggggtgaggatggtccagttaaattcagatggccagatccagctgaggaaggcaaacctgaaattagatcttttccatctagggtaaaagtggggctaggaaggccagacagaatgaaaaatcggtgatttttgcaagatgtatattcatcatcagtgatctaacagacatggcatagcaacaaggacatctgattgccagaccacacccagtcaccaggtttcttggcacagctctatctgaggctctccttagttcacattaagggcatctgtcagaagagcttggataaaaatggcaggactcagggtcacaggggagagctgacaaggggaggatctcagtcttg

SEQ ID NO: 70228 - DNA, 1094 bp, Homo sapiens
cctgaaaaagaaattactattatcatagataaggacaaggaattctgtacagctataggatctgtatttttgagtggaaggtagagaagctactgtcaatgaaaattgcctcctttcacttgaatatgtaatggaggaaaggtcctctacaaagatttcagtctttccatagctgtagcccttgtggcaatccactggtaactgatgtttttgaatagaaaattgattaatttaccggcacaccaattttaacactattaactttgtctggctttattggataatgttggctttcctcctcctccttgttatcttataatctggggatttgcacagtatcctagacactccaggacaggatcctggtaaaggttgagtgcatggccacacacacacacacaaaaaaaaagcctatttacgttatggacatcattgattcaacttgtcccttggaaagtatgatcactatttattctggctgatatattgacttcttccaggtccctggctcttgatccacggatctaattggatcagtcataccttggcttctgaaagggttcctcctcatgacccctactctgtttaggattcataataaagtttccctggtcactccaccagcttggataatagcaagactcctgctaccacccagacttaatccttccactttgggggaggttgccactcgcccagtggttctcagcattgtttctaccccaacatatttgggaatacaactatacctactagtaacctacagctataatcattccccaaaaatattttcaacaaatatttaatgagtacctgttgcatgccatctaatccctggggtagatgttaggtgagtaaatgcagtccttgcattctagctggagaatggttctcttctttatttatttttcatgtctattattgctaccatgggttttggacggctgcttgtttgtcttaagaagtagacatctcttccaatcaggaaaggctgctgtttctgtggtacattgaaaagtttcattttctaaatgctacctgttcttatgacagagaggtatgtactgttctttttttcaataagaatttaattc

SEQ ID NO: 70229 - DNA, 1010 bp, Homo sapiens
cttttttagtacgctgtactatctttacctctttcctttggtgtttctgaccttttcttacattttgaaatgtccctatccctctccttctgcatgtcaagtcttatcctttttatgatattcctctaagtttacttctacttgctctgtgaaattggtcatttctctctgctctgtgaagtgctttgcataattctcctacagcatttatcttctattgtagtctttcatgcgtgtatttgctttatccactggaaggtaagctgctcaagaacaaaaacattgtcttgcttatctttgtgtttagaactccaagtgcaatatttgggacctagtgggcatagaataaatgttgaatgaatgactacatttattaatcagcctgtttttccttattatttactctatgtgggttctaatttatttactctatgtaccttgtctttcttcagctttgattcatctatagtcttgagcaaacataggaagtctttctgttctctatatgaataatctgtaagtcatttgtgtattttcttcagggttttactgaccattcctaaatgctgattctgcaaaactgcagtcctttttactgactagtttatatatgttggagtctgacatcctattgaggtaatttggcagctttaccaccagggagccatagaaatctccgtgttgcttgttatctatggaccttatctgatgaagcaatcctttcagttatggccatcaggtgacgtgtaaaatgtttgtccctgaaattcaagtggcccctgcaaagcgatactcctaagtttgccttttataggaccagaatgattgttaaaaccagaagccaaattcattaatttcttgctgtgatatataacatagccatacaatactacacatttagtaaatgtcagcagtattaatagaactgtctgtaatataattgagtaagatttctgtgtataaaactaaattatgatggatgagttactcaaaggatgaaggaaaataac

SEQ ID NO: 70230 - DNA, 1098 bp, Homo sapiens
atctcatttacacatatgtaaatttatatatatgcataaataatgtattctttccttataatctctgaatccgtattacgtgaattatagttgattgtattcaatgtattatgtaactcatcttttattccctttggagttaaagatcaaatatttatttttatttttattgagccagacactctgtacatttcacagagttcacaagacaaccctgggggaaaaaaatgttggtattattaaacccattttgtagattaagagattgagtttcagaaaggtcaaatactttagctcttgctgggtatatgcctttgctcaaatctgaatacagacttatccctcatccccaaataagcttttcttactttgtgtgctattgtgcccattttccattccctgttggcctgaaataaaattcctttttaatccattttatttttctcttaagctttacctatgtttttcatcccaatcagaaggcacggaaagaaatgcttcttttacttcatgtttagcagatgtaacttacattttgagtctctgtcaaggatgtgtagcttgcttgattttagaagcttctgctgaaagatattcttttcatgtacacagttgcctcttggattgtgtaggcagcagtgctatggttattagtcaagttatttaatatcctttttgttagcttagttttcaatttttaagtagtttatacagccaaggaatctggatataaattttatttactcagtttttttaatcccttatattctttctagagatctagttttatttgagagtgtttaatatgttcatttccttctcagttcacttcttttctacatccaactaaataggctcttttggtatttctaatcctaaatccaaaactgtccttatctatttatgctctatttttatcataatatgtaacttaatcttagctaatcagctcaacctctcatcaccattattgccataactcagatgaatgtggcttaatttattataatgctattttgcccataaatggattctaacaatttattgttctgctagcagtggcctgcagtgggcagggacaatagatacctggaagcc

SEQ ID NO: 70231 - DNA, 1051 bp, Homo sapiens
tttgtttcaatttttgataacatagactataaacctttgcagattttcagttttaacatttgttcagcagaccttttttcagttacttgtggctagattattattgaatgaataccagatgtatacatccatcgtctatattcctttgtcaaaaggaaaaataaaactactctggaaaatcacaacagatcataattatttaccagcaggttgtcacttaacccctaaggggcaactaagaggagatgcatttattgtggctggatttgatgattcacactgctaagtgttaaaaggagagggaaaaaatgaaccatgtttatccaaggaaatgctgtttaagcatgacattcaagtgtgaattgaatacattgctggatccaacagtaacattttctcaccaaccatgaaaaatcttttctttttctgttgtgttctaaatcaaactcatatataagctttctattagattaatgcagctttatcagatactatcagtcatttaaccactttcagtaaacattcattgagtgtctgctatgggataggcgttaagaattcaaagttaaataaaatagtatctgctttcaaggatctcacaagctgattcagacagcaatgaataataaatatacataataaatgctctgggaacaaaatgaagagggtgattagttctgcctaaggcagagggaaagactttgagtggaggaaaccttgatgtatgatgaaaagataaatgaagatattggttaaggtaaataatgctagctgctacaacagagaaactcccaaatctcagtggcataacatcataggtgatttatttttcacttaggtcacaggtcaacagctcaaagcaggtcagcagtggtggaaggtgactgcgtgccacagaatgatttggggaccttggattcttcctactgttactttaccatgtcccagatccttagaataagtggtctacagatggaagtcaaaaagtggccccattccttccattcacattttattttctatgattcatatacgtagccacatctaagta

SEQ ID NO: 70232 - DNA, 1032 bp, Homo sapiens
caggagacaggttcactgcgccaatgagttaatgctcagttatacagaacatggtgtcccagccagaattttctaaagactaccctgaagcaaagatcgaaataccaatgcttcattggggatatacaaattcaggccagtgagatgaaggaaaagggaagagagtcaccaaaagacaaatatgatatgattgcactcacgtgaggtgtctaaagtagtgaaactcatagaagcagaaagtagactggtggctgccagggtctgggggaggggaaatggggatttggtgctcagtgggcatggggtttcagttttgcaagatgaaggagttctagagatctgttgcccaacaatgtaaatatacttaacactgctggtctgtacacttaaataaggttaagatggtaacatttatgtgctttttaccataatttttaaaaggatgggggaaggaggcaagggaggaagtaaagcaacaggaagcagtggttccagggctggttactgcttctcaagaccaacaagggacacagccattggccatgcagctgcacccacttgccacatggaactctactggataggctggagaaaagaaccacactccacaacagtgaaaaagagaggtgagggcatttatctgccctgctctctccccattctcatagggcagagttcaccccttggggagtgaattccctgacatttccaggttgcattggcctctccagctgtagtgtggactgccagctcccacatctgtgagtggccagagaatccagaaacttcagctgggtaacggagaggtcccactgcccagccacagcctcaagagaacattcaacactcccagagcaggtgacgctggtggtggaaacttagttccccaggtgggaggaagcatagccaagggagtatgaagatgtgcataagacttttgtctgatacacactgctatccttttttgtgctaatgaattcattgctactatacctttctttgttattttttaacaatgtaaaaggctttgat

SEQ ID NO: 70233 - DNA, 1067 bp, Homo sapiens
ccctgcaaacagcctcatatacaaaacacattaagcacagggaatgatgaaatgaaatcaaccagtattgtttattaatttgttagatgttttaataaagccaatccccagggcagaatcaatctgcgtaaccactgcacattgtatatgctccgattaaggcatttaatacattaccttgcagttgtgtgtgttcatgtctgtctcctttaaataaatatgagtttcctggagggcagggactttggctcatttctttttgatttcccagcataagcacagtggcttgtacagaatggtgttagtggtgtttgtagaattgaattgaaccaacttttgcatctatgcaccgaaggatttaagcagatgtttagccacaaattttaagttgtacagcatatattaaatcatacagcatatatgaagttgtacaacatatattattgaaattaacaataaggagaaaataggaaaagtattaacaagtaacaggaaaatgaaagagggaaaggaagactaataagaagactaagaagctccatccccttgtttttcattgtaggctcctctgatcagggattggggtcctcccagcctcctctgaccaggggcaaatgaaactgttgatgcagttgtggagtaggagtcttccttggggccaggtaaattgccttcagtctagaatctccttgttgacagttattccttgacacttactattgaggaaagttcatactgagcaagtgtaaatcaccagaaagtgtctccaaattcaaaatgcctgtatctcaaaattgaatgtcataatcatgggaagagcaaaaccatggagacctagttttcccattattttaatttattatgtgccaggctctgagttaagtgctatacaaatattaactgatttatttttcttaataactctgagggataggaaatgtaactatcctcattttacaggtgaggaaaccgaggcagagagaaataagtaacctgcccaagttcacatcagagctggtatggggtagagccaggactcaccccaggccacatggctacagaatcca

SEQ ID NO: 70234 - DNA, 1023 bp, Homo sapiens
tgaacttgctggaaagggagattttttttttccctcctatattcagaggatttgcagcaataagagagataacgaagtgtgtgtgctcaggatacacagacttttctccatgactgagttaatttctcagacatgtgttctgaaaatggtacccgtgcccttgtcccctggcccacagaataatgcagtgaagattcctcaccacagggaattcgctgtttctcacttctcatgttggggtctggtggccttttcatgcttgagtcattttggttattaggggagaactgtttcataagcatgcagaaagaggaggtaaaacagtggttctcaaacttcagggagcataatcacagggtggggagggtggcacctgaagtttacgaggcctcaccttgagtgggcctcagtatctccatttcctccaggggatgctgatggcagtggtccaagaaacacactttcagaaaggctaaagtaaaaaaaaaaaaaaaaatttccatttggagaaagattcgtacagtgaatacctttgatggaggcagtgatcctcaaatatggtccctccacagcatccgcatcacctgagaacttgttagaaacaccaatccaaacctactgcgtcagaaactctgggggtggggcccaaccagctgctcttcaacagagctccagatgattctcatgcaagctcatgcacaagacctactggattagggaggcgaagtgctgttgtggaatcccataccattggttctcaagagtggctgcatgttggaattacctggggaggtttaaacactgggtcacatgcccagagattctgacagagttgatctggagtgtgggctgagtacaagaattgttttagaggtctctcagttactctaatgtgcagcagtgtcctctgggtcaggttacctgagttttttttcaccctgttatgtgaaaaactaagcattgcttttgtcctcagtcaccactaataaaatatcaccatatcaaaaggatagatgttattgt

SEQ ID NO: 70235 - DNA, 1009 bp, Homo sapiens
ggcctcccaaagtgctgggattataggcatgagccactgcaccccgccaactgctaagttttcactttgggcttgtctggtaaaataagtggaggttactggtaccatgaaatagggagtatgccttattttatttataaataaaaatgggagaaaatctctatgacagagtaaagttaaacagatccctgacccgtttggcttaccttttcaagcttcattgcccatgtggtcctcagtcccctgcttgtgtctggccactttacgggcctctaacattggcttgccccagcttctccaggtgctgacccagcggtgaccgtcagcttgctatttcccataatcttttttgaaaagattaaaaaaagtctgtcccatgatgtgcaagacctgaatccttcttttctttttattgacagaaataaccctcacagaataatcttggtcttgaccaatctacaaaaaataaatttgggatcacttttgttggtgaacttcatactgaattatactctgtccatgcactcttgaattttaggttccctgaacaataacttagtttgaatttgaagtttgacagtcctaaaggactgcttttgatattattcatttggctagttttttatttatttcattctttattcagcatttgctgtgtccactatataaaaatgaaaacaaaaactcacatttatcgaacacttgctataagctaggcactgtgccaaatgctttatatgttttagttcatttcaataatccatgaggtaggctttattattactcccactttatagatgaggaaatgggggtacaggtggttaaataatttcctccaaggctacaacctggtgagtggcagatttgggataaaatgccatacttgaatagctccaacagttgtccttcaaacaagttactaatttttaaattataaactcataaaatattgtttagttctcttattatctagctcttacttattaaacctgagagtgtcagcaaggtg

SEQ ID NO: 70236 - DNA, 1704 bp, Homo sapiens
taacagacaagcactccagcttgttttggaaatcctttgtccacttggtgtaggaagtttcattttcccagctgccacatttgggggaaggtttcctctcttatatcttgccactcttgatggtctgaggcatggctaccagcttgtgctcaggcctaatttgggtctccagtgggtttcaataatcagtctaaatgagaaaagctctttccctcccatttgtgctatactttgtcacaagggcctcagagctgagctactttgtgctcaccaaagcctaaggggctttaaagaaggaatgcttttctatctccaatccccagagttccgcacaagcctagatgttgggggtaacacacaccaatgaacccaaaatcaggtgcccctctaacctgaggcctttaccttttcagatcaagtcttttagtaatagtagctttttcccttagcacatgttattttgttgatggtttcacacccctctgttaaagacatatcccattaatccttcaaaatgcccaactgtggctgaagcttggcaccaacaggattgatgttctcaatcagggactccaccaataaaatgtgttgctttcagcaattttctgaaggatatggtttatttggggttttagctccctgcactgtcatttgggattacattttagtattctttcttgattatatgacaattcctctgtgttttataatttctcatttaagatctaaacacacctgggagtcctctgcttaatcgctctctattgaaagtcagatgaggatgggatggagagctctagctctggacatcacaggaccaggtttacattctggcactgccatctatgagcacatgaccttggacaaataactgaaatcactaagcctcatttccctaaactataaaatggggatgatatcttacctatctcatggggctgttagaggaccaaatgagataaccatgtaaaatatctgcacagcatctagaatacaagttctccataagtcttggctatttagttatcgcctttattatcaccatatttattataattttcctgtggtcctttggtcctttttatgaaccatttgtatgtgcagatcctgttttaatatgttgaaaacttttctatagaccgtggcacttgcagtgagcctccacagatgtaacctcatttagatctgagacttttggctgtatgtggcccaaaccctaaggacttagacacttgtcagagctagtaaaataacatttcttattcattacaggcttaaagaactttctttctttctaaaccaacagcaggagactctctggccttggggtgggacccagtaggctctgaaaagccaggtcatttgtgtaactctgtggatctgagtgagcctaagaactgactcattcctggggacctctctgcgctgggattgaccaaaagtaaattatctccaagtctctttggaccaaaatgaaccccaaatttaattcagccttaacatataccctatggatctatagcaataaacaacatatgggcattactttatgatgtactcaatggtttgattttaattttatcattggctttataggaattgctgtatctatgtgtgtgttgtgtctgtgcaaggtcttgtatgattatggctcaagatatacatttaaatatagttgagacttaatggtgcattgtattacta

SEQ ID NO: 70237 - DNA, 1005 bp, Homo sapiens
gagaagccctgcgggaaagaaaactctttattccagtgtttctcaaattgatttgaccacagaaaaccatttttccccctagtaacacctatcagtatatcacagaatatcaattttctgcacagtagagttggagaaagagcagttgttttttctctgctttttattttataccaaatagaggtgaattatataactttataaataattattattaaatatatttaaaatttttatcttcatcaaatgaaaggtctctgtccagttacaggctagtttatagctgattgaccacagaaataggccacagatgaagtgaatatttttgtttaggatctattttgtaatagattccatcccagaaccagttagattaaagctaacatgacaaatgtttaaagctaaaattgacaaatgaagatgattttaaaaaaccagacccagctattaatttcctctaactatattacattttcagatacctgaaatgtggccaggggaatgattctacaacttctactgtgttgtcaaagatgccaactgatgactcctctcacgtgtattttaaattatggagatgtatttaacagacactgtcaactttaatctgcacatagaaattcttaattgtcccaaccccctttgtttcagcttgtttttcaggctttctaatgcattcaccttgcttcttcctattctctctcctccctctctgtgctccttaaaaacatccactaggctggcaattaggggctgagcacagatgcatcctttaatttaatttcacattccatcatttgaaacatgacccagtgtgtctgcttatggccttcagagtgctgggaaatcaatatgttaatttacctccatctttccaaatcatctttgcaagcaagcacctgtgaaatgagaggcttgcacaggggagggagtgattctgtgtaagagacagccccaagtacctgtattctccccctccccctctttgttaatgagctatattct

SEQ ID NO: 70238 - DNA, 1736 bp, Homo sapiens
aaaattatgacgattatatggaaagtaaataccatttttgttcttctgttaaccttgatagtcttacaatatgaatgaattgaaaggaaatgcattttgcaatgcatgatgaatgagcctgcacttcttaaatgtctcagttctactacaggttagatatttagaaagaatgtgaggaaaatcaaatcttaacgcaagctgtcttttgccaaatataatttcttatctgaattttttcatattgaactcaaacttgagttcaatacttgagatagtattgaactcaaaactagtatttttttagcactttaaggtataagtggttacctagactctatttagaataccttatcttaaatatctgtggatacttaagaagaaaactgtaaaatcgatgtgttggccatgaatttttaaccctgcttatcaaatgttgttaagaacattgccaaggaaataaagatgtatcattaaagcatgtcatgtttgcaagatcatctctctgagtgttgattaactcctagacctttaagcacagccacctcacttataagttgctgccaagaggaaaatgcgggtgccactggttagccattgtcaaatggatgtatttttctcagatatgaataaatgagaactggactgtgacacagaaacaaactatgcactttttttccccatgacattataataatcaagaaacaatgtggccaggcatggtggctcacgcctgtaatccaaacactttggtaggctgagatgggccaatcacatgaggccaggagttcaagaccagcctggccaacatggcaaaacacatgtctctactaaaacagtacaaaaagtagccaagtgtggtaatgcatgcctgtaatcctagctactcaggtagctgaggcataagaattgcttgaacccgggaggcagaggttgcagtgggccaaaattgtgccactgcactccagcctgggtgacagagtgtcttaaaaaaaaaaaagtacctttactcatttgcctttcagctgagaaatatggcaatgcactattaattcaaagaagcagtattgccccttggttaaaatctcagactccagagtgagaaatgatcagaatcctggcatctctacttaactgatttttaattttgtcaaagtatgttaacttctctaaccatcttcagtttccttctctgtaaaatggagataactgttatacctatctatcatctcttgtggagaggagagcaataggaaaacttaggcagagattgttacatagcaagcagtaagagtaactacctttgtaaataggaaaaatctttcatgagtcaagagtactgggttctgatcccagctttgtcactaactacctatgcaatttggggctatcatatcagttctctgaatcttagtttccataaccagaagtgaaagaaattgattgcatgatcttgaaaattacttccaattctaaaatactattctggttagcagaagcatttaaaaactcaaactaaaacaaaaagccccctccgtttctaattggtagttaattatttcagtctttacttaaacattcctttatgtcagggaaagaccttttgtttttcaccacttctatttccccaggaacttcattgcctccagttccagagaaaggtgttaagaagaaaattaacaaccacttgctactgtgtgaacactaactgctcttaattgctttctttaagatagctt

SEQ ID NO: 70239 - DNA, 1066 bp, Homo sapiens
tgatttttattttgcaaaatgtggttgtcatatccatctagcagaatgattttgattttctacccccaactccaaattcctagtcgtcttcaccttttcctcaacccttattccattcaaaaagctataatttcaatacaaaaacttagtgtcacttgctaaaccaaattgctttatttttatttttttgtgtgacaggatcttgctttgtcacccaggctagagtacagtggtgcagtcatatctcactgtagcctccatctcctgggctcaagcaatcctcccacctcagcctcctgaatagctgggactattggtgcatgccaccatgcccggctaatttttaaatttttttgtagagttggagtctctctattttgcccaggctggtctcaaactcctggcctcaagcaatcctcccacctcagcctcccaaagtgctgagattataggtgtgagccaccatgcccagccctgctttccttttaaaggttacttaagtgtgtgattgtctgataatccaagttattattaatgaagtttttgttttgtttggctttattttatttgtttttgcttattaacccaaatgaatctctaaatgatggaatttcaggcagagtaagagagaattttggattgggtcactttactacatttggctaagtatattctacttaaataaaaggacacattttgatatggggaacttgcagcctctcccacccgaaatatttccatcgcctcaacctttttctttttgagacagggtcttgctgtgttgccaaggctggagtgcagtggcacaatcagagctcaccacagcttccatcccccaggctgaagtgatccccctgtgtcagcctcgtgagcagctgggactataggaaagtgctaccatgcccaactaatatatatatatatatatatgtatgtatgtatgtatgtatgtatgtatgtatgtatgttaaattcttggaagagtcagggtttcaccatgttgcccaggctggtcttgaactcctgagctcaagcgatctgcccacctcagcctcccaaagtgctg

SEQ ID NO: 70240 - DNA, 1045 bp, Homo sapiens
caaattaattatggaccattatctatttgtacagcaaagtttgtatattatagttttggtaataaccattgcaataattataattttatattattttaaaattttacaatgctataacatacattgtcctttttggtctttctagccatcttataagttgataaattagctgttgttactgttattcctcattttatagatgagaaaacaaaagcactgaaaatttaaatggcttatccagtgtcacacaactagtgaatactggcattcctcctgattcacttatttccaaatcttatgggattttctcctctcctgaatggacttagagctctttgaaacaagctgcccatccgacttaattctcctgtgcctagaacattgcaggttctcaatgtgtatttgtaaaacagattcatctaaactagaatggaatttcaagtgtgagcctttttgtaaagaattttactactcaaatactatattctgtcaacctaatagaattatgctgtgaccttgaatatactgaaattgcattttaaagtcctaaaaataaagtaattgagagttgtcttggaaaacataacacaaaggcaaaggataagtattttattgttaatctatttaagtttaattcctttctatcagttatcttttgctgcatgacaaattaccccaaaatttggcagcttaaaaaaacaaacatttcttctctcatagtttctgtggatcaggaatactggtgcagcttagctggatactcgggttcatggtctctcagaaggctgtgaccaaagtataggctggggctacaatcatctctcggctggaatggggagggatcccttctaagctcaccaacgtagctgcaggcaggatccaagttctagatggctattgtatggagataccagttttgtgagggctttttctcccggcaaatgcccctctccactgagcagctcaaacaaggcaactggtcactcttagaataggtgggccagagagagcaagaaagggcatgcaagacaaaaaaaacacagtt

SEQ ID NO: 70241 - DNA, 3021 bp, Homo sapiens
gtgtgtcataatcttctctgtatttggatcctaaacatccattgagcatgattcttaagctaaaagtacacttaccatgtcatcagaggatactaaaatgtatgattgctttatagtcgttgtttgttttctgtagaacaaaattattttatgcttctccctagtctttcaagtgcactccattataaagattcttaatggcttttgtatgtccaaggaaagattatatgtcaaagaaattatttccagaaagtgcacaaagttgtacagggtctttcaggttacagcccacagcatcaccatcttctgtgctttgtggagaattagaccctttatattgctattgtagattatgttactatcaatagataaacagggaattgtatgttgcttgttggaataagttattttctacataacttactatgtgttaaatatgattcagaggattggacttttatgtttaaaaataaatttaatgtaagatgaaattcctgttttctgataattatctgaactgcttttcacgattgagtctagccaacaaacttaaaatttatgtgtagtttcagaacagtggcaaacattttgtgaaaacaggtgcttttgattactgctaagctggtcttatgttttcacattgtgcttctgctggcagtagtatgtggttcctgaattttcaggtgcagaaaataacatttgatttgtgaagccccatttttgagataaaactaggcacatgtcaaatgtaagcaatatggaatgtgacgccaacagtggcatccttgctgattctaaaaattggatataggttaacaaattgctgtagtggaaagttttacaaatgattacagctctggttaatacttgtttttgtaaactgtaatctgcctgcaaaaaattaacttctgcaagtattttgaagacatgaatatgaacttatacctttaaaaactttgctcagtacatttcaccctgcttataatcgtgatcacttttaggggaacagctgttaaaatttagggtgagatgtacgggtgctcagcagttggttgtaaatttccactttatggatttacagtggtctttcattattgaagtagaattggggaatccccatcaccttaaaactgttatttatggctggttttatctaccaatgccaagttttcatgatttataggaacaaacacctctctcttttattcttaaaaattccaaatcttctgtgtaatggtgtttttagcactatttggaagatgatcaggcataaaaggaattttaaacctaagaactgttgggatcttccaatccagccctctgattttacataaatttaatatctctaacaacagagtaatttgctcagtaattgtttaaggcttaaagagagaaaatgtctaactcaagattacacagctcagaatagaagtaacgtaagtatttaagtctgtgaacttggtgtatttttaatcgtatcctcccccatacacttcccattgcttcaaacactgccttcatgtgaaatttcccacaaccctgctcactctcccaagggttagccctggagcccctgtgtatgtgaatggcacccccaattactccatcgttttgtgattacttacatacagtgtccttttgtgagtgccatatcctcatctttgtattccagcatctaagacagtgcctggaccatctatagatgtttctgtcttaaaaagctgtgaagaagactgattcccataagccacccacagaaacctatctcattactttgtagtcactattcgtgtatttgaaatgattaggaagtttagaaaaccatactctggctgtaagaatcttagtttgccatatcaatgattccgatgctattcctctccatctactactctgtgtagcacaggaaaacacagctcctgcaacagatgttttgagaatccaaatgcaaggaaaatagaaggggaaagcagtgtttatactttataagattcttatagacctacctttttcttttcaacacatgctacgaagtttattatgcttgatctcctgagatcagtgcatgctaggccctatgcttcgtaatttatgtgcattagctcatttaatccacacaactccatgagactaatactattatctttattttccagataaaacttgagccaaatgagcttaattttctcaatgttacacaattgtcggtatgttagctattatcagccaatatgcattaagcactactatgtgctgagagccatggcaggaatatcccagctcccaactgcagtgctgtgtgccatccttccccatgctgccagtcaactgtgccttcatgatggcagcctccatcctcgtgatgggttgataaactcctgagtcagcttggatataattccacggctccaaaaggagaaaaagcagcaaacgcaacatgctgttatgactaaccatttttgtaatgaggtgaatgttcttctcagtacgttcattcaattattttgtattcaattatactttgaataggagaatttaccttacactctagtgtgactttgttgttgttgttttttttcccactgaatctgaaattagggactgatgtatgtaattcacagcatacttggactggaagaaaatttatcaccaaggtgagcaaacagatccagtttagagttgggaccttgactcagctttgtgtataatccctcagcaacgtagtacaagagcaggagggctgtgacattgtcctgtgtcatgtccagccatcacaatatttgaatatgaatgcattttgtgtctgtaatacctagaactcaaattgtgaaaagtggaacagtaaaaaaccaatgcatctatataaacaaaaatgtgaatgtgggtataaaactttcataagatcagagagttctctgaggaattccaaataaatctagaattcatgagaattggaaaactatataggaactagttttatttatttatattttctattgctaagtcacacatgaatcatat

SEQ ID NO: 70242 - DNA, 1619 bp, Homo sapiens
tgaacatgttcatttccagacaaggcaagttactgaataaacctatgcctcctttaaatacattgtaagttatatgttaagttgctggcttatttcaagaaatacaatatgtgttcaaaatctatatcttgacccaaataaacatagactctattgaatttaatgtgcaataagatttcatgcctcctttttattcacattactctttcacggatgtaacatatggcatgtggaggtgagtaattccttcaatgctatttctgttttaactatacaaacacagaagagctctgtattgggcccacatccatgtggtaatttttatttcttgttttctacttattttttgttgatttctacaagatcaccaaggcttctatttatttaataaaaagcatattctagtgctttctgtttgcatgatgtagtggtcatcatttgtctgccttaaaactcctttttcattccccttggaagagcaatgttcatatttaaaatgctcctgtttctccttcagttctgtcattattgattgatcaaaactgtgataatttgggttacaattatagaaaactaccacgttttagtctttagtgatttgtctgttcataaacagctaggtcaatcagaatgctcctgtgagagtttgcaaattcaactcagtgcactgtgctcatggagaaaccattctggactgggagggaatcaagcccacatccaaaggagacagacatgaaggatcaagaggctcctctcagggttgtattcactaattccagtccttaaggtctctaggttagagaattagaaaggaccagaactcagattggaactcagatcagctagtttcaagtttgatagtgttggtaagctcttatttggaaaatatgattctttagttattttcatttgatagtaataaatgccaccgatggaaactatattctttccataaaagttcccatcctcccaaaatataattctcttaatgggactaaaaaactatgtgactttggatgaatcacctgggtcagtatgcttcttcagtttcctatttgtaaaatggggttctaaatcccagtggagagtgctgaagaccccagagagagaggaatcactggcaggtgtagtcagtagagctgtgtctccccagggcagcatacatcccaaacagctggaagaaggggatagctagtgggcaaatttggacagatgacgttccgcttagcagcataactgcagtgcatttaacattctttgcccttacttttcatttagagagttaagtcttgttttagagggaacacacaacttccccatgtacctctcaccagatcattcaccatgatgccagatggaaacatgcctagtggtgtattagaatataatagaatttttaatctgctttttaaaatttgaagtgttagaattctaccccactatctcactaactattacataatcttacaaccaaaaagcttttctgaaacatccaaccatgggactgagttatttggatctgtagatttaaactaaacgtcagcaagtaggtttatagatatgtagaaactgagctgaatttcagttgatatccaaacctttgaagacctctgttttag

SEQ ID NO: 70243 - DNA, 3305 bp, Homo sapiens
tctgaactggtatgaaaaatacctgctactacctgccatgataatattagctttgtgatcttggacaaaccactaaaacaccattgaacctttttttgctcatccatagaggtataatgacattcacctcattattagagctgttaggttaaattaaaagattgtgtattattattgtcatatatttagtgactattcaggtctaaaatccagatcttcaaatttctcattcattatttgttaattgttctagtttgttttggttgagggaatcagaataataaaggatttgaaaccaaaaaaaaaaaaaagaaaaaaaaaagaaacctaaggacaagtgatttttttaatttaaagatgttcataaaacattttatagcatctttttgtcagcatcattaagttagtgtttctttccacaaacttactcctaaggcatacaaaatgggaaacttctgggaataaaggaacttcacagaaccattgaaagtaactacatattttagatgtgatatgttcttggctgatgaatatttgcctttctaagtaaatttctccctgctccatcattatcaatttatatctgaaaatagggaactgtgtaaatctagaagacagacaaattgcttgtgaatctaacagagagtgcaaagtgcagtcagttccctctgggatgatcctacaaacttgacattacacagatattgaactatctttattcagtaagaaggctttttaaaaattatatttctgggaacatggagctgcagtatatcattagtttcataggtaatatgctgacatgcttgattaattatattgtaaacaaatcagatttttcctggtgttaaaagttctctttcgcttaaagacctgaagaagaaagaagctatagagaaaaaaaaattattcatgattaatgctgacctctctagactttagagtacctctctcgtctactatgaagtgtttctgattgtggttcttaaaaataattttttaaagcttgtgatttttagagataaaggatgaacagcatgtgagcatattatgaaatttctctttccactgtcttcaccaagaagaattaagttttgtttgctgtttagcccatttactttcatgtttttttaaaaatgtaacaattgagctaggtttatatttgagttcagtctaagttgagttggattatttgtatttcttttcccttaaaccaggcagtttcctttatttgctgattatggtatgctgttactaagcctatgagaagcttctctgtgaagtgcattttaatatttaaatcaaacagtgattggaatacattaatgcccagtgggtaaacgtgtcatttgaaagcagctgctgagccttctccctgctgctccaattaacacatactgcacactcctgtcagcaagagggctgtgcatatggatgaaaccactttgctgcttattaatatgatatgcaagggagcacaaagggttaatcagtacgcccattgcaaaacaatagcttttcaagaggtttcccaagcacatgttttgagataatgtgggctaggattagggtgttggattagcaggtaggaaagtcagttcagtctctaactttggttcagtccattgactaatgtgtttccccggccctcccttctcctatacccccgccccgatgatgagatgatggagatattggatagtgaaattctcgtgctgggactcctcttgcctcagctgaatctcttgaactttgttttgaagctatttaaagtccaaagctttgctgtttgttttttctcttagtcttttattaccatttcattttctttctcttttcctcttttttttttaaaaaaattacagatttgacagtttattgatctaaatgagaaatattgtcaaggtaaacccatatcgctattattttctttcccctccgatggccaaagtcgccgtgttgatggtagcccagaggtagatagaagggtagctgtcctggtccaggtttggtattggtcattcatgctccaccggctcgcagagcagctgggctgttgctgtgctcttgtgctagctgtgccgcgctgcacggtgagtaagagatggaccgcttcctgggttttgtcaaggcgataagaagatctaggagaagaaaggggaaaaagtaccgaccagaagaggattaccacgagggctatgaggatgtctattattacgcttcagagcattttcgaagtaagcgcttctctccatcctccggttccttctcgcatgctggggctaacaataaaccttgtgtggagccttaatcttaaatgcaaaaggtttctcagatggtgttctctgtgagcagtctgtaagtactgaagtgctatgttttgcttgatttgttgcaagaacagccattagataatagcatctagacagtgtcaccagccaaggtctgtacacatcgttaatattttaggtgaaattaattatgttattttaataagccattcaaaaaagttgcaagccaacgtagtaggtggccagaatatgctctgttgtagttgttgctttcctttttctttcagaatagggaaggctagctcatttggaagaaataattgttcatgttcaagttgatgttaatgcttaatgctcctgatacagacttctagacagttatctgtgattaatctcaggtgttgtttgtacaaggaagttcaagtacctttctctgatgcatgtttacaattttgttattaaataaggttaattcttatttgctgtcagctagaagcagtgatacctgtagtatccgtaatatgtctatattgagacatttgaaacttagcttataaatagaagagaactagcagttttcttttatctgtcagcgctttaagtttctggtaaggtttagacttgtcccactagatttaaaatgcccagaaatgcctaagggtgcagagagaaagcagctatgcacagagatcactgagtttatgatgtgccccaaatgggggaagatgacagttatgtatgatctacatttttaaaaagctaaaaattatttatttgtcttcttcaataaggatctttataaacttatatttcaattctaattcgttctggtcttttgatgtctaatcatgaatgcatcccacttataaactctgagcattaactaataaataatttaaatcccaatttctgtggtattgaaagccatgagaattccttctaaatgctagaaattctgttgcgattgatgaagactgagggttgaaaattcatgtggtggcaataatacaagaa

SEQ ID NO: 70244 - DNA, 1032 bp, Homo sapiens
atgtattattaaatatatatatcagcattaagacattttgtgtttaagccaggtgtggtggctcatgcctgtaatcccagcactttgggaggccaaggtgggcagattgctggagctccggagttcaagatcagccagatggtgaaaccctgtctgtctcaaaacaaaacaaaaattagctgtatgtggtgagacatgcctgtagtccgagctactcaggaggctgaggtgggaggatcgcttgaccctgagaggtggaggctgtagtgagctgtgattgcaccactggactccagcctgggcaacacaccaagattctgtctcaaaaaaaaaaaaaaagacattttgtgtttaaattatgtgctcatgagttacatgatctatgagtttcagttagtaagaagggatattacaaatcatttgctacaataaagtaggagtgggtctaatgagaataccattagtgccagagaacagagtgtttttttctttcccattctcatcctcagtaggtcagggtatctctcccaaggctacatgaaggctgcagcgattattggcattgcgtgcagatgctatgaaatctaaaagggccagattaatttaatgtcttaaagatttctcttatagactgtgtgtttcatactgttactcaaaaaaaatactataaccattactcaatttaattatgcattgaagggaaccccctaatcgctgatctaggaaaggttataaattgaagatttaatctcaatagctggtccatttcttttttcctaaaaggggatgaagaatccagttcagaagagtacggaaatcatgtaaatgctatataggcaattgcctacttcccaaaaaagaaaataattagtacttgaaaaatacatatttgttaacatatatttgcccttgctggttgaaatgcattttgttgaatacttcaaactgctttattttctcatgtgaacgaatttttctaataaatttaatattatagtttagtgaacatttagctcaactgataaccaattt

SEQ ID NO: 70245 - DNA, 1018 bp, Homo sapiens
agtgatactccatcgcaaaatgaataaataaataaataaaagtaaaaaggagaggcagaaatgctggataactcaaattggataaatggctgttaaaaaatctaaaactcacaagtgctttaaaatacttgctattaacccaaataagtttgcttgtaaatcatagctaggattgggggccaaagaaatggctttaagagaaaaaggccgagaaggcaggaaagatgaatcacatggcaatgcatttagagacggaaaagaagagaaatttaaattagattatttatgacagcttagaagtgagaccacaggaacaaatttaaataccaagaaaatgttcctgtagccaaatgaataaataaaattctcagcttttagaaattcagtacttgggtaaaaaccaaccaaccaagagacaaatataaataaataaatatgtataacttaaagtaagtagacttttcttatctccaagtagcttgaaaagaacaagttggcaaggagaaagaagggaaggagggagggaaggaggaagagaggagagagtcagagagagagagagaatcagagagagacaaggaaaatggaatgaattccgggaaatagaaggcattaggtaatatattcttcagaaccatcaaacattgagcttaaatagattccgtgaagtctcacaattaccttaaaagacactataattagcactatatttttcatcacttcaaagcatctagctgcataaaaataacatcttgtagctagaagagactttctagtccaactctttcctcctaagacacatacaccttcaggaaaaaatgagttccgatacaatgaacatttttgaaatccttataatagtcagaacggcacacttagcattttacattcagaaattatttttatgcttttgctcttttatgctcattctacacttattgaatgaacatattctatatggtagaaaaaaagtagaaaaaaatctttgaaaactcaataacctcagttatctgagccc

SEQ ID NO: 70246 - DNA, 1023 bp, Homo sapiens
ttcctctgatatggtttgatgtgtctcccctccaaacctcatgttgaaatgtgatccccagtgttggaggtggggcctagtggaggtccttggatcatcggtgcagatctctcttgaatggcttagtgtcattctttggtgatgagtgagttctctctctattagttcacatgagagctggttatttacaaggagcccggcaccttttcctctctcttgcttcctttctcactgtgtgatatacttgcttcccctttaccttctgccataatcataagctccctgaggccttcaccagaagcagatgcctttaccacatttcctgtacagcctagggaaccgtgaaccaaaataatcctcttttctttataaattacccagtctcaggtattcctttatagtaacacaaacagactaacacacctcctcatctataatatagctccatgagaggagtgttaccctcatatgcactgttctatctttagagtgtgaatagtgcctggcactagagacacacaggaagcatttgtcgaataaatgaatcagatttagtgtgagacaagcacatattcttcatagttcatggaaacatactgtttaaattattcaagggcctttaatgttttcctcctaaaaagtatgtcaaacaccaaaatcaaccagcaagaatgtgaaataggaccagttctaaaagttggtcaaagccatcatggattaaacatctagcatgtgactggcactaaatacattttatagggcaaaaaaatgaatccttagagctgtagacattctaaaagtgtaatttaagctaacagttttaaactctttacttgaacttgtaactaaagctactatcaaggcgaatgatgacttagaattttccctccatattctgtttcacacctaccgcataataaatatcgaacatgtaattatgtgtgtgaagaacaattgagtaaataaatgaacaaacagacgaatgaaccagataaatgctcaataataaaagtaaagaggagg

SEQ ID NO: 70247 - DNA, 1057 bp, Homo sapiens
ggtccctttgccttttgccatgattgaaagtttcctgaggcctcctcagcgatgcagaactgagtcaattaaacctctctctctctctctttgttaaatataaactatagtctcgggtatttcttcatagcagtgtgacagaactaatgcatataccttattgatttatttatttaatttttctataaactcattctccccccagaatgtaagcttcattaagacatggtcattgctttttttttttttttttatggtatcactagtacttagtgcagctggacacataataagtattcagtaaattctttgttgaattaataaagggacaaatatatgttagactatcggaatgtaacaataaaaaggacagttctaccttgaactcacagttaaataagcagataattacaaggtttcataagaagcagctataataaagtgaatgaaaatgaaaagaaggctcctttcagtaaattaacccttattatcaataacaatacatttaaatttttcttgctatgtaccaatctccaagagcttcatgtactcatttaatactcacagcaatcctatgaatatggtactattgtttatcctcatttgtagatgaggaaatggggtacagagagtttaacttgctcacagttgcacagctgaaggtggtacatttacttctaaaataaaattcatagatttataactatatataaagtatgtaactatatataaaatttataactatatataaagtatatacacataatatagacaatagtttaaggcacaacccttaaacctgtatctccaccattattcctatcatagtaatactatcacagtattatccttccagttattcacaccaaaagtcaaagaatcatgcttgatttctttctgagaaccctatttccactcttgcccattttccataaacaaccagaatattcatcttaaatgtagatcatgtcacttccctatttaacactgtgcactgagttctatgtgctcctaatgcatgtggaatagaagcccacaatttgtatctgggcctgga

SEQ ID NO: 70248 - DNA, 1050 bp, Homo sapiens
gtgcctgtaatcccagctactcgggaggctgagacaaaagaattgcttgaatctgggaggcggaggttatggtgagctgagatcatgtcactgcactccagcctgggtgacaagagaaagactccatcccaaaaagtaaaaaatacaataaaattttcagttttagtgtcaaatatggtacatatcaataagtaaaattcatataaacaaaagctctttgatgtcctcagtaattttttaaagagcagatgggtcttgagaccaaatttaaaatttacgctttaaaatgaaatagtccgtgggaaatatatatgtgtgtgtgtgtgtgtgtgtgtgtgtgtgtgtgtgtgtgtgcatactgaaaattatgtatatatatatactgtgatgaaacaagtttgctgcctgtcagagagtcatactggcataagagtgtcataaaagcacttagaagtcttacagttgaaaaacaggcttaattttgtttgacttggtatttctcaggctcttggataaaatcttatttgttttctgaggaaaggatgttcatgaggaatcgtcttttgcgaatactgctttatttacattttgttttgaagatctagtgccttgagtaggttaaaatgttataaaccccacagttctctagtataaaatataaagggggcaaccttaatcatgaagcaaatatatgaacatatttcatgagcaaatgggactgaggatctagttttgtttttttcaaaatgactttaagattctgtaagaagttcaaagtctactgttagaattcttgtttcttgtcattcagaaaattttcattgatataggataaaaagaaggctgttagtcatctgaaaattctaatacttctttaaggttttgaggctatattttaaaatggtagtctcaagtttttgtgttttcttaaaatgtaccagtgtggtttagtgaaagagtaaggacttagaggacttacataaggttggttacaaataatgtgtccataatttattgaatctttaatggataagtttataaatatcagca

SEQ ID NO: 70249 - DNA, 1056 bp, Homo sapiens
tcattatctcccaaagtccatagtttatgttaaggttcactcttggtgttgtatgttctatagattttgagaaatgtataatgacgtatgcaccattatggtatcacacagaataatcccagtgtcctaaaaatcctttgtgcttcacctatttatccacccctccttctgattactagcaacccctgttttttttttttaattgtctccctagtttttccttttcccaaatgtcatacagttagaatcatactatgtagtctttttggattggcttctttcacttagtaatagcattgaattttccttcatttcttttcatggcttggtagctcattttttttggtgctaaataatattccagtatctgaatgtaccatagtttagttatctagtcacctactgaaagacatattggttgcttccaaattttggcaattatgaacaaagctgacataaacatccatgtgcaggtttgtacatggacataatttttaatacctttaggtaaataccaatgagcatgattgctggactgaatactaagagagaatatttagttgtctaagaaactgccaaattgtcttcccaagtagctgtaccattttgcattcccatcagcaatgaatgagagttcctgctgctccacatcctcaccagcatttggtattgccagtgttgtggacactagacattttaataggtgtgtagtgctttcttattgctattttaatttgcatttctctaatcgcatatgacttggagcatcttttcacatgcttatttaccaccgtgttagccaggatggtcttgatcacctgacctcgtgatatgcccacctcggccttccaaagtgctgggattacaggcgtgagccaccgtgcccagcccagcgtatttcaaaatggttatttttccctcttcctgccaaaagcaggaggagatatttcttcagtattcactgtgagaacctcagcaggtttcaggaggtaaagctcactaaagtaaggtgcctccagataactgagtctccctggagtttttatctttcaggct

SEQ ID NO: 70250 - DNA, 1084 bp, Homo sapiens
gggtagaaaataaatggatgatgtggccttaaaatttgaaaggtgaactcagtgtcaacaattccaagtatcatgcctattcattagttttaatttttttagtttagcctttggcagtctcttgctctctttaacctaatactatcacatatggcatcatctatagttatgattatatctaaaattcacaaggcctgcaattctataatttattaaagcctgtagaaaaggtagtgtgtgaatgttaaattaagataaaataattgcctcaccacaaagctggtaatttatgtcatcttgggactagtatttggtccattttggaccctgaggcatgggagtccccaaattagggcaagtccaggatttgacagtgatgtgtatctccttcctgtgggaggctgcagtgaaagaaccatggaaagacagtgtcgtactttcttctcagcagcttccaaccaccaatgaagcactaagaaaactagaacttgacacacttattcggtagtggccctataagcaagatatgtttttatgaaaaagaatttatttttaagtttgaattatagacacatgtctatctaatttttgcagtaatttcaaaatgatacctcaaaagagccagtgcttgtttactgaggtagggaaaaaaggcaaatgtggaagggagaatttttttcatgtttttcaaatcaacattgtcattcttgcactaaagttgaatcttctaagcattaaaatagatgagtgttgcatacagactcttaaggtggcctgcatagcacctgtctcctggcattcatgcccttgtgtgatcccctccccttgagtgtggatagcacctgtgacttgcttccaaccaatggaacagggcaaaggtgagaggatatatgtgattacatctacctaattatgtgattagtgtataaatttgtagtgtctgtccttttggcactctcttgctctcgctgtcttgtgcgctctctctctctctctctctctctctctcacacacacacacacacacacacacctggttttgagtaagtgagcaacctctacaaactaagggcaagccccagcc

SEQ ID NO: 70251 - DNA, 1489 bp, Homo sapiens
gtgcatagactgaggcattagtgtgtgtatgcaaattataaaataaactcacagatgaatactgcatgcaattaacttgcagaattaaatcattttgaaaattctcataattctcatagaattatgtctattacagtttgacctcataagtaggtgacataggagtcatctgcatctgtatactcattttcccataatggtccctaataggttcattagggactccagaatcactgattgggcaattttgcttgctaaattatttcaaatgtccatttttttactgacaccaaatggtaggatgtttttctgttcaataaatgcagggttttttcattttttctctgtttccttttgtgtttttatttgaaatatgaatctgttgggaattaaattcaaattagtctaatttttttcatagctatagtcgctatgataatgctcagtattgcagtgacaagcccttagtgtcttgatttcattgctgtttgctataaaacattcaagtctgtggtagagatcttgtagtatttgtgatcaaggcagctcattgtttctgcccctactctgacttgccctttaaaatgtctttttcagcgctaagtttaaaattggctacatagaagtctgcctttatctccgaccccaatatttcactctgacaattctgtgatccttgtgcctattctgtcatcctttcttacttggtgggcttttcttgtttttaacctcttccattttctctcttgcccagtcaccactgctaccaaaccaaaaagaattacctgaatcaactcacctatttttatcagtccaaatcaaagtacattgtgcccccttatcgggtgatgctctgtccttgtactttttctctactattattttaacccagtcactgatcccaaacattcctcatcagattctttggctttattatgtctaagttgatttgttcacatgcgtgaatgagcgtgttgtgcctctgctgctggcaagattcttgtctgatcagagttttgcgtctcctgtgtttactctaggcaagagactcctgtcttattagtgtaatcttgatgttccaacctcatcttggtatttggtaactattttaccaatcacctgctgagctttttcactttgaaacacttgaaatatttttaaagttattagaattggtactctaaaaatcatagaaacaaatggtacccaatgatagagtaatggagaatataactcacccactgccattctggaaagaataaactcattgcctttaccccaaaattggttctcctgctcgattttttttttttttttaggtggagtctttctctgtcacctgcccaggctggagtgcagtggcctgatctcggctcactgcaaccctgccttccgggttcaagcgattctcctgcctcagcctctggagtagctgggattacaggcatgcaccaccacacccagctaatttttagtaggcacagggttt

SEQ ID NO: 70252 - DNA, 1003 bp, Homo sapiens
gattttaaaaatatgttagccagttagaaaatagtagctgagtgacctgccctttaaaaacaaaaagaggctcactgggctgtctgtgcatgtttgaccttgtcagtcaggcaatagagggccagaggctgacataactcctactctcttctgcctctcaggcagcccaaatgaccagttagagagtttggggactcttgttctatcaagcttggcacacagtaggagttcagtaggtttcagtctaaatagattgctcagtagtgtgaaaatcttaggtatttcagagttaatattatgccctgatgtaaaatgaattcactttataaggtgaataataacatcactggcaagaaaaatgtcaaccaatcagctaggagaatttttacatatgcctcattaacagtgcagcccttactgtcgttgtctaatgatcttgttccttccctgctcttgtctaggacaaatatttcttttttaaaagttgcctcttacgttgttttgtagtcattccccagcagattaacattagaaaaatgttgggttttcacaattgtattagtgattaaaagccaccaccccaaactgatagctcattattgttccttaataagaataacctccactgctttatacttgaaataataactttggagatggaaagcctcaagtttgcttcagttggcaatcaatatcagaagcctattattattattattttaaatccccaagtagtagagattttcctttaattacatgttgatgggacattttatcttgtgtgcttgaggtagctgtagctgcagcttgaggcacttatgggcttgaatggggcttgaatttataagcctaaaccatgaaacagcagtgcaggaccaaagcctgggaatacaaatatccaagttaaaataatttcccatttgggtcaaggattaaattattgaatttgcaaccttattgattataatggctacctatagtatctattaaacacacttatcaa

SEQ ID NO: 70253 - DNA, 2061 bp, Homo sapiens
gttaaaaccaaacaacataaaaactttgcaacctgaaaatacagtaagttgatggtttactaagtcttacaatacagtttcattattcaacagaggaacattctaatccagaagtattccaacatcttgaaaatgatgtacccacctcaggaacccacatctggattcataagaagcactgtataaaagaactaaagtttaaattgcttcatgattgcccaggggtgtaggtagcttcctagaggaataatgtattcaatggataagctgttaccttacccttaaaatcgttttctaaattcttttttgactcttagatttgtaatataactcatctccccttttgtctcactttgcctttctctttaaccgattaccgttctgtttagctatatgtgctctgggttataaagtgtaagtatctccataagtcaaacatggaaaagggacttaagaatattttctggaccgatatccttcattttgtagatgaggaaagaggaaactgtggcacagaaagactgagaaactgggttggagctctccagctgcagaccgacagagccagaaattgaactgggctcctattcatgtgctttctccactagaatatgtttaccagccaaaaggtagctggtccttgaaagtgaagaagggggacagattgaagatgtaggaaatattttgtttctttcaggtcaggtctctttactcttgggctagcccacatgccttttagaaaccaggtaaacatttatgtatttatttcatttgattcagcaaatagtatgggcttcacattgctattgaggtgggggtgaggaaggaaggtaaataaaaggattttttcatttttgttttttgagacagggtcatgctctgtcacctaggctgcagtgtagtggcacaaacacagctcactgcaagtcttgacctcctggattcaggtaatgcttctgcctcagtttctcgagtaggttggattacaggaatgagccactgtacccagccaaaaggatttttaagatctaacagaatttgcagtatcattaggtagtgaaaaataacatggattgcagtgttagataataaaaaggatgtttcaaaataagtgatgaagtagatgtttagagagaaaggaattgatgctggctggagtgacctgtgcaggcttcacggaggaggtttggatgtgagatgagccttgtaggagatggaagaaatggttatggccagatagaagaggacaaggtctccttagcaggaaggagcaagtgtgagtgagtccagcactgaggtatgaattgtagctgtccaaggtagaaagctcatgccagggagaagaggtgctgcagaaagagttcagatttttgtcttgcgggctgttaatatgctggatgcagaaaagtgacagaactgtgctttaggaggatgaacctggcagcaatatgcaggatggagtacagttgggagaacctaggtggataaaatgcaagaaatagtgaagactgggcctagaaagtttcagagacttgcaatcagaatcccatcccggaaagcagcccatcaattgccatcctctcatttataaatttgggactgtgaccaagaaagttgatgtgaattcctcagtatgacacagaggttggtgaaggaactgggtagagtcagaatacccataatttgactctcaatcagttttcttattttttcatttaaagaaatacaaaattttgaacctagggaaaaaagtgcctttgaaatgaattttaaaagttgagtagggagttgtaatttgagaatgcagtgaattaggttttactgtttatttaaagttttgactaaatgaatagaaatgtctatatagctcattgttttatgccatagtttagatattatttctcccaggaaaccttctgtgacccatgaattcaggttattttaccctcctatgtattttcagagtaccccagaatttacctaccatagattttccatgctgggttgtaattgttggatggtcagccactcctttggattgtcagctccccacagatagga

SEQ ID NO: 70254 - DNA, 1053 bp, Homo sapiens
atggagaatatctattcctttaccatgctgaataacttcatagtactgaaagtgaagacatacattaacaccccaccctcaaaacaaaaaaacatggtgaatattgttgagagacttgccctggaaagcatgatcaaaggaaaggtaggcagtgtttcctctataaacctcacactcctgagatactgagctaccaaaagcctccaaggtgctgcaccagttcacacttctgtgctcgacattaatatggctttacctgtagtttcagacactccatcatctctgcacacttgataagcttgtacttatccttcaagactcagctcaagtgtcctccagtctttgaagctcactgatcacatctcttttcctctttctatgatagcttactactcttattcttgtctccctattttgaatttatatgatgatatgccttacctccctgcacctcaaaatgagctccttgaagtcaggaaccacattttattcatttatatatcctcagtgcctagagcatagatggaaaatacccagcacttaacttatgcctccactcttcaattctgtgcttgaggaaaacattgcaaattgttcttttttttttttttttcctgagactagccagagccccatagtatttctgaactccaccctagagatagctgcttactacagattcactgtgagtgacacattagtttcaacttccttgctaccactggcctaacaaaacacctggctcacagtagttaatcattactatttttaatgtgaaaattatattaaaataataaaatccaagctttggtttcacttttttattattattatacttttagggtacatgtgcacaacgtgcaggtttgttacatatgtataccatagtcgtcatttaacattaggtatatctcctaatgctatccctcccccttccccccaccccacaacaggccccggtgtgtgatgttcctcttcctgtgtccatgtgttctcattgttcagttcccacctatgagtgagaacatgcggtgtttggttttttgtccttgc

SEQ ID NO: 70255 - DNA, 1095 bp, Homo sapiens
cttcagatgaagaattagtaataggacaggactatctattaatgctgagctgaggaggactaagaagccaagtattttcccccaagtgcaactggtgctgcctgctagttagtgttcatcaggatgttgaataacacagccctgcagcacccacagagcactatttttaggaattgcccagattgacagtgatctcttcaaaaccattttctgaggttaatatagttgtaattacctacacttatatgatactgcttgttttgtctaagttcatttgatgagtctcccatagagaatggaattagacatcccagtaagataagggatggcaactactttttgttcctgtagattaggaggattgttgctcagtctgagaaaattattttattcagagtcacttttttttctacttgtattatttatttatgtagtgtacttacctgaaagcataaattaatattcgagtttgaataatggtttagaagcagaatcatgtgcagttggcaaaaatgaaacttgcttcttgtgaggaacttatggaccatacacaaatgctaaaggaactaaatagcttctatttctgtgatggctaatactggtttttttttgtttttttgtttttttgtttttttgtttttttgttttttttcagaaaatgtggagaatatgctagtcttttgggcctcattttgctatttcctggcaatttgttgcgtttagtattttagagtcaaaaatggttttgcttctggcttatttggctgatatcaatggtgaattcacattccttcatatggctcatattcccaaatgtgcaaagtgtggtgtagggtatggtagaaattgttaggaaaaaatacctggacagattcatagggattatgtaataggaaaactaagccaaaaagcctagtcatgatgggtatagtgatcatttgttgatgggcaaagttatctcattctttaacggaagagctctgatacatcaaaattttcccataaccaacaaccacaaaaaagtcaccaaattaatgctaaaaatactagatcttttttccaggatgatatttttctccacttcaattagtattt

SEQ ID NO: 70256 - DNA, 1058 bp, Homo sapiens
ttgaggcagcaataattttctggatttgatctgcagagtaacagggagtttgataaaggtcagcattttctaaaatgctataaacaggtcttatattttatttttcagagacagggtctctctctgtcacccaggctagagtgatcatagctcactgcaaccttgagctactaaactcaagtgatccttctgcctcagcctcccaagtgtctgggaccacagacccacaccaccatacccagctattttttttttatttttaatagaaatgaggtctcactgtgttgcccaggctggtctcgaacttacaggctcaagcaatcctactgcctcagcctcctgaagtgttgggattccaggtgtgagccaccacacccagccctaaacagacctttaaaaattattttatatggtcagatcatattattgatgactgatctttgtcgacctagtgtagatctcaattcaagaatatttatggagtgtcaagttaataagtataatgatttataaaatagtctctgatatttggagtttatagactgtttggatggataggacatgtactcaaaaatcatggtgtatattgaggacatgaagagtattttaaagaagaaaaagagaaaaaaaattgagtatcatcacttttggcaggggtggaagagaagccatgagatccactcgggatccacacatgtgaagtgcttagagggcccctggttgaagatactctttgtcaatggtggagatggttcatgtgattaagcaagatcttgccaagtgttggagagggaagggcatgccagttgaaagaaacagcagtttctgctcaaaaccttctagtggtggcacagctccctcagaataaaattcagcagactcaccctgccttactgggctctcagtacaattcagtgtggtccttggatctctgctcctctgagaactgctatgggtctgtgaggagacaggttcagaagctttttgtagcagtagttattgcactgacattttaattgcattttataaaattatcgatctgcagtggatcctgaaaa

SEQ ID NO: 70257 - DNA, 1038 bp, Homo sapiens
cgcagtcttgaacttctgggctcaagtgattctcttgccttagcctcccaagtaagtgggactacaggcatgcaccactacacttggctaactttttattttttatttttttaagatagggtgtcactatgccacccagcctggtcatgaacacctggcctcaagcaattctcccatcctgacctctcaaagtgctgggattataggcatgagccactgtgcccagcctgcccttaaaaagcaaatcatttaagagtaggtgtttctctaatttgttataggcttttcttcatatgatgataggtttttaaatctgtgtttcaaagccatcaaattggggacatcaataaaagtcgcagccatgggttgggtggtccagaaagaccaggaaaagtaaggctttggttatttgtcttcttcttgctttacacagacccctgggtgatagttttgaggttaatctcaattttcttctgtaggttgaccgaaagaaatggagagttacatatagaaggaaaaggttaactttaggaaaaggagaaaagtgagtttggaaaataagcagaagtaggaaaattgtggaagagagataatctaaaaatataggaagaaaagcatacagatttgtatttgcatttgtatgttttgctttaaaacattaaatcgtgaggggaaaagattatttgtttcactctgaagattacaagaagatagagatagaaaaagctgagggggagataatgagaatgtgggtgggtagatgaatgaatgggtgggtggatggatggttggatggatggatggttggatggatggatgcatggatggatggagtaatgaacagaatgtgttgttgaccttttaaaacagtatgtgtcaaaattttggaggtccctttgcagctagaaaataacatatttctatccatgcaaaaaaaaaaaactaccacaaagatctgctagctctatttagatagtctgtcttattggcttcttactcttaaggaaagcgttttcctcattgtctaaagaaaaaagt

SEQ ID NO: 70258 - DNA, 1653 bp, Homo sapiens
gcatggagtaggcatccactgcccatcagttcctgtctcttggcccagtatgatcttgaactgagaatgatgaagatgaagaagatgatgatgataccaacatttattgagtttttgttatatgccaggtatttcattaagcacctcataggtattattttataatcttacacatccctataaggtaggtaatatcctgttttacagatgaggaaactgaggcacaaactgcccataaaactaataagttgcagtactgcaatgtggatctaggtagtctgatactaaatcttctttcttatgcattgatagagattttagtaggtttcttgctattcgtgctgttctatgtctgagtgaatgctagaaatatataactgggaaaaaatagtgttctaaaacaattatcacgtattttcatcaggtgattatgtttgaaaaagtagaaacaggcaagaaaatcgcagcattgcctaatccttcaacagtctgcattccagaccctaattcctaagcaaaaggccagaagacccctcttcccaacctacaccaattctaatagcagggttccaacctctaactttgtttaatcctcacatcagtgctgagattttcattattaacacttttatttacacatgaaaaaagtaagtctcagaaggatcatatactatggtcaaggtcacacaggctataaatggtaaaaattaggctttgagtgcaaatctcacattctcaactactgcgagagctataatgttaaagtttccagtgcaatgcagtagttcagcacagtgagataaggccataaagcaatgtggcagggagaccaaattggcatgtaggctttgaaatggagtggccctttaatgaagtagtaacatacgaaggccatgactgtaaatcctagcattgacaaacagtttacatcctgttgttcatgtaccagtctttccagtgtgatagcacttgttaccaataatcctgtcagaagcatgaacccagtctctacctccttttcatcttcatgtccgtgctcaaatttggcgaagttcacacaagaaataatttctgtatttagattaggtgcattcagaatgaatagaaataacacttcaaaactagaactaaagaatacaactgacttcagtctaacagtttaagcttttataccacatcagactatattgatattctctctctttgcaccaagggatgttctgtggagaaacagcattgctctataagagattacattaaaaaactggggagtatgtcaacacataacattaccaaacatttcttaaacctatttttttcaaccctgatttacatcttgggataaaattaaattcacaaattttcattctatttagtaataactttatcatttttctcttaaaaatgcctcccttcagctatacccatagacctggaatttggcaagtatatgcatatttgccccaactgtctcatggtatgtttatttctgtcatatgcttatgattccttctcctgctgcagagtctgctgatcattttaaagcgatggttctcaatccagatcattttgtcacccagaggacatttgacaatgtctggagatatttttggttgtcacaatggggaaggtgttactggcatctaatgggta

SEQ ID NO: 70259 - DNA, 1072 bp, Homo sapiens
caacagatgtgatttagtgagaagcattgccagataattccaactcagccataagtcactcttcaattcttccctgatgaagtctcagattttggaacagaaagaacatatgtcctctgtgtcccatccaatttcctgacccactgtgtctgtgagcataataatatcattgttattaagttttgggatagtttgtttcacagcatagttaactggacaaattgataaggtaaacttgacattttaatgacagagcattattgtcggctccaaaggcctgaacaaagcctttccttttccgtagaagcagtatttattgaaaaatttagagaataaatttacacatttagagtaggcatcattatagcaactgtcactttgaagcaccagatgtttttttatatatattttactgttactggttggtgcctgtaccaccttttgtagtagatacgaatccctggcttcctggaatatatccagatttttagttgaaagaaacacaaaccttgcctgatcagccaggaagagattttattataggataaataaataaattctatagctcacagaattgtcagggagggttggaatttaatataggaacagttgagtgtaaacttacaggaacaatcctagaaccatgcattagaactggtctgatgagaaaaaactgcaacctgtgctgttgcctgatgaacataaaggaaatccctgtactgactgtccctgattgttggatgcctctgctgccaccaatgccagcaaaatagttaggactccccctaaagcttgtcttcttagatttcttgcttccaaaccaaagattcaggagcaactgactaactggcaaaacctcctgcaggtgcatgtatcctagctggaagggagtcttggaacttgagttttctagattctgctgttaggaagccaaatcaagaaggctgcaaatttcccaaatatagcaagggtgtaaaaaggtgctgggtaccttgaaaacttgacagttatgtatgagctgggttgtattaaaagaagacaaacagaagtctggctggccacaacaatgaag

SEQ ID NO: 70260 - DNA, 1070 bp, Homo sapiens
gtaaatcatgcagaacatggaacagtttttcccactggggaacagtaatccccagtgttggaggtgggtcctggtgggaggtgattggatcatgggggaaaaattctcatgaatggtttagcaccatctcagtgctaatctcatgatagtgagtgagtgaattatcacaacatctggttgtttaaaaatgtgtagcacctgccgcgtctctctctctcttccttctgctccggccatgtgaagtgctagctctcccttcgccttcttccatgattgtaagtttcctgaggcctccccagaagcagaagctgctatgctttctgtacatcctgcataaccataagccagttaaacctcttttctttataaattactcagtctcaggtatttctttatagcaatgcaagaatggactaatacaccatatcatgaaacataagtcttcagaagttaaaaaaaaaatctaaaacctgccagatataaaaagaatcagcactgtggtatatgaactatatattaatggaagcaatgcataatcataagattgtcgtcaacagacacttgttgtgcaacaattatgtaaatgtactggggcagaatcgatggataagtccaaagccctggcctgaaaaacaaatacacattccattttaaaagatgctgggtatattttcttctgaaaaggattggtactttgactaatagctctcaggtcttacttttgcaatcacacagtaatagcatttaaatttgccaaaagaataactgatgaacctgtatcttaaaacagcacgtatctccaccagatcacatgctgatgaagacagatgtccttcaagaatcttaagagaccctttgtagcagaacttgtttttgccagaagggagttaggaaagatttcagtacatcttttggcagtgatgataagatgtagagaaacgtaattgaattttacaagggaaaactcagctgcaacgatctgctcagtgggaaagatcaaaattatgccattatcaacaccatctttcatctataaaactataggaaatacatgaacatgataaaaatcc

SEQ ID NO: 70261 - DNA, 1298 bp, Homo sapiens
atgatattgaccaatgtgagtgttgaccaatgaactcaacgtcaagacattttacctctactacatcctccatttagcatggtgtatttcttttgaatccattgttaatttcctgtcactttaattaacatggctgtatttgacattatcctaaagttttcacccatccccccaactccctttttttagcagatcttaccacccacaatcctagtgaggttcttgggctccatctgctccttcctttgtgcactcagttctcttaaacacatcggtcctttgctccttcccttctttgcatggctggtcattctacatctggctgtcatgggctgacctctgctgaacctcaagctatctggtcttgtacaaattacctactctctgtgcctcatcatcagctaccctcatttccttctcgcccctgcacaatattaatcacttgcatttctcccagtaggccttagcatgaacactgcctactgtgtgtagacacctcaacctctgcttaattgggttcactctttcttacactgcagttgactctggcatctggaccttagacatgccggccataggctcccataccctccttgcatacctttattatagtgctagttatactgtatttcaattgcccataagctctgccttatctactcttatactgttgtacctacagcagtgactggcacatacggtttaagaaatttaaaaaatatgcactgcaagttgagccgtgaaaaaataaggagtgaatgaatgaatcttataactagttgccattcaattcattctgccttgacagtgcctcttaactctgttactatctttgtcttccctcctttgctgttcagcttcctccagctgaagcttttgtttatttttggagaggcgattctgagtgctgtttggagagtggcttcacatatggtctttggagtcttgctgccttggtttgtagcctatgtggcttggtttgctcagtatgtggccttgtccaaattacgtagtctctgtgccttatttatttatttatttaacctataaatgaatgatagaaataatacccccttccacagggttgttgtgtggattcatcgagggagttcctgtgtagcactaagcacctggtatgtagtaaattataattatatgtaaactatttaaactgttgcctccacttttttttttcctttttgcaagctacttcagacttgcaaataaaaatagagattaacacagcaaacacctatgagtgcagccccagtttaagaacaaaaataacaagatagtaa

SEQ ID NO: 70262 - DNA, 1099 bp, Homo sapiens
gaagtgcggatctcagttccctgttgctagcaaaagcgctaagcggtctcactgaaattattaacaaaatacgtaggttaagcatgcagccttttgctctgcatttccccatttctgtgctcttaaaactgctattgtaatgttaaacaaaaggcactcacatatggcttgagtaaaaacctgatcaatttgttgccagaatgccttggagagctaacatttagtaagtgtaatttttctgctcacacttgcatgtgcactggcatgatcaccctctctaattcagtgatagtagctaatatttttgaacaatgtgccaggcattatgctaatgactttgcatgcattatctcatttgatctttataatgctgtgaagtagatgcccattttgcagatgtaaaaacagaaatttatagaagttgaacaacttgaccaaggtcccacagctggaaagcaacagagctgaaacccgatctgccctcttctccactatgtagtatagtgtccaaacggggatgtctttgtgaaatgggacactgttgctatttacatcgggatgacagttataaatcagggctttactatgcaaaccaggacgtatgttcaccctaactataaaccctctcaagggagagcttttgatcattgagacactaaaggaggaacctgggggtcctttttaggtcctttccccaagtttggaaagtccttagtctctaatcagattcagttttcactcagaaggggcagccttccatgaatgtgtctactgatgtaatacaatgtaaacatggtcagggctgtaccccagtccctctctacttatattatagagttttcatttgcttgttcaatatagatttattgagcaccatgggttgggtattttgatgggtactgtgaaaatgaagatgaaaaaacatgatccatgccctcaaataatttataatctagtgtgaagactaaggccaaaaattaaggaatgggcagtactaaagggaaaggggtgcacagttgcaatgggatcacgactggaaatgtgaaaggggaagatgagggagccccaaaggagagtggcattatgggttttcatgtgg

SEQ ID NO: 70263 - DNA, 1793 bp, Homo sapiens
caaaaaaaaatgaaaaaaaattagctgggtgtgatggtgtgcgcctgtggttccagctactcaggaggctgaggtgggaggatcacttgagccccaggtcgaggttgcagtaagtggtgattgcactactgcactccagcctgggcaacagagagagaccctgtctcaaaataaaataaaataaaataaaaatgaataaaaaagtcatttcttaggtttgtgcccctgaccagttgaatcagaatcaccggggttagaacttgatttctgtgtttgttaaaagctttttgaagcctagatgattttgatgcacaccaaggacagacagctgctgatctgggcctattgttatctaaatttaatttatatttaactacagtagcatttttttctcttttggtggagggtgcatctaggaataaatatcttctctggctaaggaaaagcacttttaacatgggatccacctctctgtttcttttagtatattgaacttcaaagtttttaaagaaaagtgtaagcttataatcatttcttagaggttagtttcttaagagattttgtattttagaatagaaatacatgagacatactctaaacactctcaaagcatgtgtagaatgttcaaattacttaaaaggtcaaataaatatctgttgtaaatattcttgacctctagaaaagaaaacacaaaagacctagatggagatatctatagtttatgattatgtcactagaaatgataacagtactaacattaataggctccttatatgccaggcagtattttaagtgccttaaggcagacactcattcaatcctcataacaacctgtaaagtgggtacattattaatcccattttacccctgaggacgttgaggcacagggagaaaatttgcatttataaatattttgtaaatattataattaggcattatgatttgaacattaatccttctttttcaaacatttctatgcttcagcagtctttcttatttcctaatactgctatattttgaaaagctaactttcattaaaatttgttttactcctaaggcaaagccagaaggcgaagtcttcaaacaactttatctcctacactgacgcagttagcaaagccagaaaaacaaagcataagatcaagtggttcatgcaccacagttttaattgctttactttctcgattccccaactttccagatttgaaattcatttatctaaagagtgatactgggagatggtgagatagagtgaaaagggcacatggagacatagacctctcgtatagctctcacttaggtgtgtgatcttgcaaaaattcctatacctgttgagacttaatttatatgctataaaatagggttagcaatagtaataacagtaattaacaacagtaatatcagtatctgccatcacttcttcacggtattgttgtcatgatcaaataaggtatttgttagggagtgctttttgtggtatgatgatatatagatattaatctttaaaattaattttatcttgctcttattgttactgttattatcttatttttgcttagtactgtcaccaactaaaagtggttccacgtgtccagggttggtagaggatggatgaatgggtgctgtagatgggagcccagctcaggagtctcctcttatgggtcgttaggagattttacatttgggaatatgagagcattttcaacagggaaacggctcagttagatttgctttcaaaaagaaaatgttgactgcagagagagaagagatggggcaggttgtaactgggcttc

SEQ ID NO: 70264 - DNA, 1018 bp, Homo sapiens
ttgtagtagagatggggtttcactatgttggccaggctggtctcaaactcctgacctcaggtaagccacctgcctcggcctcccaaggtgctgggattacaggcgtgagctgccgcacctggcctgaaattatttttaaaaaggaatgtatgtaccacatccgtgcacagacaaacaactagacttacaatagagaaaggtggcagataggaaaaataagtttgagactggactctggcactgactttatttctttggacaaatcatgtaacttcttagagcttcaattttttgtagttcaactctgtcttctagcattgcttctttattaatgtcccattatgattataaaaggccaaaatgtttatttaaatgtagtcttcaaatatttttagggcactcttactcagatttgaatttatttatttttatttatttattcaatgatatttgatttatttaaatgtggcttttcacatttgatgatagcaactgtgttcagtagaaaaacatattataaactcacaatattttagctcctgttagcaaaaataggaacttgaaattctctagatctgtggttcctaaccctgactacacattcctgtaacctaaacaggctttaaaaatgtcagttctggcagggcaaggtggctcatgcctgtaattccagcacttttggaggccgaggcaggcaaatcatctgaggtcaggagtttgagaccagcctggccaacatggcaaaacaccgtctctactaaaaataatgtgaaaattagctgtgcatggtggcacatgcctgtagtcccagctacttgggagcctgaggcacaagaattgcttgaacccaggaggcagaggttacagtgagctgagatcgcgccactgtactccagcctgggtgacagagagagactctatcttaataaaagtcagttcttggctaggccctgtggttcatgcctgtaatcctagcactttgggaggctgaggtaagatgattgcttgagtctaagag

SEQ ID NO: 70265 - DNA, 1744 bp, Homo sapiens
ctcagtcatattttctaatggcatctcctcatctgtcagctctttctcaaggtactttcccatgagagagaaggaaggaaatctccatgtcaaagcatttttcttcctactgatttaattttatggtttttatccttgtcgtctttaaggagcatggctacctcaatgctctgtggagggaaacaccaaacagaggctcatccctcccagtgtttagcccctgtgatgaggaggatgcagatactcctcttctactttgtattcttcggtcatcattctaaaatcaccacatcagcccacatccttctggtgcaaccttcagatgggagagaaatcctttcttgttacttcctgactgcagccaggccatccactgtcccatccttctgaaagtatgtgctttgtggccagatatgaacattttcccaggggtagctgctctgctaggttcttgatacgcaaaacttgagcccttgagaggttctggaccattgagtcccaactgcaacctacttaatatttcatagtaaggctatgcaaggccttgtatgaattttaatcattcttgacattatctccaaaatggttgggacttttgctagtgcttgtctaaatatggactaaatcttcatggtggaaaaaaatataaaagctttaccttgctttgagatcttttcacttttacttcattaagacaaattccttattgaagtatacatgacttctagttactttataacaattataaaattgctgtttaaatgcactatgtaattttagaataacattaaaatatagcaacactttactactttccccatttccctttcaaatccatatgttctctgtgatgttaagtctctgaggaagacctcataaagtcattgagcatccactggtgatcctgcaagataaaagatccacagcctgtgtttcaattctggcattaatgaagttctttctagacacagcacacctgttaccctgtcacattctctaccctcttgctaaaattcttctttaggcagataatttctttttcagatctaaagatggttaacccatcagtatgtataataaactcatttgtgttccagttatgattatttacatttattaaaattttatctattcttttttcccctaattttatattccctgatgctaactatttgatactgagcagagaatagtatttagttgcagctgtagtactttcgaatgttgtgtcatctttctctgacacccagactaacaagtaagttctttaacagcattactcagcattatccagttttgacttgtgttcacctgtgttcatgttaacagcatcagtgttttcacaggcaatttttttaaacctaaattatagttaaaatcagttttacctaaaagttttaattttagttgggtttgcattcaataagattaagcttagatttctaatcgtcataaggtaaaatatgtttgtggttcaagcattgcctttggagcaaaactgacctggatcggaaatttactttgccaccaaatggctatgttcacgagcattttaagttctctgagctggccgggtgtggtggctcacaactgtaatcccaacattttgggaggctgaggtgggaacattgcttgagcccaggggttctagaccagactgagtaacatagtgagaccctgtctctactaaaaatgtaaatattagccaggcatggtggcacatacctgtagtcccagctattgg

SEQ ID NO: 70266 - DNA, 1070 bp, Homo sapiens
ttttatactgtatggttccacttatataacatgttcaaaatggaaaaatcatagtgatggagaacagatcagtggttgttggggtttagggttggggaagggtatacctgtaaatgagtggcataggatgtttctttgtggtgatggaacagttctgcatccattttgttttttgtttttgtctttgttttgttttgtttatgaggcagcgtcttgctctatcacctaggctggactgcattggtgctatttggctcactgtagccttgacctcctaggctccagcaatcctcccgactcagcctcccaagtagctcagaccacaggtgtgcaccaccatacctggcttatttaaaataaaatgaaatttttgtagagatggggtctcatgttgcctaggcttgcctcaaagttgtaggctcaagcagtcctcctgccttggcctcccaaaatgcagggattgcacgtgtgagctaccacatccattccagttttgtatcctgattgtaataatgattgcacaaatccatatgtgtgataacatttcatagcaaaaatgtgtatatatgtgtatatatatatataagtgagtaaatgaaaagagtggtagactcctgaaaaggtctctcatttagataaagtattgtaccaatgccagctgtgtgatgtactatggttatgtaacttgctctcattggtgagacctgggagaaggatacacagaatttctctgtattgtttttgccatttcttgtgagtctaaaattatttctaaataaaacattttttaaaaaaggttctctctggaagttatgttgaatcaacactgaagggacaaaggggaagcagggagaccaattaggaggctgctgtagtcatccaggtaagagatgatggtggctgggaccaaggtggaattggtgatggaattcctacctgtcccttccaggctgtgcaatgggacaactttaagagccagagtctccagctgtcactaccctgtcaccatccctactatcatctctggaccccatatttcacctgtgctcaccctgacaccacttctgccc

SEQ ID NO: 70267 - DNA, 1019 bp, Homo sapiens
cttccctgtggattgcacacacacaaggcatttttaggtataacagactttattgaatgtttggggcaacagggatcagttagcagttccatcaccacaacacaacctcaaactgaatttagaattttctgtttctaaatgtcctccagtcatcccatcacagaattctcttaggtcacccttgtagcaagctccagtctcttgcagcttcatcctgctccagttctagctatactttaaatacagtttttctcgcattttatgcacagttgtctagctggcaactccttatttgacttcatgcctgcctttgtctaaaaatttgttaatatcttgctaaacaaaatgaccattgattctttaccagtatagcagaactggcagtgacttttttctcaatgacaggaattttaactttcccctctgatataagaagtggccatagtcattttgagttttaaacacatttattatttaggctaaactagtaacaaaaatgtattagtgttgcttttaaaaatatgataagaaacacagtgtactatggagtgtatataacttcctcatcttctggtaaatgaacattaatatgaaagtaaaccagtaccactggttacattaactgcaggaggtagtggtgggtctgcggccagctttacctttggggagaaattcttgaataaggcagtggttgctaatcaaatctcatttctgcttgttaatggtgcccagtagagaacattacccatacctcagtacagggctcaggtagaaacaaggggagagaatggatccagaccaagtgaggctgtgacagttgactactataagggtgcattagtctgttctcacactgctacaagagatacctgaggctgggtaatttataaagaaaaagagatttagtggactgacagtttcacgtggctgggaggcctcacaatcatggtggaaggcaaaggaggagcaaaggcatatcttacatggcagcaggcaagagaacgtgtgtaggggaactg

SEQ ID NO: 70268 - DNA, 1785 bp, Homo sapiens
agcacttggcatgtttttagagagtaatttcaaggtagttattgtaattgttgctaataaacacactacattgggcacaagctggactaggaaagagtgtcataaaaagaaatctgtaacgataagggattgtaaattgctaacgaatatcctaacaaaataaagcttttattaaaattaagaatctctttctcttatgaaagaactgggaaggattattttagctttacttggcataggctcttcatgataagaggagtgtatatatatgaattttgagggcagcatccagagcttggaaaaggtccagagaagagcaaatgcaattatcaataggttagaaaattggccctttaacaaaaggttaaaggagttggatgcatttagcctggagtagaagcaatttaataactgttaaagagctgttattaaggaggacactgaccaatgttctctctccccatcgaggacacaaataaaaggaattgtttaaactggaagagaagagagggatttagattaaatattaggaaacatttcttaggagtgagcatcattaaagaaaaaaatgccataagctataaccagttcctgaggaaggctaaggactctgtgtctcgggatattagtgtagtgggcacaacacaggctttgaactcagacagaactgcttttgaatctcagttcttgcctcggctaacataaataaaaggatcttaaaaattcctccactttgtagattttttggggaatgtggaacatagtatttggacacgcatttaggtgataaaggtgataaataaacattattttcccctttaactactgtactgttgcttgagattttacagtacacaggttaggcaatgtattcttgtcagtactgattatttttctttgttttgcgaggatttggcttttattttttattgaaaaatggatcctagcaatttgtggcggattattattacttggttttacaaagccataactggtgtgtatgcatgtgtttggattcacacttacatcttgaacaaggaaacattagaaaggtatttcaaaatcacagtaaaaaatacatattagaattcacaaaaagaaatcactggtctaaacacggtatgcctgaggcatagcgttaatttcccctgttttgccataattggatctgttacctggtgtactgccatttcatcaactgtttgtgaaaatctctatttagagaaaacccttgtctgtttagctcatccgccaccatcatgactgcctcccatgcatttgtaggttggtctttgaagcatatgttctgaagcggctgattgccttcctcagctgtaacctctgggtcttaattaagggaacattgtatttttctgacctaaatggtattatagcatgtgcagttgttaaactagtggagttttctgtattttcagaggctaataaggaggcagaaactctgaaagttgctctgtcttgattctcacctccatggaagactccaaaactgtgaccttaagctttctccctaagtaggggagtgtgattcttagctcttggggcagggctttagggcactttcagtgagcgcttatagctctttcatgaaaagagcattgacacataccgagtgcctcctgggtggtgggtgcccatctaagtgcttcccatgcattgattcatgccatcttcccgacaacactgtgaatttctaactgtttattattgttcacattttatagataagaaaatggaatcacagcaaatataagcaacatacccagg

SEQ ID NO: 70269 - DNA, 1022 bp, Homo sapiens
gtctcaggtagagtcttatagttcctgattgtaaaggtcaatccaagtttattaaggctactgtacatcccagctttcctgacatagccttgaattgaagggcttttattcttcatcataaaaatgatctcttaatgtgtgccatcttcccttgtaagactatttgatacctttgcaaacaagaaagcctcttgtcaaaatatataatgtgatttttctatttggagggtctcaagaagcataagcagaactgagtgaaatatggagggcctccctttccaccagatgtgtccacacggagtgattgagtggtatgccctgtggcagcaagagtgacaagtcttaggcctacttctgctttcactttttcttttgtctattgcttaaaataactgagctttatattttgttcccctcatcatgtgaaattgcagatgtttactggtttcattctttcttttgatgaactaactccccctctaatggatggtttttgttttcaaaacaaagctgtacatttcagtttgaatagctccctctgatataataaagttgttcttttaacccatgtaatcaagatttcctttcattttaaacttaaaaataatttggaagatgtgagtgataaatttccatgcagctgatttaaatattctggttcattttcattcatgtatctctactcccatgggagaaatgtcaaattagggaaatagcagtgcattcccttcctactttcaaaaaacatgcaggatttaagagccaagaccgaaagtattttgtcttagcttttagcttagaaactgctagttgcctacccaatatccattctccatttactcctagaaacctgatgtttttccagttggcaatgtgcccagatacacactcttatttcctagcttcccatgggtggtcaatgagattaggtagaagtccttgggtgtgctttcgggaaggctatgtgaagcaggctgactcagttgagagggaaatctttttggcccttcccttcttcctcc

SEQ ID NO: 70270 - DNA, 2803 bp, Homo sapiens
tctcctttgttgaggacaccgcagcaccatagaagtagccaatcttttaaactctcttttgctttaccaataaaaagacaaacaaaaacaaagcttacttttttttgtttttttttttgagacggagtctcattctgtcaccaggctggagtgcagtggcgcaatcttggctcactgcaacctctgcctcctgggttcaagcgattctcctgcctcagccccccgagtagctggggctacaggcacctgccaccatgaccagctaatttttgtatttttaatagaagatgaggtttcaccacgttggccaggatggtcttgatctcttgacctcttgatccgcctaccttggcctcccaaaatgctgggattgcaggcgtgagccactgctcccagcccaatctgaacattttaacaagcttcctatttaaaggaatggggtttcataagcaaataactaatatatgatgaactccccaattagatatgtcttttagacacagtctcagaatataaattcccagaatttcatacacatttctaaccttcattttttaaattcataattgaaaacaccatcagccaactctcagatcaattgattttccatctgtgatccttgcttcttatcattttgactaattaatacttccattacttccacttttccatgcagttcttggccagtgggcagggcagcaccaccatgcaggggtttgaaatatttgttcaataactgatgtgcaaaagtctgggttatagaaaggttgaaaacgtctctactaagattatactacagtgccctctagcctatatagcagggagaaaaatgtttccccttcctgctgttcatttctagtggcacattacagtatttgttatataaagggtatgaacctgctattaaataccatacttcctaaaaggcagacataaagttgctttcttatagcacacataaaattactctcttaaacagtcagtgccttcttgctgaagaaatacccagtatcctaaagtgtcaacaggtgcagaaacactgcactgctgtgtctagggactttctgttgaaaacctttgcttggctgagtaaaagtagagaagagtttaacttccatctctcttcctcatcctccatcagaaggcagcagtccataaaccctattcttaagtgtggcaagtgcagatgcctttggtgatatctaattatccttgatctctaaatctttattgtctattgttaatattctttcccttcatatcattttgggaaagaacaatatctatagatttaagcccttctgtgtctatgttgttttacattcaacaaatagactttaaagagaaaatgtagtgtttcctaaaatctttctttgattacttgatatctgtggttttctttcctacctccccttcaaacagaagccttgaaatactaaaaacttaacctcaagaatttcattaggcaaagctcacaatattttttttggagatattctttaaaaaataatttatctttcttcaaaatcttcaaattgtaaaagtaggtgaggagtaggacataatttattctactgtgttggttaataaccttgaaagtttacttaaaaggcagtctctttcctgattatacaaaacatttaatgggaggaaaaaagcgctcttgaagtattgccatacacagacttttaaacttacaaaaaaaaaaaaaatactgcagcacgtttacactctgccataaagtactataatgaataattaaaacaactagaattgtcaaaataaataactatggattgcggtgtagtgctctaaatttttttaatgcttttttgcatgttgatttacatagcatagtaataagtcaaggatttcccagtcattaaagtgaattaacaagaaagtattttaatgggtagttttgtcttatttcagaatttgactagttatttaattctatacccttctcttgcatttactctaaaaaaaactgtgtttgtataaataatgtatttaaaaataaacaaatcagaactccatggtctgaaaaacagaatttagcaactaatttgtcacgtatatgtgaagctttccctagtacctcacttccaagcattgaagaaatgaacatttcacgcagaacatgtatctttactgttcaataattcaaaagcgctaacaacaatatgcatttaagggtctttatatttcattcgaaatacaagctcttaaaacaacaacatcagtatttctgtgtctatatccaaatatattaaatgatgtctaagtgaattttcccagaagattgtcactatttcccatattaagtcattggtatgaaaaattccagttcactttcatctctccctgtatctcttttgcaatattccgaagtggcctacttggtaacctcaactttgagctgatgaatgaaactggcagttttcacgagttgtcttctagtcctggagcaaaggactgagtataggaggaagactgctgaatgacatctgggagactgctcagctgatctgagatttgaagctggtggtgttcacatacttctgcaccatcccagaatctttgcctgaaaccatccctcaggccagctatttcttggaggtctatgactaatgtcacattgtaaaggaacaaaagtttttaatccatgttggtgatatgattggcattctcatttaacctcataatatattaatatgatcaaattttgctaaatatgtgaatgtaaatccaaaacagtgaattgttgagagtgggaaagaagtctggggaggtgggagag

SEQ ID NO: 70271 - DNA, 1612 bp, Homo sapiens
gaagggcaatccaacactgttcttgtcactttgcatgtcttcttcttaggttggcatgaccctttctccttgttccagccaccctcccctcaaataattcagaaaaatgaatggaacttgttgttgtgcaattgatgtaggaatctctttctgttttacttttctacctgttttctcccctttctttgttgttatttgaagtttctcatcatatttccaacctcatgtagtctttcttcacactacccccttctatcgtcatctcattggtacagcatttgaaattactggaatatgacaagtgctgctgtccccatgtctttggaatgctgaccccccacttcctggaacactcttgctcctccttttacctgacactaacccctggtcaccacacagatctcaacttgcctctgcttcctcctgggaacctttcctggccctttagctaaggtgagattcatttgctgaatgtaacccagtccttcttatctcttccttgttatgcttaatgtacctgttgtggcttgtttaatattcataaaatacatatgagcagaggccatttatgtcttgttcaatgctatatttccaatgcctaatgttctattactataagtaatgttgagttgaacagatgagatagaagtactaaattggcaaaatcttactttattttccccgacccagttcaaatgtcatctttctttaaagttctcctccccactagcaaaaatgtacttctctcatagaacttacacattccatcatgattgtttaaaagtcaactaacaaaaaatgacaaggttttgaaagacaagaaaagactgaggaactgtcccagaatggaggcgattaaagagacatgatgacaaagtgcaatgtgggatcctggagtgaatcctggaacagaaggaccatagtagaaaaactggtgagacaaagtttgtagtttagttaatagtattgtaccaaggtcaattccttagttgtggtcattggtatgaaggttatgtgagatattgacattaaggcaagctgggggaaaggtctatgggaaccttttctacaattttcaatttttttctcaaggtttaaaattactttaaaataaaaagttaaaaagaaaagccaactaggagctttctatagacaaagtatatcttaagaatgtagatttctagcccctgatggtgtccagtctagtaggtgcccaataaacaccaaagtaatttacccttgcttgctcccattttggttatttgcagtctgttttgtgccttcccgttctggtcttacctagcaacagcttggctcctttagggatgacctagtcccagagtgcatatgcttgagaggccagtatcctgcctttctgtggcaatgatgctgtactacatacatcctatgtattggtaacttgctttcatcagtactgagagtaataaggaagatatataaaataataagagaaagtgggaaatctgggctcttttctaccttattttatttttttttgagacagggtctcacttggttgcccaggctgagttcggtggtgcactcacaactcttcagcttcgacttcctgggctcaggtgattctcccacc

SEQ ID NO: 70272 - DNA, 1256 bp, Homo sapiens
agaaatactcctatgttttataaaattaagtatgccaacattttggaatattatttaaactgatcattttttaaaagttgtaatcattacaaagtaaaactaaaatgtaatgaaacatagatgctggctatgaaatccagagatgtaggtaatattattttattttaaaaatgtagattgatgtaattactttttctagagtaagctgaagatgcaggtttattcagcgaaaaccagagatatagttattgtaggcaacatatctcagatgctggtgccaggaattgatggcagctggttgcacactgtgttcactccagtgttgctcagtgcattgaactaagtattgttaataagggatgacacattgaacatgccaacaaagtaacatcagtaaaatatttcaatatacttgtatgtttttggacaccctctatattttcattaattttgcatgataagaaaggaagaaaaatgagccctaatgatctgtggttatattttattatatccaatttcatctacatactattttcttgattctaggagagcaccaggaactgctcttacaattatcccaaataaagctctcacatagtaggagtcatttcttcaaaccttctctctcccaaaatatactccctttttttcttagttacatggagccatgatataataattataaacaaagggtatgcctagagagtagaatgccaggagaagagaatgatgactgaactccaatcttaaaaggcaatcttgtggaaagggttagtggactgactctgtgtatactttgcaataaaactagagccaatgggttgaagccttcagaacatagatttccgcctttaaaaatttttttctaagagttataagtgttaaaagcataatcaaccattttgtagaatttccccccagtggatatatttaagtagagcttcaaagccaatttccagatattaaagcacctgttttatgggatctcaaagctccagtttctcccactgttgtagcacctgataaatcaccatgctctgagttttgcataatttgcttctctacccatctccagggagagccccttgagggtaacaaccatatattacttatttttgtatccccatccattagcacaatgcttggcacgtagtagatgctcaataaatgtttactgaatagatgaaggtatgaacggctgcagttgaaataatggttgaaaaatgttttcttcatgttgtagaacctgtccttca

SEQ ID NO: 70273 - DNA, 1050 bp, Homo sapiens
ttgggaggtccacattgcttgtgagctaattaaaagctttgagaagttttggagtaaagaaatacatggataaagagtattatttgttatggtattttggagtttcaagcacttgtttcaggtactaaagcagatccaaagctgctttttgaggccaatttttgccctagatgctgtggcggccgacttgtttggcaacctcttatccaggtgaagattgtaggcagtttttcagcttctataatggagtgttaattttgcacattcatgtttggtatttgaagttctttcaggcatgaacacgtggtacctgcattatgggttttttcattagagtttaaacttgaggtaacttccatctatatcctgtaacagccacacctgagtagagaaagaaaataatagtcatgccttttctattaatttaggttccgctcataaattaatgatcatggttcatgagagagagatattccttgacttcttcgattgtagcccccacaaaaataccctcactagatgacattaatgttattttcttaaattttattgaagatatatgtaatacataacattgttaggattattttttcagtcttctattgcatatttttgttgaagacatattactaaatgtgccttatttaaattccccttattaatactccttgataaagtctgtttgaaatatagtaataaaatatttgtttttcccttaaaaagtattttatcctatcagatatgaatcaaatataattgaatattttttcatgttttttctttttgcctaggctgccaggaagatcaaagtcacatttaatacacatcaaacatcatagtaatatctatacattttttttagaaaacaggcttctgtatttcttcaattcctttggtacttaaattttgtagtgaaagtgaaatacttaatatttaaagtctgtgtccagaaaattaatcttgaaaccatttgaatggatacattttttcatagatataacattatatgtgtgttagatttcacactggccttcagagcttcctaatcca

SEQ ID NO: 70274 - DNA, 1091 bp, Homo sapiens
gcatcccagccccttagggcttggctttcctgctgtactccagcctcagggagttgatgtacagatacctccgtgttatttgcaggggccccaacctaaaatagcatgtgggactttttgtccactaattttgaactttttttaaaaacatacttgccattttcctttttattaggctttctgatacaatcattttatatttagggtagaggtgggcatacttaggacccataggctccacaatatgcaccattctgtgtgtgcccacacatgcgtgcatgcacatgcccagagtgccactagcccacctgcccttgcccccaacaaaagcatgcttcagcccttctcaaggaccagccaggtgccttctggcatgatgagtttctcacagagacctcctgtgagaagaatattctgaatgcacttcctctccctttgcttccaattttggctgagtgttaataggtgctcagcaacctgaagggagaactatattttcttcctcgtctcatccccaatgtctaactcagtgtctggctgtcactcattatatttgtttaggcagcagcaggaagtaatcctgaaagcaattctgaaaagtcaggcttgaggcctcacaagttcattgcccagcatacaagacataggccccaccctgtttaatatctttcttctcaacagatagcctcacatgcaaaagctacacagttaggagatctgtgccaaatctggaatttgcagtggctgatgacagacagcagtgtcgattccgtcactctgcttgattcccacccacgtctgatgcctgctgagaacacactctgtgtgattccaccctgtttccgtctcactcgcctttgtcaccatacactcttcttttctaaagctagctggctctttgtctagacagctccctccctcatctccagatggctttgtctgggaagcctacagtcttttccactaccaccccaagatgcagaggcaattaaatcaggctaactctcatggtgttactccagttaataggcatttaccaaacagtttggcattttctagaaagaaaatgacaacattttcctcacttagtc

SEQ ID NO: 70275 - DNA, 1291 bp, Homo sapiens
aaatgagtgagtgggtgcagtcagtgatgtcaggccacctgtgggtgccccatccctactatgctgagttcaaaagcaggagcctgcagtactaggagaaatccatgcatggggcccagaaatgggaaggtggattcacctgggaaatattttaatagaagtaaagaacaaggccaagaaattgctcaagagtctggctaggaggtagcccagatacctttcaatgatccagataaggcttttgttcttgtgtactgatcttatgtattgacatgtcaggagccaggagcagtccctttcctgtgtattttgtgtggaatcttgcctggggctttaggcagttgacacatgttgggtttatggaaaatagttttctttgctattttgtgtctgccaggacaacatattaggtcggaggctatcatagcattttctttgctgttgtaaacagttctctgagctgaagggcttctgaagtcatctattatgtccatctaggtgagaagtgctgtctcatgactggtaacaatggttcacgtatcacctgcctctaatggtaacatcaggacctctcatttcccagtagtgactttaatttcctgtcaccatttcctagacggttatgttcagaggctgggttgtgccatggcacatgaaagagaatgacaggatgcatcctcatttcatgttacaatttgccagaagatcattagagaagtccgtttatgccttactgcagatgaacggatcacatgattgcattcccattatttggcactgggattgaggtattagggaggtggagagtattacactcaaaataagtacaagtcttagtagggcagcagtggtcctcatggacactggtaagccgagtagagattcccccaagatgataaagttttaaggaaagccttttgggctatgggcctgatttatgtctgagttacataactttctttcctagacacataaaaatattaagagtaatcagtgacctggtggggaagaggttattcttcatcagacatcaaaaggtccccttagttcttgggttccttctataacttccttgatggtccttttccctccagtcactggacagtgcttactactccttgagcttttgggacatgaatgtgacatgtgtcttgtcatcgtatctctcacaacatccagctgcttgaaggagatagaaggcatgtgtgtggatataatcaggtggttgttttttaatcaggttgatggcaaggaccaggggtgactgcaaaggagtgattataccagtggg

SEQ ID NO: 70276 - DNA, 1344 bp, Homo sapiens
ctgggttcttactctgtactgactcaaaagtacaagtgggtttgaggatttggtggaggcggctgtggcagcctttatctgatgatttctactttattttttctgagatcttctgcttagatttgagtgggggtagataaaggggttaaaagtttgtgaagagttgagaagaactcttgttgagtaggagggtgaggtgatggtggaaagtgaatgggttgttgagcattcccaaggaatcagttgatgctctggactatgacttagtgagatatctaactgccaaataatgtgcagtatggcaagacaagttttttgtctgtttttgagacagggtctcactctgttgcccagatggagtgcagtggtacgatctcagctcactgcagcctcgactttcccagttcaagtgatcctcccgctttggcttcctcaaatgctgggattacaggaatgtgccactgtgtcagcctaagacaagttttttaaaaaggaagtcatacaacctgataactgtttatatcaattgcaattaggttcagctgcttgtaaacccaagctactagtcatttaagatagaggtgcatctttctctcgtagaaaataaatgttgaggtaggtagcgaagggcttgtatgatattcatacagtcatcagtggctcagctttacctgcagcatgggctcaatcatatatatcaatatttttttctagggattttgctagatcttaaatggaatttgtttaatgtatagtgcattcagcacatatttattatatgcccactgtgtgccaggctcagagggagatcctgtctttttgatctacttttcttaggccaggctttctatcctcaagaccacctcatattcacaagataattgctggagttctggccatcatgcccacattccagatagccagagggagaaaagggggaagggtaaaagcagtcaactgagtcagttccctttgaagtattttcccagaagcctgtcaatgacttttgctaaaatctgtttggatactcttaagcacaaaggaattcaggaattatgggtttggtttttattttcttaactcaagcacattgctgcctgtaactgtataaggacctgctttttaagaaaaagactggatatttcataaatacttgcagtctgcaacactttcctactcagaaatctgttgtacatccaacatttggaaaccttagtttaaaatttgacaatgtatgggtacattgtgaaactttcttacaagctaagaatgtaaatagctgccactgatttctctttaagatgacagagaacacggagtcctggttttatagaaggtgggtga

SEQ ID NO: 70277 - DNA, 1046 bp, Homo sapiens
attcttatcttgctctcttaattttttttcttttttgagacggagtctcgctctgtcgcccaggctagagtgcagcggcacgatctcggctcactgcaagctccacctcccgggttcacaccattctcctgcctcagcctcccgagtagctgggactacaggcacccgccaccacacccggctaattttttggtatttttttaatagagacggggtttcaccgtgttagccaggatggtctcgatctcctgaccttgtgatccacccgcctcggcctcccaaagtgctgggattacaggcgtgagccaccgtgcctggccgctctattaatttttatctggcttctcttatgagtgaggcatcgtttgttttgtggtacctctcaatgttctctcagttagccagttcagaacaagataactcttaaaatcagctaactagtgcatttccataccaagttttaaggaattatactataatatgttgctatgcccagagaagacaacaggaattcagagaatgtgattgcctctttcagctaatgatgtgactctaaggaagttgcacagacacatctctgtctctctacctgcagcatgggccccaacatatgtatcaatagtttttcctagcgtttcccctagattttaaatgaaatttgtttaatgtatagtgccttcagcaaatagttattatgtgcccactgtgtgccaggctctttgcattgtggtgatattgacagatatgatgatatagacttaaatatagtgtaatatgatgtagacttaaatacagtgtgaactaaaattgtttcagtgctttctgtgttccaggcattgtgttaaaatatgccaaaaaattggctgggcatggtggctcatgcatgtaatcccagcactttgggaggccgaggggggtgaatcacctgctgccaggagtccgagaccagcctggccaacatggcgaaaccccacatctactaaaaatataaaaatcagctgggtgtggtggcacatacatgtaatcccagctactcgggaggctga

SEQ ID NO: 70278 - DNA, 1021 bp, Homo sapiens
tgttaagtctatagaaacaactagagatattttattcatgagtcctaatttgttccttactggctgcacccaagttctatggagtggcaatttccttcccgtggctggaaacagagagggactgaaacttttcacttagaaaatattgacggtgttcctactgtgtttcaaaaactgaaacccatgggctggtcacagaaatgaatgataaggcagggatgatgaagagcatagggacatgtcttattgatcttatttatcttcaatcaatatgtgttctattataagctctagaggagtggggacattttttgctgctttgttggctgtgtatctctaacatctgacacattgcctgacacacactgagcataccacacatacttattgaagtaatatttcttggagccaaaatcattaatgattcttgaaaggacaatgcaataataaagggatgtataacagtagctcacaggcttgaatacttggatggctctctaaggtaagaaatctaaggaggtcagttaattccttctcacctggagggtatagacaagtaataaaggatttttgatgtcagaaaagctgtgaaaccatgatataatgtaacaagttggagtggtgtctatgtcgtagaagccctttcactcactaagaatacttagcgtagcacctaacacatagtgcacatttaataaatcattgatgaatgaatgatgagcattctaattagatttgggagaatattgtgattagattaagtagttcatatcctactgtgcctgcatgcttttatttttttctttgctcttagtggtgtgatttgtgatattattagtgctttgttattttaatagagttatatttctagtggaaaaatgtggcctagtgaaatgtgccttgtctcactattccatgctgaatgagagtcagcttgtgtgtagcacacggcatagactgggcacctcacaaattgccctctttagtgtctgaaggaaaataacttgaaggcctactaacc

SEQ ID NO: 70279 - DNA, 2341 bp, Homo sapiens
gagatcaagaacaacaagaaagtaccattaaaacaaggtgctcttgtgggaatatgaattgtgagagaacatgttttgtacactttaggagaatgagtaatgctgctgtgggaggatagtagagttaggaattaaaaaaagagattctgttagaggtaacaaggtaaaggttatcaaaaaacaacttattctaggaaaaaagggttccctgagtactattatgtaaatctgaatacttagatctggactatagcttaatattatgcagaatagaggctgcttagtgacatgtttagatccctattcaaatatttgcaagtttagaagggaagcaaattccagcttgacatgaataaacattattgtactatatatgtaggtggtttatttatgggtatgaatgtacatttatgtatctattcactaaaatataagctccctgagggcagagatgtggcttttttcatttcatttcattattgtgtccttagagcctagaaaaatgcctggtatatagtagcccctcaattaaatttttttggatgaactaaatatgaataacatgtataccctggttaaactgtataagggaaaaagcttaataatagatattctgcatttagtatagtaaatacatttcaaaatctacaaaatgttaagctaatattacccaaagactagagttatgttttagaaaaatctcagcagtggtttccatataagacaatttatttttagcttaattgtgcagaagtgatctcatcttttattgtggatttctctggagaattaatgtgttgatgatcctgaacctctatgcagctcctctgggaagaggtacatacttagtcatgcctttatattgggataaaacttggaaaagtggtgccagcctcagtttgtgttgactgtattcaagaaagaagttacattacatcagcaagagttagtttgctttggaaatttatgctcagccagtaagtccagtatccagaagaaaaattaggctaaaggctgaaagatattacacatatgaaagattgttaataaaatggaactcgttacctataggaacaatatcattccttgctagtttcattgccattaaaatacactgatattgggctgggcacggtggctcacacctgtaatcccagcactttgggaggtccaggcaggtggatcacgaggtcaggggttcaagactagcctggccaagatggtgaaaccctgtctctagtaaaaacacaaaaattagctgggcgcggtggcaggcgcctgcagtcctagttacttgggaggctgaggcaggagaatcgcttgaacccagatggcagagattgcaatgagccgagatcatgccactgcactccagcctgggcaacagagtgacactccatctaaaaaaacaaaaaacaaaaacaaaaaacattgataatctatagtctttccctctgattttagctcctcggaatttttttttttttttaaataatcctatccttctgctcacttgactaagagactcaattcagggttgatgtccaattaagtgacctattcgcttaagtctcagagcctggcacagaggagccctcaacaaatacttctttcagtgaatcccttgtgtaatgttaaaatattgaagcagctggtgtatgatcatgatgatttctttgcaggttaggaattagttcatagagtgatagggtttctagtttattaactttctcaaatgactaatggagtaaaatcagttaggtattaataaacagttcgactaatgggatgaatgtctgtggttgcaacttttgttgctcctggatggaagaacatcatgaggctttctttggggttgtagctcataactgagatacatgatacacttaattcttgggtcctaccacctttttcaaatttgtggccaggagcctttatattggtggccaggagcctttatatttatttaatattgctgggttgtagttaataagaatagatctttgatggagatatgaaaggaaatatttaatggcttattacttgtaaaaatacatatatttttacgactattcaaaagaattttacttttattctaccataatcttaattttcaatgtctgtgataatgcttagccacaaaccatacaaatgtttgtttggttgtaagaagccttcaaaaattggcacataacccatagccaatattggggccatataaaaatttaacaaaatattaaaaagagaggtcctgaaatttcacagtgattcagcagagttaagaaagacatttttggatagtgttaaaaaaatcacggaatcttgagtcataatgtttctt

SEQ ID NO: 70280 - DNA, 1145 bp, Homo sapiens
aaacataaaaataaacagtgaaattaattttaattatgtgttttatttagcctaacacatcaaaaattattattatcattattattattattgaaacggagtctcgttctgtcaccaggctggaatgccgtggcatgatctcgtctcactgtgacctcacctcccgggttcaagcaattttcctgcctcagcctcccaagtagctgggactacaggcgtgtgccaccatgcccagctaatttttgtatttttagtagagacagtgcttcaccatgttggccaggatggtcttgatctcttgaccttgcaatccgcctgccttggcctcccaaagtgctgggattacaggtatgagccactgtgcctggccaaaaattattttaacatgaaacgaatataaaaattaacaggttgtgttttattcttttatttatactaaatctttgaaatctggtatttattttatacttcaataatatgtttcaattcagactagctatagttcaagtgctcaattgtcccttatgtctaattgttactatattggacacctggtttaaatcatgtttcctctgcaatttctcaatatttcagagcctttcccttataccacctgtttgttgtaatctttactatgaccaataagataatttttcacttttgtcaattattgtagcatcaactgcccctttctctgctatcatctttggaaactctaatatctattgagagattgtgatctctcaatgtcttatcacatctccactttacctatcaccataatatcatctccactctaaaatctcttaagccccataattctttcctctgactgtgatgaatagcattctgttatcatctattctcacaccctttctccaattttttttgaatttggggggaatcatttttacagttattttaggtatgagcttgtgtattacttaattaaattgttgtgcctaccagatctcagaaaaactaccattgatccatatgtcaaatatttattaaacatcagctatttatttgttatgcacttttctaggtgctgaggataaagcagtggacacacaacacagacccttgctctcatggagcttacgttctactggcggagcagatgagaaaagccattgtcacat

SEQ ID NO: 70281 - DNA, 1058 bp, Homo sapiens
ggaagaagaacagaagtagcaatgttatgcttggcagtcatctacacacaaatgtagttttgtgaatgaagaaaacctcacattacttagcataagtgaagacactgggcagccaggaaaaaaaaaataagaacagaaaaattgaaaagggatgggaaaagaaagaaaaaccacttaatttggaattcatccctgatccgctagtggcagccacaactagcttggagaccttgcataaattcctcaaccttgatggaatgcatttatcttatcagaaaataatgaacacaacaatacctatctatagtcattgtcaggattaaatgaattagtacatgcaaagcacctagaactgtgcctgtaagtgttctatgaaagctagcagatataataacattccctggtttcagagtagaaattctgttttattgattcctctatgggtagtgcctgcaacagggcctaggttaagatgtgacatgtagttagttttcaataaatgtttgctgtgcgattggatgaatgtcaaagctgaagagatctgataaatttacagatatggattgtaaacaatcctccactgaatagtgctagatatgtcagaacaatgaataattcaggaggatcatgattacgttactggctgccatttaattgtacatccttttaattatcagtatatttatgatcctgttttggatatctcaggggtggtatgaaatgaaaatgaaaaggtgggaagatgtaatgggaaggaagaaatgagcaagggttttcaggcatcaaatgacacctgtagcagctcctcacggtaaagccacatgagttgaaggaatgtgtagctttgaagtagaaaaagctttaggggaccagctcttttgtggattagatttatgctatgtagctcaggaccaaagcacaacattaactggagacaagatttagattcatcgtaaagaagacatttcagaaatggcaacagtgaccttataaaaggggtgagtcattggaactgttaaacagagactaaataaccacatgtcattcatgctattgat

SEQ ID NO: 70282 - DNA, 1106 bp, Homo sapiens
gcactttgggaggccaaggtgggtgggtcacgtgaggccaggagttctagaccaccctggccaacaagacaaaaccctgtctctactaaaaatacaaaaattagctgggcgtggtggcacatgcctgtaatcccagtttctcgggaggctgaggcacgagaattgcctgaacctgggtggcagaggttgcagtgagccaagagcgtgccactgtactctagcctgggcaacaaagtgagactctgtctcaaaaaacaaaacaaaacaaacaacaaaacacctgcgtaatttgccttttaaacttttggtgaggaaagggtgtgaaatggcccagtagcagtcctctgagtgacttcctgggctctgcattacatcaggctgttccctttccctttcggaccttatgtgttaccttcctgttttcacccctaccctctttccatcagctcctcaggctgcaggactttctcacacatctcagagttccttaagtgccttctttccctcagaatggcacccccacccctccacccccacgttttcttcactgctgcagtgaatatactgacattctgttcagcaaagtgccctgtcaaaaatgtaaaatgctctaactaaggtggatcagtatcctatcaacttgaatttcaagccatatgtcacatttacttaaaaggacatatagccttttacactgaaaagatagactttttgtagcagcctcaggatcaggctatcagtcacgctctaactctgtaaagggggaaaccaagtcatgcacaagtcacagaatcatagtgtatgagagctgggaggacctttgagattatcgagtccctttattagcagatcaaaagcctgaagggtaaatgagatgccccagctaaaatgagtactgtttcacaacacagcaacctctgaaagtcctttctgtcaacaacattagagaaaggcatcagttcctgtacccactgaagttttatttggaaaaattcatgctaatgtaagtcattatagcaacctttgcaaaccctggcagttacaattattgattatttcaggacatcggtgaaagattagagatgatagatttaaagaatattatt

SEQ ID NO: 70283 - DNA, 1026 bp, Homo sapiens
caataataatgccaacctctgatggtttatgtataatgtgtgtaatgcaaaccaatttagcaatttacatgacacattgtaagttgttcatgaaaagatatcaattaagactagatatcaccacccccttaaatgtcttcatggctaactccttcatctcctttggggctttgctcaagtggcactttatcaatgaggccttctgcggccaccctctttgcaaatgcaacttgcctttcttcctttagtccttcttcctggaacttgcaatcttcttttctcctcccctccttgcacccccactgcctcccccatagcacgtatctccttctaataaattatatattttatatattcattatgtgctttttaaatgtctgtgtccctctgccagattgtaacttatcaagggaagggaatctctgcattcactgatgcaactcaagtgctaaaatcagtgcctggcacatagtaggcacttaacaaatgtttgttccacatcgaatggttgatattactgtccgatgaaagtggattacaaattattctttaggcacttttggggttctgcatatttaatttgacttaggacaagtttctttaattaggctttgtttttggtactgactgatggtctccccaccccagaaccaccagcttactggtgtggttgagacagggatggggttccaggacacttggccacaaccagacattcatctttctcctagggatctagtcctaagtggctggattctaggagaaattgcacacacaaaaggactgtgtagctaaaagagtttgatactcatttttctataccatttagtacaaatgaatttgttttcccaaatattgctgaactctgcagcaattttttattggtgagagcagcagttaagatttacaaagttgttcttagaagatggaacctaatagcgatgtcatgaggaaaagaattagcagaagggaagagatgagacagaagggatttagatggaccaggcagatccactgatagtggaa

SEQ ID NO: 70284 - DNA, 1011 bp, Homo sapiens
atttgttgtttaatcaggatcttactcttttcttttttgttttgagacggatctttatttaggacctcgaatatttaaaagtcctggacccctgcacatttactggctcattaaagtgtatgtttgcagttttttatctgtcgtcttctttaattgacgccttaatgccgtggcttcatagggggtgcccagttcttactgcttcctgcctgtttttgttgcagagaggccactttcgctttttagtattatttagtctaagtcgcactgtttagcaataagacaggcacgttgcaaaggcctcatgcttcagtcagggcctgtaaaagactccccacttactatcttctaatcagaaaaggcctctccacttgacccatttttcctgtctcgattcctttcccctttgaagttcaatgtggaagtttctttgcataaaattgtttacgataatatattaatcctgttagtaggtttccatccatttcaaaaacttccgtctcctgaagatttcctcttattattaaaggaaataggctggtttctttctaaactttaaaactgttagcttgggctatgcttgcatcaccactaccacagccatggtaaaaatagaaagattttaatatcccaaagagaggaagaaatatagaactataaatatatatatgctatttgagtaaggctgaattcaagggtaggctctcaggcaaaactggcctatttatggatcacctttctgattcaaaacatcgttctctacactactaggctactttttaaaaagtttttatggcaactctgcatagaaatccacccttttgaaatacattagagtaagcaaacaacgttttttagcaatatatttgttcgtttgatcaatattcagctgttaatcaatgattattttctggctgccaggcactaatggcggtagtggtagcattcagaaatgcacagagtaaacctgcacttgccctcatggagcttagaatttagtggggacacaga

SEQ ID NO: 70285 - DNA, 1149 bp, Homo sapiens
taactggtatatttctggctacttagaatagtacctggcacacagaaggtattcaacaaaaaaattgctgaataaataaatgagtaaactgcatgatttattctttagaaaaatcactttggcagcactgcgggaaacatttggaatgtggcctcaagcaggactgttaggagattgttgcaatagtcccgctgaagttgacggtggaggtgtagatgagaagactcagctaacgggtgagttactcaggaggtagaactaagagaacttgtaatgtgattgtctatagggcttaaaggagaatggtcactcccaggttcctggtgtaggcactgacagaaagatagggttattttctgaggtaagaaacatacaaagaaaagtagactttgggtctgggttggaggtactgagttcagtgttggtcatgtttagcttcaggtagcagaatgacatccaaatcaagatgtctacttggtggtgactgagagggggctgtctaggctggatcttcaacttagacgtgaacctaaagctgtagaaatggatggtgttgttcaagtagaaggtgtagacgcagaagatgagaacaaggagtattgagagaagaaaatagaaacaggaaatcaaaataagcagtgaaaagtttactgcacttccaaaaaactcttgaattccttattgttatgtttgtcattacattacagaactttaaaacaaatatgtagttcagattctagctctgaagctgtagtcttggtaacttaacctccttattccttctttttcttcatctctaagatgggtccaattataatccctacctttattatagatatgttgtgagggctagatgaaatacatgtaaagcctttagtattagaatgtgcattcaataattgttcactcatttttaattattaagtttaaactttcattatttttatttatttatttttttgagacagcgtctcactcttgctcaggctggagtacagtggtgcaatcatggctcactgcagccttgacttgctgggctcaggtgatcctcccatctcagcctcccaagtagctgggactacaggtgcatgccaccacacctggctaatgtttttttttgtttgtttgtggaggtggggtcccaccatg

SEQ ID NO: 70286 - DNA, 1052 bp, Homo sapiens
tcagtttatttctggaatacagcaattctttgatttctccttataaatatatgcaagaacaacagtgtcctttagttgttagaatcttatatagtccatatattcttcagcacccatgttattcattgtctttttacaacctgctatttaaggacaaaatacatagagtcacaaatggaaagtaaagaagaaccatctctttcatctcctcctcattttgtcatcacagtgtgaagtgtcagtatggagaaggcattactttgaaagcagactgtctggcagaaactgcaaaactgcattttgcaatagtgtcatccaaactctggggaattctgttattcagaagcctctgtggttcattcatgcattaagaggatgagtcttgctgctttctcatctgacagaggagaatgttgccatgacagctgttaggaggtgaggagatgtgtaaagggcatccataatgaaaagagaaaatagcctggcttcttaggtctcactgatgatgcatggagtggcttgtgtggattctcaaaatgaaccttgaaaatccgttagtcccattttagtaataatatctcacacacacacacacacacacacacacacacacacacacacacacacaatgtttcttttccagtagcctaagaagcatgtagaaaaattaaacctcaactaaaaccccctcatagatacctccttttccatctttggagtgtagactgaagatctaccatattgaaggtttaaaacatttgttttgttagtgattattatgagggaaaatattttccaaaaaggcagaatctttttagaaaatgtcctaaaaccagaaaaggtgttagagagtaatcagagagcttaagtagatttcatctctttagtcccagagagtaaaatatattttctttatctaaagatgttgaaggagtatttactgattgaaggatatggtatcttgcattttcttcaaaataatatgggaatggggagttttttagggccacaggcaaaaaaaagattggtaatgaatcgattatagaatatta

SEQ ID NO: 70287 - DNA, 2756 bp, Homo sapiens
gaagaaaaatacttaaagagttgaaagaaaaataaaccctcatcaactttgaattctaaatccataaaaattatccttcacatgtgaaggagaaataaagactttctcacataagcaaaaccgaggggatttattattagcacagcatacctattctttataaaatgttaaaagaagttcttcagagaaaagaataatgatagttcagcaacttagatcaacattaaggaaagaacatcagagaaggaataaatttaaggtaaagtaaaatcttttgcttttctcattaattgagctaaaagaaaactttgtttaaactaataattgtaacggtgtattagataattatagcatatggttaagtgaaatgaatgacaacaatgtcataagagattggagggaggaattggaaatactttaagttatctgaactacacatgaaatggcatagtattagttgaaactgaacttagattagtttaaaatgcatattgcaaactctagaaccaccactaaaaaagttaaaagaaatataattgagatgctcagagagtagataacatgttatataaaacgctcaattaaaacgggagaaagaagaacaagaggggagaattaaagcaagagaaggcaaaataagaaaaaaatatataaaacataggaaacctagagtcgtaggcaaatccttattgtctacaagaagcccactttaaatataaagcatcaagttaagagtaaagggatggagaattatacagtatgttaacaccaatcaaaagaaagctggagtcactatcttaattttagacaaagcagacttcagtacaagggaaattatcagggataaatagggacattaagactgataaaagtatcagttctccaggaagacataatcataaaaacatatgcaccaaacaacagagaatcagaatacatgaggcaaaaactgatgaacttgcaaagaggcacaatttcaaaataacaaattgactattgtagctgtggacttcaacacccctctttcactagttgatagatcaagccagcagaaaatcagtaaggacgtagttgacttgaatagcattatcagtcagcttgatctaattgacatgtataaaacactccatccaacaatagcagaatccacattttcaagcttgcatggaaattcaccaagatagatcacatcctgggccataaaacataccttaacaaattttaaagaatagaaattatacaaagtatgtactcagactgcagtgaaattaaactataagtcaataacagaaagatatttggaaaatgccaaaatatttacagattaaacagcacccttcacaataacacatgactgaagaggtcacaagataaatttaagagtattttgaatagcctgtagtctcagctacttgggaggctgaggcaggaggatttcttgagcccaggagtttgagtctagcctgaacaacatagtgagacccaggcacttgaaaaattttttgaataaaataaaatttaaaatataacttataaaaaattgtgagtttaactcctgtcttgccatatactagcagtagcagtacaactgtgaataacatacttaaatggctgtgcttattttcgtaaaataattttagtatttaaaacttcacctaaaataagttctaatgttctattgcatagtatggtgactagagttaacaataacatgttgcatatattttgaagtagctagaaagaaatgacacatatttgaggtgatagatatgctaattaccctggttttattgttacacaatgtatacatgtatcaaaacatcacactgtaccacataaatgtgtacagttattatttgtcaattaaaagcaaaataaaacaaaaacaaacacaaaaaattgtgggatgcaaggaaagcaatgcttagagaacaactgataccactaaatgcttacattagaaaagaagaaacaatgaaacaacaaaaatatctttcaataggtaaatgaataaacaaattgtggtgtatctatacaaaaaataaataaatggaggagaagaagcagtatctcctacagaattccaaacaattgatgcagatacttcactctcaagaaagtggtaattttccactccttaaagtgtaggttatgcatagtgactttgtttcagagtatagtgtggaaagggcaaggaagcgactttatggtagttactcacagccagatgatcaagacatcagcagtgataagcactattgctattatgtatgatgtgataaagataacacttcacctctgtggtcttccttcccaaaatacataactccagtctcataatgagaaaaacgtcagacaaattttaattgatggcattttacaaagataaatactcctcaaatctgttaaggtcattaaaaccaacggaaatctcagaaattgttagagccaagaggaccgtaaggaaacatgacagctaatgaaatatgttttcttggatggggtcctagaacagaaaataatattaggtaaaatgaagacaattgaataaagtatggactttagttaataatgatgtatcaatattggtcctttagttgtagcaaatgtgcacttagaacgtgtagtaataggggaaactctctgggttgatataagtggagcgatgaaacaaataggtgaaactgtaatatttgtaatttttgcaatttttgtaatttttctataaatctaaaactgctgaaatacattttatt

SEQ ID NO: 70288 - DNA, 3117 bp, Homo sapiens
aaaaacctaccccaaacccctgaataacctacataatgtgggttttttttgtttgtattaaggagtgtttttaatatttaaaaaatacttttcaacaatggttctactgaaaaaataacagttttacatgacatatagatttataaaaattacatgttactgtgtttatagaaaaaaatggtggctgtgttttaaaaagacattgaagcaactcttgtgtgaaaatacacaggtggtgttgaaatagaaacaagcctaggcactagggttcctaaggtctgctttcatctcagcctctcatttgttatgttacatttcagggctatcattaatactgccattgtatcccatttttctttcatcttctcttttcaccccggaccctgtttgggggccaggagttcctttgagaatgtgaaggcggccctaaaagctctcctctaaataatgtgcaaatacacaacagatttgcatgtaagtttaggggtttcatggtttctggaaagcatctttggaccttagctgagtgtgcatgaattagaatgcattagtaagaacatggggctgcaaaatataccatatgaacaatagttagagcatttcactgtgatgagctagaaaaagaaaagcttgaggacaggtcgttaatgaactgtcacacatatctgaagagctgttatgtggaaggaagaagtttatttggggttgttttagagctaggtggtccaccactgtagccactggtcacatgtgactatttaaatgaaaattaaataaaataaaaaattcagctttccactcatagtaggcacatttcaagtgctcagtggtcacatggctgctgaattggactgttatatctttgtaagaagttctgttgggcagagctgctctgaagttttgaactttcaacagagtgaattatggcaaggcagatttcagctcatttctaacaaaactgttctattaattttaactgttcagtgccagagctgttgaactggctgcctcaaagaatagtaagctttctgtcatttgaagtactcagacagagactagattcctactttttggagtgatgtagaagagtttcctacccagaaccttagggtgtttaagtgggaagaagactcagcaattcaatgtttcttttactgcagatgaagacacagactcagagtcagacagttttgcccaaagacccacaactggttaatggcaaatgctagctgtcctcatgaatcctagcttagtacttttcccattccacccattggctaatgttttaacaacaaggtcctcgcggttcttgttgagcaacacatttccgcttctggcattcaccagcttttccacttattctctcccactcttctgcagtgaaaactacactgcagccaagctgaactggctatattgaaatacgttattctgattcctgcctctgcgtctttgctattgctttgccctttatcaaagtgacatttcttcacaaacttaattctacttattttctaacttctcctcaggtctcagaatattcaaacccataccatctcttctctttgctaaactaccttgttacaatgcactcagacatttatactctctgtgatgattatattttgtcttatccctttgatgagcttcttaaagactgtgattactattttcatgcatatatcctttttctgtctccctcactagaatataagttcctcaagggcagggactatagctgtctttttcaccataccttactatccagttgctatccagcaagtgtcttagcaccataataggtgctcaacaaatatttattgaatgagtgaatcaatttttctcttcccaagcatgctattattctccttaagtttgccatgaattctcaataaatacttttctaagcaaacatttctgtttctataaagtaagtattgaaaataggaatatgaaaaaaacaaagtaaggcactccagcatgtaaagtgcttgggagtcctcactcccttccaaacctgagcaagtaaaacttggtaagttttcctggaactgtcagcaatctcagggcaaatcacttgccaccccaaaatctgaagaaataggtacattcagacagtcacagctaagatttgcttacctacagcagaagcaactggaaccatagactagaagggccatttaaatagtaattttgatgaattgctggaggctaagtgttgactagcttgagagtggaactcctaggcgcaggagtctgagaaagggtctcacacgtacatggattttacctcccggaaacccgtcaggttttcacagcaaagagccaagatagaccctgtcctggctctggcaaagggaaggggaaagtaatgactttgaagtgcgctcagaatgttctctatgataaagacttactctccaaggaaaagggctttaccagagtcttatcccatctggggagaagatagttctctgactcgaggcacctctagattcctgtgtcaactaaggaaggaggaaaaaggttaagaaacatttgtaaaggtcacagtacagcaacataggcccaccaaaagattgagatgtaatcctaagaaaatggaatgtttcccttccccactccttaccaccacagcaacagggctccttataataacagtggattacagctgaaagagctgcaagatgcagacagacactggctggccaaggagagggggtctcaggaaagtccaaagacaacaggagagatgaaaaaaaaaaaaaaaaaagacactagaggactttgaaacctctgacaaccacatttatagcaaacattatatacaacccaatcttagacagataagcctcaagctgaagtcctttttgcctcatttcctgttatctgatacatcatgtctagctttcaacagaaaattacacagatgaggctgggcacatggctcatgcctataattctagcactttgggaagccaaggtggacagatgacttgaggctagaagttcaagagcatcctgggcaacatggtaaaaccccatctatacaaaaaataagaagattagcctggcatggtggtgcatggctgtagtcccagctacttaggaggctga

SEQ ID NO: 70289 - DNA, 2238 bp, Homo sapiens
ttaaaatttcacctatcaaattggccaaattgagaaaaactgataatagccaatgttggttaagttttaaggaaatcaggagtggcaatgggcataatctttccaatgggaaattaagcgatgcatgtcaaaatttaaaatctacatactctgtgaccaaaggcagatacagggtttgtggagcccaagcctatgcaactggggaagggagagagttcttttaaaaaaggatcccaaagttataaatacaaatttaggtatgacattaaatatttagttcgaatgagaaaaaatcacaacaaatttttatgaaattggtaaataccataaacatcacaaaatccatctctatgaggcaaacttgggaatcagtctggctccagggcatggctcttaacagctgtgctctgactgcctcagaatgtatcattcatctgtgtccattgactactacagaccaaaacacatttgcaacttcttgtcacctctgctgctagtgccttggtccaaacctccatcgtgtctctcttggatcatgggaacactctcctaactggtctctgtattttgcccttgaacagaatgcatgtattatgtttttaacattttttagtaattgactttctgacactcctctattttatttattatattattttggttactctttgattgccttttcatgtgacgatggttttgtactattttctacaaaaagacaggaaagataagtcctctatcatggtaggtggaaatctattttttattgttaatagttgcataaaacctgaaaattctcacgcacacaaatttgctatttgtagcactgccacaggtttgttgcatttgtaattgcatatactgcattattgaatatgtttctgacaggagagagccttcgtttagtctagccactgatggaaactgaatcctttgtttacaattttagatacctgatgattggaagaattttctacagactagcttgtggctctatacattttacatgctgtttctccttcactactcatatatttctggtgccaggcttggcaagaggtgttttcattgtgatgtgacctctgaccttgcagggtgagatggaatgaggggcagtaggaatattcctgcctttttttctagtctggaacagctatcaatacctatccctggaggtgaccccaaatccatataaaaaagccactaaaccaaaataaagtataattccaaagtcagtttgaccccccagattccaaaaatgtccatgtctccttcagtgcagtcaatttaaaggaatgtttgatgagaggaaaattgcagtggatggcaacagcagtcataacagatccagttgaaatattttatttttacaaattttacaaaagcagagccattgaacacatttcgaggatcccttttacgtcttggaagaagctttaggaaatgagggaccctgaaaattacacttaattaggcacttaatatatgtgcctctgtctatgacctggatacttctaagaatttatcataaggaaaatgtgcagtaaaaatcaataatagcaaacatttgttgaacgcttactgtacaccagacaccttgctaagaacttcattttgactttttataatgagcgttttatttttatatcttatttaaaaattccagagaacaatatccgtgtttaaatgggaattttagtttagacaatgtcaaaattatgttcatttttacttcatcttttcacttcaacttttatatggatttatgcagtttatacaacaactacatagtgaatgctaggcagtgttctagatgttgaaattcctgccttcatgaagcttatattctagttggacaagatactcaataaataagttaacaaataagataaataagtctgttatcgcatgttggatgggtataagtactaaggagaaacaagatagcaagcaaggaggtaagaaatatgtatgtgtatggagtgggggttgagattttagatggatcatttcacagagaaggtaatacttaagtaaagaccaggccaggtgcggtggctcatgcctgtaatcccagcactttgggaggctgaggtgggaggatcacctgaggtcaggagttcaagaccagcctggccaacatgagaaaccccatctctactaaaaatacaaaaattagttgggcgtgttggcaggcgcctgtaatccccacctactcaggaggctagggcaggcaga

SEQ ID NO: 70290 - DNA, 1361 bp, Homo sapiens
ttaaaaatgggcaaaactaatctatggtgttgaaagtcagaattgtggtgtacctcagggagaggtaaacactgagaaggggcaccatggggtctgccagcttctggtagtgtgccagttcctaatctagggactgataacttgagtgtgttcattttgtgttcatcatactcttcacctaatcatttgtacacttttctgtaacctttatgttacattttaaaagaagttaaagagttatgttatagaacttaatgtgcattctttagaaaaattttatcctaaagaaatgtaaatttatagtcagttctagagcttatgatgtgtctttttgaaagtttgacctgcacctgtaccctaaaacttaaagtataataataataaaaaaaaagaaaaaaaagaaatgcagaaaatgatttgacaaaaaaaaaaaaagtttgacctaatcttaatcatggcagatttgggaatgctaatgtttatatatatactttcataattacaccaaaattgatgaatctttctctgggagctatccattgatgttccttgtaattagcaacctgcttctgtttccgaaattgtattttcaatcatataagtgtgttcaaaggcctcagcggggaccagaattagctacaatttatattcagttcagaacatagaattcgtttctcaaatttctcattagcttggcagtttataaacttggatgtgtgtatgtgagttttaggaatctgaggattggacaaaaaagagagacagagaatattaaggcagtaaagaagagtttggaagagtagagataagtagaaataatgacattagaaggcagaagtcttcagatagtcattcagaagcaagatgatgaaatactcttttggccagacacatcatacttactcaacctttgtatttagcttcaattgttggttgaatggactcagctgttcacactgtagaagtagtggtagtggtagtagcataaggagtgtagattttgctttaaatatcactcatttaaaatacttttgttctttgccaggtgatatgatatgatatgatatacatgtcacatttcttgtcatgcatgaacctaccctttagttggagaaacaaggcatttggaggtgaaatgttcaaatgaaaatatatgtacaagataagtggtgtaaatacacacacagtaacagtaacaatatttgatacattttgcatttgtttgtatgccagccaaataataaagaccagctttctaacagaaaaatgacaaaggactggattggacagtctgtgaggagcgatatataaatcaccaatacatacatgaaaatatgttcagtatcactggtaatcaaagg

SEQ ID NO: 70291 - DNA, 1050 bp, Homo sapiens
cttctttttttggctgaaatctagtaacttttaatgtttaggacaaaaagaagacagctaatctgagaccaatgaaagaaaggaatgcagaagcctgatgcctgggcatcatcagctatgcagtagcatttcctccttgggaaaaatattgacagtttgaaggagacttgagatgttaacataattacttaagacaaaggctgagcagggagagagagtggtcatttcaaattatatggtcaaaaataggtaaatcaaagttacatgctttcaatttgatgtatgtgcttttcattttggtttatgattcagaccacttacagttgatctctgtagaagtgcttttaagtcaaagtttcaaaaatgttagggaatagtgctttttagttattttttagtataataaaaaaaattccttgcttctatgtgtgactatgcactttacgtatcaaaaagtaatcttaaaaattcccagagttgagtctatttattaactcttgttgagatagtttctgggtttggatttaaagtctaaaatgtgaaactttatgaaaagtagagcccagggccaggtgtcgtggttcagatctgtaatccaagcactttggaaggccaaggtgggagctttgcttgagctcaagagtttgagaccactctgggcaacatagtgagactccatctctacaaaaaataaaaataaaaaaaaacttagccagttatggtagtgtgcacgtgtagtcttagccacttgggaagctggggtgggaggatcacctgagcctaggagttcaaggctgtagagaggtatgattgtgccactgtactccaaactggatgaaagagcaagagccaaaaaaaaaaaaaaaaaaaaaaaaaaaaatgctcagctctagaactgactatagtaataaaaagaagacattctttagtgacataaaacttgggtgttatatcttacattggctattattcttacgtgcaacaacataacaatgagaaaaacaagccagatacaaaaaagtatgtattgtttgattcccatttatataa

SEQ ID NO: 70292 - DNA, 1052 bp, Homo sapiens
tctgcctctcatcacatggcattctccctgtgtgtcttttcgtatgtcattttccttttttaaggacacctgtcatgttggattagggcttactaatgacttcatcttaacttgattacatctgcaaagactctatttccaaataaagtcacattcacatcatagatacaggtatgcgtctttctgggggttacaacttaacccataacatagtgtctctcagaactgaggtttgttcaatgtgggttcatggccataatatgaataacaacaacaacaaaaccctgaggcttggagccctcagaggggttgagaggtgttttgacgggttcgtgaagacagcagctgtagtgctctaactttttcatggtggctcatatgggctattaccatataaactagggaagccaactcattttcactcctgcattcactcattgagttgtttttttttttcaccttgccaaaatgtgtgaattcatataagaggaaaagtaatttcagaattatctagtggtaatggtacttgcaggatgacgggcttgttttttttttttttttttttttttttttttttaagaagagaagttttgtggcttggggatattatataaatcctcaagtggggtcatggggatcaaaatgcttgggatttattgctatacaggaaaaaaagtgtattttctgtttaattcttcaaaaaggtcacacatgggatctcagcaggtttagtaaatcatatatcctgggggaggaacccagatggtgtggagctactgacctagcacagagactgaggcatgctgctggaggcataaagcttggctggcctctgtgggcttgggttgtggctgtgtcacggtctaccactttgccatttgtctctgtggatcctgaaagctgcagataaaaattttaaaggcttagctgcctgtaatttaagaaagaacttggttagaagtcagatcaagtgaaagaaaatgaaatgtcattgcacaaaaggaaaatgaccaatctggtggaaatggagcattttttaaaatagttttttg

SEQ ID NO: 70293 - DNA, 1775 bp, Homo sapiens
ttataggtgtcactaggtccagctaatgctcaactggaggggaatatataaggacatgaatatcaggaggtggggaacattaagagccatcctagaagttgcctaccacaggagtctaggaaggtgaatgattttatgttcccatcacacacaaaatcaagaaggagacattggatattgggtatgctgttagccattgctatctcagagagtgaatgcagagtacaaagtttggagacagaaataactggatttcagtgctagatctgctacctattaaatgagttaattaacatctttgaccttctgttttctcaacaaagtcacagagttactatccaaattaaatgaggtaagatagtataacagtgttctttataagttctcaatgaaaggtggctctcccattactatgtagtggagctgcaactagaattcagtttcctcaaaggtaacagcagtgatttttctcagtgtaacacaatgtagcccagacatattaattctaaaattgagagtgtagaagcctaacatttaggcattttgctttctcatttagaaactactttcttttccagtaggctgtctcaccatgtaggcaaatgtgaaggactcatgtacagcaaagctgagtcctcctgcaactgtgctgttggaatacctacaccaattgaacagtgtgacttcctttatttttgaaaaattgtagtttttgtttatccttttaagtagaggctttatctttataaactgtctttgggttagataaacgtatatcagaaccttgctgtaaagctaaattttttcttttctgcttttcaacctaaagtctaagttacagttttggtaatacataggaacttattctttaggtgaaattcctttatgtcactttgattacactgaataatctatctttagaattcagtgtattattacaacaggatcagttgtttaatattatagtcatttatatttgtccagttattctttcaaaaatatattttgagcacttgctttatgcaaggaaccaaggaagttgctctgagggagacagatgtaaaaatgtagttttgaaattaaggaatttacaatgagaaaagagaagtaacaatgaacacaaataattataagaaggtagttctttaaaaagtcataataagcattaagtattaaggagaattcgagagaggaatggatcacttccagcttgtagatcataaggaagattgctctactgcatggccaactcctgattagagattatgcacattaagctcttgaaagagacttgctgacattgtcaccttctttgcttaagtgcttggttaacataaataggagcttcgattactataattcaattggaatagaaggccttttaaatcaaaatacttaacctctctgccctaggaaaagtaggaaacagcacatttgcagaagggattcagctatgttaaacatgggtcctttagttgtctagtggtaatttggccaatgctcaaaacacggaaatggagaacaagtcacaagagcagaggaagatgaaagatgctgagtagacacagtaacatgaataaactgaataatcgaaactacatccagtgtggatttgtaatagagacactattgcatgctggtgaagaagctggctctggaatcagtctgcctggggtcatcaaactgtggttctgatgcttggccaagttagtttcttcttgtctcaattttctcatttatataataaggataatattttatttcacagagttgtt

SEQ ID NO: 70294 - DNA, 1086 bp, Homo sapiens
tttgggttggttccaagtctttgctattgtgaatagtgcctcaataaacatacgtgtgcatgtgtctttatagcagcatgatttatagtcctttaggtatatacccagtaatgggatggctgggtcaaatggtatttctagttctagatccctgaggaatcgccacactgacttccataatggttgaactagtttacagtcccaccaacagtgtaaaagtgttcctatttctccacatcctctccagcacctgtcgtttcctgaatgatttttagataagaattttgccacacaagtgtatcacttgcttggattgtgatgtgcattcagaaggagcataggaatcaagatttgtggttgagttaagtaatgtattagatttaggtccattaggggcagggcattctaggctggagaacagcatatctcaagggcgaaaatcaggatgagaaaaagtaagcagcacattttaaaaaagatgaccctgaattttagacacaaaactactaagtacttttaatcagaatgaaatcaataactgttactgcctgttgaccagaggcacatgaattacagtgatggagttgtttttcagtgtcctcagtgaaggatctacaaacgacatgccatcttgataaaacaaaccaagattttgatttacagtgctgttttagggcaggatgagatgtctcagaggtagtaggtgttactgaaaacatcattttatctttgaaaacctgagtggcagtgctcatttttccactttaacatgatgagagaaaaatttaatctttaatgatcagtccttatttctctaactgttcccaatagaagggtgatttagcttcaaatttggtacccaggaagttgaaattggatcagatacaattaagttgtaaatcaaaatgtcttagagctctatgatagaaggaaatttaaacagtaaaaattttattttaaaaataattcctgaggtgtttaattatagtaggacattgctgatatcacttatttaatttatttatttattgtgtaggttctttatgtttagattttgaacagctttaattgccttcttgtgacata

SEQ ID NO: 70295 - DNA, 2705 bp, Homo sapiens
attggctacccagagtagcaacaaagaagaaggtgtccagtgaataagcttggattttaattgtgaagctgcagcaagtttacacacaagagtatcagattaacacagaaatctggaaatgttagaactttggttggaaatttcctgtgacccttgggaatgacagctttagagccaggattgtgtgattcacagtatagtcttccacagtctcctgtctcttttataaggtgtcctatgagactaataatatctttcttaggggactgttgagaaggtggaattttgcactgttctatagtaaatgctcagcaggtggtaattaagaagaaattatgtttctggaaatatttgtagatgtaagttatgatcagcatttagcttgcctatccattgttctggttcaaagagttttgcatgttagccgatctcaaaactaaacatcttccattataaagccatcaaatcattctttattgagagtttatcaataagcatttaacttaattaactccctcttgagtaactggataaatgaaaaaaccatattatatatcagaatttgaaacaagaactgaaaactcctaaaacatggaaccaaactcaaccaggtattatttaaaaatacaggttcttagctgggtgcggtggctcaaacccgtaatcccagcactttgggaggccgagacggggatcacttgagtccaggagttcaacgccagtctgtgcaacatgggaaaccccgtctctacaaaaaattcaaaaattacccaggtgtggtggtgcatgcctgtagtcctagctactctggaggctgaagtgggagaatcacttgagcccaggaggcagaggttgcagtgagccgagattgtgccactgcactccagcctggatgacagagtaaaatttccatctaaaaaaaaagaaaaagaaaaaagaatttctagaatatcagagaagtagcacaaggctatgtgaatgcctagtaaatatttgcatgtttatctgtttatttattattattatttttgagacagagtttcactcccatcacccaggccgtatatttgcatatctattgatcaaggaataagtggcactattagattaaaagaaagaattaactagcactattatttcacactatcaagaaagattattgtttggagtcctttcttaattacttattgatttgaagaatttgctactagaagaaactcttaagtttatttattgtttcttttgtcacttgtttcttttatcctgacctctggttttataaatgaggaaacagagaccttgggggctaaatgacttgaccttaggtaactacctattgactgaggcagacctggaaatcaggctacatttactgagggcacaaaggaaggggaagcgttcattccgtggctttcccaggcttttgcacgtgttcttgtagtgctgttgaccgggcattcctgaaagcattggttgataagagtgacagagaaaagaggggctgagaagggatgttttctaacttgctaattttcactgggctcagggagaatcggaaatgagtgagtactactctttggtgacacactgtggccttatgactctcttaatgaaaggtcagcttagcaagctgttgaaaaaaccaggctcaagtaatgctcctttggaaaagattgattggggtggaatacttgcagttggactccaaagatgacctgtggtgttgatatgggtagattttctctctggcagacatatctctgttcctttacatttgtaaggggagacactactctgcactcttgttctccagacagcagagaagcttagcattctactctggctgagacttgtgtggaaggagagagaatgagtaggttgataagaaggcaaggtctaaaggacctctgctgtcagaaaagtaaaagcctggattcccatctctcattgtactttatctcaaaattattgccatctatcagtatcattggttctttcaacaagtactggttgagtattcactaccagtcaggcactgttcttggtgtttggggtatcacagtgagcaaaccaacaataacccttgtcttcacagaacttacattctggtagcaggagacaatgaattatgtttcaccctcccaaactgctcccttgatatcctctctctaggttcttattcctcaccctttcctagaaagctccaggagttcagctctattcccatgtatttcaccttcttctgacccctgattaggctttattgtaagccagaaggcacacatactcttgctgaatcctgtatttgtccaacggaccctaaacaggtaaagttcttatatactgtctctttagatttatatgatgtctctgagcttcttagaatttctagtaggaattccaaatgtctccaaatgatttttatttttatttttatttttattttatttttttaaaattttttaaaaattttattttattattattatactttaagttttagggtacatgtgcacaatgtgcaggttagttacatatgtatacatgtgccatgctggtgtgctgtacccattaactcgtcatttagcattaggtatatctcctaatgctatccctcccccctccccccaccccacaatagtccccagagtgtgatgttccccttcctgtgtccgtgtgttctcactgttcaattcccacctatg

SEQ ID NO: 70296 - DNA, 1070 bp, Homo sapiens
cagtgttaaatacattaaatacattactacttaattaaatgtctcttgaataactggataaatgaacaaaccatactatttatcagaatttgaaacaagaaccaaaatttctaaaacatagaaccaaactcaagcagataccatttaaaaatgtaagttctagaacatcagagaagtagcagaaagctatgcgtatagtgagtgcctagtaacaacctttgcctgatcatcagaacaaatcccacctccctagatctctaactttttggaatttgagacagtattttcttcatccttcttatgtaccatcccttttaatgaattatatctaatatgttgctagtcaggaatatccgccttctaggaatcttagaactagcattaacactttcatttattttaattctgtgaaatcttaacaagcaacactgaattgtctatttgtaatattatcatttttccttggaatttataattccttttaaatcatttacacttttcttccctgcctctcactttgcagcagtcaatagagctgattgtatttatttctgcagttgtaactcaaattccattaaaggttttggtgccgtcagccagatcatgttggagccagggattccatttcctataaacaagttaatatcttccattatttttcttccttgtgtagtgacagtgtttattgttgttccgaagccaatttgaagcttaactttagaaacattatatattaatctgaccatatttggttttaaaaaagtctctatgagtgaaataaagattttctgtttaatgatgattaataacctattcggatggattcatctgaggaactgaagataattttgccatcaggccacttgtatatgggcacaaacagatgggtcttactccaaaccctgaaggcacagacgagacgcccccgtaattgcttagggaagaattgtacagccatggcctcttcccaaggacacagtgatcttcactgtgataactcccaaatttgacgcttttcaacaaggcaagaaacctcaccacattcattcagtaaaaacttcccatgctgt

SEQ ID NO: 70297 - DNA, 2337 bp, Homo sapiens
ctaatttcctttgtgatatttttttttttgagacagggtcttgttctgttttccaggctggagtgcagtaacaccctctcagctcactgcaatgtccgcctcctgggctcaagagatgctcccatctcagcctcctgagtagctgggaccacaggtgcatgccaccacaccctgctaattttttgtatttttggaatacacagggtttcaccatgttgcccagcgtggtctcaaacccctgagctgaagcagcctgcctgccttggcctcccaaagtgctgggattataggtaagagctaccacacctggcctttttttgacccattggttatttggaagtatgtttttaaaatttccacatatttgtgaatttcccaaatttctttctgttgttgatttctaattttgttccactgtggtcagaaaatatgctttgtataatttcaattctttaaaatatatttttaggattgttttatggcctaccatatggtctagcctggagaatgctctgtgtgcacttgagaagaatgtaactctgtaattgttgggcagagtgttctatagatatatgttaggtctagttagttgatagcacatgtcttatctttttaaatagatttaccaagctttgtaatcaggacttgttgatatttaaatacctctgaaaaagccacctacctatttggctctatactttcttcctgaattgacatggttccaaacacactgatattggaattgtatttaaaaaaaaattttttttttctaaaccttcacattgtttttctagggtacaggtatttagcttccagtgggaaatatgattgccaaatgcagcctgcttcttcatgttctgttactgaattatcttaaaatcaatacaattactgcttctctaagaattgtgctgcacatggaggataaattcacagttttagaggagattcacaaattttgacgttcataaattatgctttaattttttgcaattgtttctggatatctgcatttggaggctatagcccttcctctgaatgggattcgagattcaacagagtgcaatctatgcctattaaggaaacatacccagaacattcttggaaatgtgaagattgtaagagtatctcaacactaccatgaaatgcctgtctatttaagtcatattttgagtggtgtttcaatgtgtcctgttctgtgaaagcattttctcttttatgaaactactaaaattgaagccattagtgttgtaaatttggaatccaagttgagatggcgtctggctgaatacactctagaggataaaaaaattgttcagtttgacaaatgccagggttttcactgatatagtttactattgattaaaatatacttattgctaattatatttttgggtggactaaatttttttacactgcttttatatcaccattaaatatccagctgtctctatttcaacactgttattaataaatcatttggctttcataatgtaatatgtgaatatgttgcacattattgaaaaattggctgtgcccaagttttctctatgttttcttgtattcttttactcagaaatgatggatgtttgcagaaatgaataaagtattttgattattctgtattttactttgaccattgtcatatttatgtataactacttgatttttccttactcagctatagggaagaaatatttctttcctctcctgcctgctgtggcaatgccttattctcctgaatttgcaaatgaagccgtgtctctaatcattactaatttgattttttcctattttaggttattatgttgagtttacataacttgagttaaaagctgataattcattaaatagtttgtcctttttttttgagacggagtcttgctgtgttgcccacgcttgagtgcagtggcgtgatctcggctcactgcaagctctgcctcccgggttcatgccattctcctgtctcagcctcccgagtagctgggactacaggcgcccaccacctcgcctggctaatttttttgtatttttagtagagacgggatttcaccctgttagccaggatggtctcgtctcctgacctcgtgatccgcctgcctcggtctcccgaagtgctgggattacagatagtttgtccttttttctttcttttttttttttttgcgacggagtttagctcttgttgcccaggctggagcgtaatggcgctatctcggctcaccgcgacctctgcctcccgggttcaagcctcccaagtagctgggattacaggcatgtgccaacacgcccggctaattttgtatttttagtagagacagggttcctccatgttgg

SEQ ID NO: 70298 - DNA, 1952 bp, Homo sapiens
gaatagctgaaacttaagcatgacccttttctctattagtctttctgtccagtggttgccaaatgcatcttctgaggtcttcagctcgatgctgtgtggggaactcatgccccagttcctgagaaatgacaagtcagtgctggttctcccttcttccttttaagtgagcagcctctggcagatctttctggaagtgtagaaggttttcctcaggtttggactgagatgtggggatggtaagaacttctttcagtaggtagattttcatgtgaataagtgaaagggtgagggggatccacataattcctaaatattcaggaaagtggaaacaatggggtatggtttttggtaaaattccaatctcacatcactctgtcttccaggatgggtcaatctctatcttcctggcaccagttgctccattttctctacatgccatttttacccctgtggtttgggagaggggattcaatgggtttggcctgggtttctctattcccttgtgtagcaaaggagcaattgatgaagtgaagataattgtgatgtagaagaggtgattctctggcactgctctttagactccaaggcccttaggcaatggagacagtcagagtgtctcagttctgctgtgttggctcaggtgttggctacctctagaacctctttgtgcagtcaggtactttgtctttttttttttttaattgtgaaagagtttcaaattgttagttcgcatttttaatagctttattgaaatataatctacgtaacacacaattcagtcatttaaagtgtgcaagccagtgacttcattatattcacagaattgtgcaatcattatcacatcaattttagaacattttcatcattctaaaaagaaaaccttgtatccattaagtagtcactccttattttcccctccccactctaaaagtctctacccctagacaactactgatctactttctgtctcggtagatatgcctattctgagcatgtcatataaatggattcatacaatatgtggtcttttttaactggcttgtttcacttagtgttatttcatttttattgccaaagaatattccatcgtatgtatataccacattttatgttttatttatccattcatcagttgacggacatttgggttgttcctacatttttgctattatgaataatgcaggtatagatattcatgtatgagattttatgtggacatatgttttcatttctcttgggttatatacctaggagtgaaattgcagtgtcatatggtagctgtgtttaacctcatgaagaatggccaaactgttttccaaagcagttgtaccactttatcttcttaccaagcaatgtataagtttctccatgtccaacacttgtattatgtttttattatccaccatcctagtagatgtgaactagtacttcattgtggctttgatttgcatttccttgataaataatgatgtaaagcatcttttcatgtagccatttgccatttatgaattttctttggagaaatgtctgttgagattatttacccatttttattatttgtcttcttgttattgagtgttaatagttctttgtacattctagatataagtccaatatcagatatatggttttcaaaatttttctcctattctttggatgttattttcacgttattgatggtatcctttgaagaataagttttaaattttgatgaagttcattttatttgttgtttcttttgtcacttggtatttttggtgtcatatctaataaggttttgcctaacctagtgtcacagtgatttattgttataatttcttccatgagttttatagttttagctcttacatgtagatatgatccattttgagtctttttttttttttagatggcatgaaaaaggggtaggtcaaactttattcttgaatataaatatccagttgtactagaac

SEQ ID NO: 70299 - DNA, 2383 bp, Homo sapiens
ataagagtaagtgattagatagtagtagcagctaatatttttcctgttatttagctagaaaaaatgaagattcggagaaatatagctaaatcttaacatgatctgtttcatagaaacatggtattctttgatttttatgtgatatggtcctagatattatgtgatatggccctattagattgaacacatgtggtattccttttgccctgtagtacttacctaatttatttataaaatactgtgctagaccctgagaagagaaagagatgtacaagacagagttagagttgcttccctcgagaggtccttgcctagttcgaggtgacaataaacatgtgaaaagagtaatgcctgacagaaatttgtgctgtcatatgatctgtcactctgtgagctgtagcaaagattttgaaatcaagaaagagaaatctttgagctcctgaatgtggaacaacttaatgggagggaagaagaaaaattgggggctttgaaaggagaacagcgtgagaaaaattatgagtgcaggaaggtgtaagacaaatgaacaggggaatgagtgttcagtgtagcaggtgtgatgatctgttaccaaaatatctcacactatgaccaaggattaacaaaaagtataagtagatggaaccatgatatataattatatcttctctctctgtttttctttttggtgtctttactctgaatcctcttttgcatttttaggcttctccttgtgctttcatatgtacattaattatttagatagttctgtattacacttttccttggtgatggttaataccctttgccattatctttatgacttctagttggttttaatattcacttacttaatcttctctttcttgatttacaattttgctttatttcttcataacttggtcaaaattttcattcaattaacaaaaagtgtgtttgaatagcgtttattatatagagaggcagcaaagtataattgttgagtgcatgggctttggagatagtctgcttgggtttcaacctggctctacccccactagtaagactctaccaccagggttttctaaccttcaaatggaaattccaacttccttatgtgggtggccttgggcaagttgcataacttccctgggtcttagttattttgggctataaaataagatattaatcacatgtttctcagtgctgtgaaaattgataagataacccaatttggactacagcacattaaaactcttattattttttattattgtttgctccattgagatgtaggtatgaacaagacagaccagatctcctcagtcttggaactgttttttcctgatgttatcattgttatgaagaaaatgtctgaatgtggtagagaattgagggcatgtgaggtgtgggcagcttttgatggggtggtcagcaaagcgtactttgaggaggggggtccttttgagcttagactcaaatgaggtgagaagaaaaattatagaagatcattatagtttaagggcacttaggctcaaatgctcgtactttttaaaagaaggcattggagcatgttttaatgctagtgggcacaattcagtaaagaggaagatgttaatgcagccaggaagagaggaaataatggcagaagtattgtttctgaaatggacagagagccagggcagctaaaaaggttggtgtttgtagaagttgagactcttaacttgtaaggagagaagacagaatatgggcctgatctgatgcagatagattcctgtcctgttttattttctctttgaagaatgagatgaggtctttggtgattgggagtggggtgatgggcaagtgtgtgtatgggaggctagtttgaaagtttggcaagagaaaagaataagtaaaatgaacctatcagggatctgcagtgggattccaggcaattcttagtgcccatttgtgatttgtggtcgtgaatttaaaatgagagctagccaggagggttgtatgcataaacaaatatatatttttttttatcagaaaagtacctgggtagtatactttctacagtttgtacataactgaaaagtatttttttctaaccttcaaacagaaattccaacttccctatgaaattatttggccaagatcttttattcaaaactctgtggtccagcctttctaatagaactttctgcaatgacataaatatcttgttatctctgtgtctagtacagtcaccagtagccacatgcggcttttgaacccttgaaatatgactagtgtcactgaggaaccaaaatttttattttattttattttcattgcttaaatagccacatatggatagcagctactgttttggacatcacagttatagacattaccccactggtttctggcatttattatt

SEQ ID NO: 70300 - DNA, 1135 bp, Homo sapiens
tctgtctcccaggctggagtgcaatggcgcaatctcggctcactgcaacctccgcctcctgggttcaagcaattctcctgcctcagcctcccgagtagctgggactgcaggtgtacactgccaagcctggctaattttttgtatttttagtagagatgggatttcaccacgttgctgaggctggtcttgaactcctgagctcaggcaatctgcctgcctcagcctcccaaagtgctggaattacaggcatgagccaccacacctggccagaatgatcatttttaagatgtcaaaatgtattacagaattaacagtgtagaattacttaatcaggaagttaattggaaaagtattaatactataaatgaaaaaacataatagtctaagtacaacaatttatccattcctttagcaatagttggacacttagaatgtaaaactgttcaaacaaattggtatattggagtttgggtagaaagaagggcgttggaagaggaggaaaagagggtgagatgatacattaatataaattactgaaaggtggtgttcacatttagaattttttttttaagttgcatgtttaggattttagtgctcaggaggaaagaaggccagtgttgcccttccagaccatcgctgccatttccctgtaatatatcgtgtgtagaggaacctaatgcctgcagttactcagccaggggaaacaggaggcataaagccaggaaaatccaaggtgctgctgggcaggggagaggcatgagtggtggttgactcttctccaaatacccttcccttatggcaaaaagccaactgtgattctgatttcatcctgataagtacaaaggacttctttacttagagaagtctctgaagttaaatattaaaagcaaaggaaagaaaggaaagaaaaaataaaagtagataaagaaaaggaaagaagaaaaccatggtgtaattctactggatatgtctgggttctcttagaaatgattgcatgactatctaaaaatgagaaaagaaaatagatgtcctgaatcatgaacccaattaatcatatgtggctgttgtaagaaagggaaataattgtttttgtttctttaaatggattagagaattttagtgtgctttgttgtat

SEQ ID NO: 70301 - DNA, 1154 bp, Homo sapiens
gtaaaagttatttcatatttcctgcccacagtgacaaaagttgatattttatttttgtcttttttttttttaaagttaatgcaacaaagttcatcttatgacttttgaaaaatgctctcatggttgcactggaagatggatttccccattgcttttatttcttttatagtgtattaaattttttgctctttctgttatgcatacatttcagtatttgttcatgattgtgccttatcttagataagcttgtccaaataagtcatatactctatattcattcagttttctcaaaatgaattccgttcccaactctataatacttttatttccctttaaactttaaaaaaagttatttgtaatgggttttgctgtcatatggtgctcaacatttaactcatgtttttttctgtgtggtgtcccaataaggttatttttttcactcctcttttctttaattcccatccaaccagggtcatggatggattgcctttcagcatgttgtacttccttcctttctatactctcctcctttccatggccaggcttgttgatgattttgtaacaatggaactctatctctttcctggagtcctcatcaaactaggtcttcatcaagttctgaggggcatgattttaatcattgaataatttattaatttaatccaactcactttgccatccaggtgattttccagacttagaatctcaaatccttcacctaccaagttctcagggtgactgttacaactggggcctgtccggtaaaaatgtagtatctgcctgcaaatgtgctatataattgaaagctagtgagtaaccggctggtgcttttcagccaattaagacattttaagtgtcgtactgtactcattttgtggtacaaagtggtcacccaaagagatcaagtcctaattcatgtaaattgtaaattttaccctatttagataaagagtctttgcagattagtagttaaggatcttgagatgagattaccctggactaccaggtaagcccctaaatgccatcacaaatgtccttatgagagagagtcacagaggagaaggtgatgtgaagacggaggcatcagttagaatgatgctgccaaaagcccaggaatgccagggcagctactaggagctgaaagaagttgcaag

SEQ ID NO: 70302 - DNA, 2620 bp, Homo sapiens
agggatcagatactttaatttttatgactataatatgcacatattgttagtgaaagcatatggatttttaaaaaaattattactaaggacaatctacatttgtagattcttctagaatcttttgctgttattagttacaaaattaatagcatctatagtttctttagcacttactgtttgaacactgtgctagcacttcctgtatatcacacagtcccttaaaaggaaggcattatcatttcagttttccaggtgagaaacctgaggggtagggatgttaagtaacttgctcaaggtcacatatttagtatgttgtgttgatggagttcagatcccatcctctctaattccagagtctgggctcataaccactgtgcccaactgctattttataatctctaattttatgtgtcttttattgtacattaaataacattcttttttgagagtaagcagaatataaataatgatgtattgagtggccttctgttaaagtgaattcatagccttattgttggaagtctttaagataaacctttacatgcaatatggtggatggatttgagacttgcttatccaaactccacatttttttccccaaagaatcagctatttctgcatattttctttcagtttttaatttcatttttctgggtataactgtactttgagcatgaacggggcagtacccccttttcctcgcatctcctgtgcacatatgaaagttgttagcatttagactggcactaacttttcaatgaatagagtgggatttgatggtattctgtcatttgtcaaaaagaaaagtttaaatacatgtatattatcctatgtcatagaagcttttattatgattgattccttctgaagcagtatactgtgcagatgctttattcatgagttgttatttctgcaaaaactctgtgggttcctatttcattttcctcagctgaatatgccatgatttttttttgttgttgttaaatttatccttatacaggcaatattatttcagagatgttgatgcacattgtaggcctagaacacagctgtttgtaaaatttaatgattgtggactgtagttaaattcccgcaagttgatagtatagatatcaaaggcatcgattgtgcaagaaaattatctttgatttgtgtggcaagactgctgtcacaccatgaccatgattttcctgtggtggcagggatgttggtggggatggcattggaaataagtgacatatgactgataatagtaacaagaggaacaacagatgtgtagtgaactcatctgtctaataaactcttagacattgtatatttattaaaacaacaattgcatgtgaaagtctcaacaccgacatcatatttgcccatcactcttctttttcttcctttgtctttgatttgcctcattctttgttttttgggggggatgaggggagttatttctttgcattacctttctgcccttattagaaatgcaatggattattaaaaagtattgaagagaaaggcaggttgtatctattcatacacatattgtggatattacttttctgaataaatgctgagttagagtcctttatcccccgcatatgaatcttgttgccgtgaattttgggagatacatattgaacactggtacggagtgttcttttttacttcttgtgtatttgagtggttgtgtatgtgtgacaacaggaagaaaatcataatgatgtaatgagttatttaaggcactttttatccctctaccctctgcccatcaccactgtgctctcctctctagtgaaagttgttagcatttagactggcaccaacttttcaatgaatagagtgggatttgatggtattctgtcttttgtcaaaaagaaaagtttaaatacatgtatattatcctatgttatagaagcttttatgatgattgattttgttctgtagttttatttcccattctagacattcaagggaaactgaaggtgagcagtgattggccaaactctacttaagctctgaattcatcagaactagaggaaacattgcccatgcatgtatttgctgtagaaaccaaggcaacagattgtctttatgactttgtgcatgggtaaacggaaaagcaacacacacaccatgatcaaacaaaagcccttttttgttgcttctctctgccttgggccaaattatttcctccatccctccctttggagcctgctcccttctgtccttaggtttgtgccagccagtagcctcgtaggtgcattagaaattaccctcagatgaaggctgtcaatgtgacttttaaaatgtttattttttatttttttgagacaagatctcgctttgttgcctaggctggagtgcagtggcatgatcacagctcactgtagccttgacttcccagatttcagcgatctctcacttcagcccctcccctacacacctttataccactccggtagctgggactatagatgtgcaccaccacacccagctaatgtttttaattttttgtagagacgggtctcactatgttgccctggctggtcttgaactgctaggctcaagtgatcctcctgcctcagcctcacaaagtgctggtattacaggcttgagctaccat

SEQ ID NO: 70303 - DNA, 2173 bp, Homo sapiens
ataggtgatgatgatgatttcagttttggagatgttgagtttgaggtgccaatgagatagctaagtacaaatgtcaagaagacggttggatgtgccactctggagcttggaggaaagatatgggtagtaggtataatttaaaagtcatcagtatttacagttctttgaagccatgttgataagtgagattgcctagggagacgagtacagagaggaaggtactaggcctcagtcctgagaactcaagcatttatagtttgggaggaggaggagtggaagcctccaaaggagactgagaaggagcagtcaaaggagtaggcagaaacctaggagagttgggtgttcctgcgctgggggggagacagtgtttcaggaaggagggctggttttatatgtccatgctgctgcacaggacctgtggtgtggggctcggtgtccccgctttctgcactcagatcttgttgacagctcttgggttagctacaatgaggaagtgaacacaatctcactggcctattctttcaaagttttttcttctggctaatcatctttatttctttctattctttctcatatctggttttgaaactctctaacattcttgtcactctccctaagtatattctagcatgccagtggccttcttaaaagtggcatctaaaactgaactcgttaattcgtagtatagtcatagttgtacgtaatagaaagggactagtgtgttttcttgccatagtcattattattttttttaaatgtgaattcagattgctttggcttttgggagaagctgtatataatactgttaactcagatttagcgtgaaggcaagtaaaacacctatgtctttctaaactcgaattgctattaggtcagatcttacacttgtgcagtcaattgtttgaacacagaaacagaggattcaatttaatctactatgtgttggctcattcatttaaatttttttcttttatattacctatcctcttagctttgtattactcatgaatttcataaatatatatccttttgtcttcatctgaatcactgattaaaatctatagaaaattagagtttggagacagtcccatggtatacctatagaaatcttgcctaaattgacaccaaatcattaagaaacaccctcttaggatagtggttcagctgcctagaaatacgcccttgcattcattacacctctctctttagtaaaagcttaatgtggaaatgttatttgaaagtcaaaagagaagtaattgggatgagaactgttgaaatgctggtgtatgtgatgggccctgatatttgttatattagctagaatttcttcagtgtggactccaaatgcagcttatactatcttaaagagggtagctattggtttcccacactcatgtatctgtccttttactatatttaaaaatgcacagactttattgagtagctctaattgagtcctatgatttgtcttggatgaggattaacaggttgtagtctatttgaataatatgttcaggaggaatgaaggactttcacagtgttgagcagtctatggtcagtctttgaatccacaaacagaaaccattttggggccaattataattcagcatggactgcaggtgttaatacttctttaaagtctgcatcatgctaaatcactctgagaatgatagtgggtaaaaatgtgctctttgtagataaaattttattcctaaatgataaaagatagtactgcttcctagctgttttgctttttaacagcaccaaataactcaatacagccttcagatgagttgaatgcgtggcctcctgtcaaagttaatcgaaagataagcatcttcctccatgttgttagcaaagcaggtgaaaccagtggctaattaccctcaaaaagaaagctaaataatcccctcttaaaatcttcagcaattacatatacaatatcaaatacattactttttttgcttgattcccaggggaaacaatctttagctaattcagttgggggacacaagaggatgcggttttctaaaataaaaatcatgattaaaatagccagctggtcttgatcctgcacttaaaatatttcagaccaaagtcattgctatcctattttgatataaaactccagtgtctcaattgcttaggcccttgaaacaaatacaagattaat

SEQ ID NO: 70304 - DNA, 1054 bp, Homo sapiens
ctattaccatggttgacagaaaatatccctggaggtgggactctatcccatccagataaaatggctgctacatgttggaggctggatagaatggatattgggcagacaaccacattctctaatatacatcccttctttatttgtttcctcagctctgtaggagacttggcaaccagctatccaagttaactagaattccctgtaaaataacaacaagtgttcaaaaggccctcctgtaatgaatgtgcatgaatactggatttgtcacatctatttgggatattcagaggttttctgctttcttcctaattttcaattgtgttctagatagatgaggccaaatgactgagcagtagatagatgaggtaattaagaaggatttggccaataaattactgagaaaatattaagaaatacatcctctaatcagattgtttttgaccattttattacacaagtaatatatgttcattgtttaaaaaacagaaaagatagataacctatttgaagataatgaagagcatttgtaatctcatagctctgacttaaaacccagattaatttttaacccccttctgaaataaaaattgcctatttttatgtaagtatttctgtatggaaatggcaagtctattgtgtctttgaaaattagaaacagcaatatttattttctgctgcacctgatattttctttcctcaacaaatgttacccaaattatgtgacttggtaatttataatattgcctgactgatatttcaactacctgttttttccttctgtgaaatgcagattgaaaataataggttttctcaaaaagttgaaaatgtttcttttagacataaattattttctatttacaaagctgttatatttattcagcatatctcaaaggaaaattgttttcaaaaatgactgttttcagagacacacttcttcatcattccatcagaaccttataatgaatttgatgcagattgcttttgaggggtttatctctcagtcctaaacatataggggcatgttagaaaatttgggattctaggtgtgatgcct

SEQ ID NO: 70305 - DNA, 1021 bp, Homo sapiens
aggtctgcagaagcagatgacagtgatggtgctggaggtggggccaaagctaggacttgtcattaaccagcagggccatttctacttcacactctattctaatgctactttcttgttgtctctcatgtggggataatatttctgatttcatgccaactgctcagttttcagctgctgaggattctgctgagtgatgcatcatgtatccctcctcctgtagaaattcaagggaaattgctctctcaccatcacaacatggttgaagcccttaagccggattgtttacactctgcctccatcgcaggattatttgtttccttccttgcatcgctttgggtatttgatgctctattcgaatcattccttttccctccctcctcactctctccatttcagatgctcaacatggaattcctgtcagaagtctttttagagtgcttctccaaagctctgaggacttcctgaattataagagttcaccaggcccaagttgtagtgaagatgccagtctgtctgctatagcaggatttattttaaagcatctctgaagctttttgttttattctgctcagagtcaagagaacccctcttggggacagtgaaatatacttaggcacgtttctcctgagcacatgtttatattttagcgtgaaagagccccctaagcttgctaagaatttatatagcaaagattgcaatttctcaagtcccttgtaaagtcattatggttcatatgacctctgggataatgcacatcttaatgtgctgcagaatatcagtgtacacatttcttgatcagagtaggactctacctagaatttctgatgtgtatgtgcacgtcttcctcgctttttttctctctcaggtaataggacctatacccttcaaaaagtcatagtgtcttagaaagtgctattttagttgtgtagtagagattctttctgctgttcactaggagaagtgaatatttatttttccatttatttatttcttcacttattttacacttaaaacatttaac

SEQ ID NO: 70306 - DNA, 1156 bp, Homo sapiens
cgggtttttacattaatctttcgtgtgtgtatgtgcctgtgtgtatgcgtgtgtgtgtgtgtatatattataaatctactgtttattttagtaattacatatatggattataggataaattctacatttattctcttttttaacatgtttacctaagacttgatttgaaaattgctaatgttgtttctggcctagtcatcctcatttggaattatggcagtaacgttcagtaatattaacaatttttctagatattatctctctggctgggaagattttccgtagatgattcatgtaaagcttagaaactgaaggtactttctgaagaagcatttaccttttttactactcttattttgagtgacttttcagtgactatttttcacgatgtacatctttaacatactgcccttccttccttcatattgcatccttttgtattacagttctgtgcagtcagggccagccgtggggctgagcctctgtgcacctacagctcccaagcgagctggttgagaaggaagcgtccgtatttacatcttggcaccatgcaggcctcctgaggtcctaactatggctgtttgcattgtgcagctgctaagcagattcttggactgcctgtttctcctgtagacgcatattcgtgcgtgtgtattgtgccagctgtgggtaaaattgtgaagtaggaagtttgccttttgcgcctgaatgatcgttttggcagtcatttctgtctccaactcaaggctcctttttactcctttctcaacccacggtttttgtgctctgttgttcttattaaaacctgttttgtgaaaaaacctgttatcagccccatttaataatgtgaatttaagtcaacttctccctgaagtatatgcattttaaactgtatccctgagtgtggtgtgaaaagcttttctttcctagctggattttaggttttgggaaacaagcagagaggaagagggtgggggaagggagtacttacttgatgcatctgaaatcatgctgtgggtccgtggttttccaactgtttttagtcacatatcccattatgctgaagctcagtatctaaaattggttttacaaaatggagctgactggctgagacagaaatggagtgttcagaggcccatttattcacccttccttt

SEQ ID NO: 70307 - DNA, 1054 bp, Homo sapiens
gttgggaaggaaaagggaatggggggatagggagagattggttgaaggatataaaataacagctaggagaaagtataaatgggaggaataaattctagtgttctgtagcacagtgggatgaatataattgacaatagtttattatatatctttggatagctagaagagaggatttggaatgtttcttgcacaagaaaatgataagtgtttgagatgatgggtattaattgctctgatttgatcattatacattgtatgtatcaaaacattactatgtaccccataaatatgtacaattatgtgtcaattaaataaaaaataaattgtagtatatccatacaacaaacactactcagtaattaaaaaattaactattgatatatgatacaacagagatgaatctgaaaataattatgctgaattaaacaaggttgacctcctcaaaaagaatgtttactgcatgatctcatttgcctaaaatttcaagaaatgcaaacagatctttttgttgttgttgggggacaggaagaaggagggatggaaggtgggatgtggtgggagaaaagagaccaacaaaaagtaaataaggaaatttttgagagtgatgaagcacatattttacatattggatatccaattccatcttgattgtggtgatggtttcttgggtgtatatatgtccaagagcttatcaaattgtgtattttattttatttcatatttttttgagacacggtcttgctctgtcatccagactggagtgcagtggtacaatcatagctcactgcagccttgaactcctgggctgaagcaatcttcctctttcagctcccagagtatctgggactacaagtgcacaccaccatgcctggctaaatttttgtatttgtagagatggggtttcaccatgctgcccgggctggtcttgaactcctggactaaagtgatcctcccaccttggtttcccaaagtactgggattataggtgcgagctactgcactgggcccagattatatattttaaatatgtggagtttattttatgtcaacaata

SEQ ID NO: 70308 - DNA, 1815 bp, Homo sapiens
ccttgacttacaaataggtccagtaaacggccaaatggcctttaggatcagaaaaccagtaagtcctatttcagacatgctgccttggcccgggtttccccctctttctccttcactttctttcattgctctgatttaaaacactctccctcttcatactcagttgattttgttgtgtttcccccagtgtctatggctgcaggtctgtcctccctccgcagatccttgcctgtgttcttcctaacgtggacccagccagaactccttagggtcagtttcctcttcagaaatacacacgaatctgcagtgcgttgggcatcttgattatttgtttgtgtttcatctttctcaagagtcatagaaagtaaagaaaaagagggtgatgagtgatggaaggaaaacattttttctttttgataattttaactatttgttaaaaaaggattcaaagatccccaagtgtgaacagtctgaaaagggctttttgcttgctgcagggacctgagaattgagaaacagctgtgaaactttgaaccctggctggaaggtcctggtattgactgtggcaagaaaacgggggagctaatctgtaatctgcttagatggaaggaaggaaagaaagagaaaagagaaaaaaaatcaaagaaaagcaaagaaaaagaagagaaaatataaaagagggaactagctttgggtccccatggaaacatatactggcaggagacactgtgcccctggtttgagcttaccctctagttcctggtccgctggagcctggggcattggaatctgccactattagtgtgagggtgacagggagggaggaaagggtgagagtggaagttttggattccactgcttaatctatagattcaatgtaatcccaataaaatcccagcagacattttttagtagaaattgacaaactgatgataaatttcatatggaaatgcaaaggacttagaatagcaaaaacaactgaaaaaaaaaagaacaaaggtaactgatttagcatatatcataaagctgcaataatcaagacagtatggtatcagcatcaagaagacaaataaatcaaaggaacagaatggagaatccagaaataaacccacacatttacgggtaactactttttgataaaagtgcaaagataattcagtggagaaaggattatctttttaacaaatggtgtggaaacaaattagagatccctatggaaagtatgtgcttccatttatcttttatatcttattaaaaagttaactcaaagtgtatcatagacttaaatgtaaaatctaaaactgtaataattctgtaacaaaactagagaactcctttatgactttgggttaggcaaaaatttcttagataagttatcccaaaacataatctaaacacacacaaattaatgaattagactttctcaacactaaaaatgacaactttttgaaagatatgccaccacctgagaggaaataattgtgaaacatatatctgatcctgtatctagatatataaagaactctcaaaactctgtaataataaataaaccaaaattttaaaagtgggcaaaaggtttgaacaggtacttaagcaaagaatatatatgggtaacaaacacataaaaagatgctcagcatacataagcataaacatgggaacaacagacactataaactactagaggtgggagggagagaagggagtgtgggtggaaaaactacctattgggtactatgctcactacctggatgacaggatgcatacctcaaacctcagtaccacgtggtatacccatgtaacaaacctgcgcct

SEQ ID NO: 70309 - DNA, 1759 bp, Homo sapiens
ctcagtgtgggtgccacatcaggcagaggttttggaaaactgagcatttcccaaggaatagcatccacattggaagttcaggtgctcactggttgctttactgtccctgcaagctgttggatgtccttactgataagatatctccccctcctccctgctctcctttcaatccagacaagaatgtttgtttaagaaagatctgttgccttgtgtggtggagtgtgcctgtattcccagctactcaggtggctgaggtgggaggatcacttgagccctggaggtcgaggctgtagtgagctgtgattgcgccattgcactccaggctgaatgacagagcgatacccagttttaaacaacaacaacaaaaaactacaaacacacaaacaagcaaagatttggatgggaattcacaacaaattctgcacaactctattaggaaattattttgtcataaaataaggctctgtgatgggttcttaaagagattatattattcaaaagaaaggggtcaccatttttctggggcttctgaggagttgtttcctctgtaatagattgaccatgagatatgagatcatcttagaaatatgtttttctgctttcaacagcacttgagggcatgttaacatgtgtgagactacagtcagctaaacaggccatcaggataatgaagaagaggaaggattacagagagccgaaaagctggaaagccagcttcaatagaaataatgacaggagctaacatttattgattacttactaggtaacaggcattgttctaagggcctacgtgttttaactcaatccttaggacaaccttttgagggaggagatacggttattaacctcatttaggaaacctttgtaggggagtgaatagaaaatgggacactatggaagtcaaaagtaaggaagtagaaaacaagcttgagaaaaaattttcccaacaaaaggctgaaaatgtagaatatgagaactatggggaaaattatagcagcttttaatggtgttatctttgaatggtaagattaggcatgacatttgttttcttctttatgtttttcaatgttttaaaataagaactttttgaaaaatgcttttttttaaacaaagagcatagttgacagagagcatctaaggttttcaataaataatcttaaataattcaatgaaaattaaattgcattacaggcagtattcagggagtagacaagagtgaagcagccccgacagggagttaacctcctaattgggaaaatagagcagagagattcatgctgctgaagaagcactgtgactatgcaccttcactcctccaactcaaaaagaagaagaagaaaaaaagcccgaggaaaatgaacaccactggctagttaggagtattttgagaattcactttaaagtgctgagaaagcactgttatacatgataattaaaagttagttaataatttatgcttttaattttaataaattatttatttgttttaaatatattatgcctcgttgcctggatcctgttatcttccatttatccacacttggggtaaacctagctgaggaccctcgccgtcatgacccaagataccatctggtggcaggtgtaggaattgcgagttaaaccctggggggagagaaacctggggcaatagtctagccttagaaattcaagtccatgaggagatactaaaggtaatgaacatatgaaaggactgactctgtaatgcacgtttatttattctatctcatatttctatgga

SEQ ID NO: 70310 - DNA, 1150 bp, Homo sapiens
gatgtatctattactttacctgtcgtgaggtgagcggttatatatgtacaaagaaattgagattataatccctatcatctccagctctgggcttaagaaaacagctaaccgagcagttgcttgaaaaaaatgacaggaagaaatttttagtaattaggcttctaactaactttgttgctgtccatatttcttctccttcaaacctctgagaatctaagagctgccaccctaagtacttgtcctacttgcccttatgcagcttgggctaaagagaatgtttttggtaaaataaataaactagaaatgatagggggttaaaatgaaataaactcaccctagcactttttcacagttagaagcaaggtaatttaaatttatttttatctgctgttctcagaaggtttggtgaaacctgaggcttaactgcttcattttaatatttattattgagggagtatgggaaatagtggaacagatttttatgaatcagagagagaaaacaatactttaaaagtacaattccagattggaaacttttttctatctgacaataaaaagccgtgttaagtggctatttttgatctttcttgtacagacctcattgcttgagttatgttgccgcagagagatgggtgcttctcaatctgtgctgcatggggatgtatctgcattttgccttaaaatttacctcctgtgcatgtctttattgataataacttatatttccctatggcaataattttctgatgtcttagggaatgtttatagtaagattctaggtagattttgatttttttcaatattattattattattattattattatttgagacagagtctcgctctgttacccaggctggagtgcagtggggcgatcttggctcactgcaagctctgcctcccgggttcatgccattctcctgcctcagcctccccagtagctgggactacaggcgcctgccaccacacctggctaatttttttttttttttttgtatttttagtagagacggggtttcatcatgttatccaggatggtctccatctcctgacctcgtgatccacccgccttggccctcccaaagtgctgggattacaggcgtgagccaccgcgccaggccgattttttttaatattatttttattgga

SEQ ID NO: 70311 - DNA, 1831 bp, Homo sapiens
aggcggcaagaaagaggtttctttatttttcttgaaaagtgagttctcagcctaggaaaaactgtctggatctgagctgtccaacccatacccattgctactagccacatattgctattaagaaattgaaatgtgactagtttgaactgacatgtgctgtacatataaaatgcacattgaatttcaaagactagtaagaaaaaataatgtaaattatttaaataatcatttttatattggttacctgttaaaatgataatattttggaaatgttaaataaaatattaaaactaatctgcttcttgttatctttttaatgtagctcctgaaatatttaagattatacgtgttgcttccatttgaacctttcattatattttgatgtgacagttctgattgagatctgtgcttttcaaccagaggcaactccccaacatcttgcacccccaaggtatatttggtaatgtctagagacatttttggttgtcgcaactgagcatgtgactgcatttagtgggtaggagtcagagatgctgttaaatgtcctatagtgcaaaggaaagtccctttccccatcaacaaagaattatctggcccaaaatgtcagtagtgctgaggttgagaattcctggtatagatattcagaaagaagtaggggaaaaaattaggaacaaaaactccttttaggttaatttgatttgaaatattagaatgaataagtatttaacaacattaaagagggtctattattgtaggtaagagtaaggaaattagagacagttggggaagaagcataaaggcaatagattttcctaggcattttaacaaatatttgttgagtgactacacatcctttctggaacaagatgaggggagaataaatgtatatatacaaacatatacaaatattgaattctgttcatgtgcgaagcttctacagggaaaagaaaaataaataactatgatttcctgtcttcaaaaagcctgcaggctagtagaagatggcatgagaaatatactatcttctaagacaacgaaaagcctatagatttcaaaggaaaatataccatgtctggtggggaaaattaggaaaggctttatggagagcatcctgtctgaagtgtatccctaaccatggacaggacagcagtccgtggagatgttggaagggcatacaaaacaaagggaacagcatggcccaaggcacggaggagggaagatacagggtatgtttggagtctttaataatcaagttgatgaaagggtagaatctcaatgggaagcagttggaaatggactaaaaaatgaaaaccccaaacaaaagaagacaaacaaaaacaaataagattaagattatttataatagatggggagattaaaagaaagaagagatgagagaggcaaagtgcgtaggaatagacatttgatttgatgtaggcaaataaaaaagaggaaggaataaaagataatcctgaggttttcaacatgggtgtctgaagacattaataaggatagagagagcggtcaggtaaatggaaagatgatgggttcaggattgccttgtggagtgtgcggtaaattatccatgtaataaagaggtggagaaagcccctgagatttggatctggaggtcaagagagtgataaggattacagatattggagtcacctcaaaaagagcaatttctgacattttgagaatgggtaatagcggaagatggtgtctagtgaggaaggccaggatatgcccttaggtgtgactgtcttcgggtgatgaaaaagaggaagagaagtcagtgaaagtgtgaggatgtggcagaagatacaggaac

SEQ ID NO: 70312 - DNA, 1033 bp, Homo sapiens
cacctggctcaaggccccgtcctgcaagcaccattcatggcaagtgccttacataggtgttccattttttttatcttttatattctatttatattgtaccttttctatgtttagatacacaaatacttagcattatgttatggttgcttacagtattctatactgtaacaggctgtatgggtttgtagcctaggtgtgtagcaggccataccatctaggtttatgtaaatgcactctatgatgtttgcacaacaatgcatttcgtagaacttatccctgtcgttaagccatgcaaactatgattaggaaatagaagtcattccttcgtcccctggtgagtttcagtacaggaagcaggctatgactctaacccagttctaggtaaagggaatttttcctttaagattgacatgtgccctccagcaggttccttttgcccaggtggtttgaagctaataattaagttctttgttggttcttgaaacattgactgaaaagtttgacttgcctgaaaacatataggaaaagttttgaattaagagtgttgtcccttattggaatgtgttactgagaggggtcttacaatcatttctttacagcctttaaataacaatttaagtttttcatcagccttgatagattaggcttagaactcctgaggggtaagcacagattaaaataaatctccaagttgctttctatcttttcctggctgtattatgtgctactcttttcagattcaacaaacatttaggatggcaggaacactgtgcctgatatttttacatatattaattcagttaaagtaattctcacaacaatgtacaaagcaggtatcattgcttgtgttatagatatgagacaaccaatggttcaggaggtgaagttactctttgaaagttgcacagctaggatggggtgggtgagagaacttggtaccaggacttggagaacttggattctgtcttaaaattccattgatgagctctgaatctcaggccagttttcagtcttgttttagactccagtttcg

SEQ ID NO: 70313 - DNA, 1019 bp, Homo sapiens
tgaaatgcaaactcggctactaagtttttttgtcgatgagttcaagctaattttaagactctggatatatcacctacccaacccaagcctctggttgcaatggtgaaacaatggtgatgaacctgatgtcatcccactgtaaatattaaacaattttgatgtaaattttagatgaagagaagtcatatttacatcaaccttccagtgcatgttgcaactgatttatttattcagcgatacttttttagaatgtattctgtgggggaactgggtgctgctctagtgctgagggtgtagcatttttcctcactttttagtgcttactctttgggaaggaggtacagcactaagaagttaaaaatgcacgtaaatagatagtttgtcaggatgagataaatgatgtgtagaatataaagactaggttagggaataataatggaggagaggctattttagatatggtagttagagaagttagtttccaatttccaagtggaatctaatttattctctctctcttttgtttttatgtatttttgatgtcttcttggcagcctcatatcattgctaacctctccactccatggaatcacattttcctgcaaacgcatcatgagcacttatttaaatacctaatcattggcagaaatgcagctgtgttcatcattgtcaattctgatttgtatgatgttcccatccaaacatacctcagggtacatttgcacatctaattacaacattaaaactaataatagcctgataaaatactactcagacaaatgtctaagtaaacagctggctgtttcattgtgtcctgaaggacaggcagattcagactttgttccctaacttaagggactgaattccaaactgcgaaccctcccccatgcacaccctgctgaggggggctgaggcagggggtgtctaattcaaagggatatcctcagataaaagagcttctgcgaagcccgagctttatggaactgcatggaggaaacacgtttttttttctactttat

SEQ ID NO: 70314 - DNA, 1014 bp, Homo sapiens
gaagattacattatgttagtatagccttagtatttaagtattattattattattattattattattattttcaggcagagtctcactctgttgcccaggctggagtacagtggcccaatctcggctcactgcaaggtccgtctcccaggttcacgccattctcctgcctcagcctcctgagtagctgggaccacaggtgcccgccaccacgccctgctaattttttgtatttttagtagagaaggtgtttcaccgtgttagccaggatggtcttgatctgacctcgtgatccacccaccttggccttccaaagtgctgggattgcaggcgtgagccactgcgcctggcctgagtattatatttttattcagagatcattggtgcagtatttaagtatgcatgtgtattccccaaaccatacttacacacttgtcggagactcacacgggtttttcatgcttcaagaaatagatgtaatgtttctcggtatgtttatatctttgaattcatatttttataattttgaagaagtataggggcaggaggaggttgagaggcaacttggagatgttgtggagaagtcaagtcttcaggacttgatgggataagtagaaggagtcgtagaagccatggatgggtaggtttagtaatttgaagctgccagaggagtggaggattttaggggccagcagtgtattaaagagatttaattgtgaagccacaacaaggagggctatgaaggtacaaaagtgttgacatccttattctggctgggtgcggtggctcacgcctgtaatcccagcactttgggaggcagaggcaggcagatcacttgaggtcaggagttcgaagccagcctggccaacatgatgaaaccctgtctctaataaaaatacaagaaaaaaaagccaggcatagtggtgggcacctgtaatcccagctacttgggaggctgaggtaggagaatctcttgaacttgggaggcagaggttgcagtgagccgagatctcattg

SEQ ID NO: 70315 - DNA, 1054 bp, Homo sapiens
gacctctgtatttttcatttaaaaattgttttgggaataaatgctaagtgtgtgtgtgtgtgtgtgtgtgtgtgtgtgtgtttattatttgtgactatttcttattacatatagggatttgggaatgggtttggtcatattgctgtggtacgtatttaggccttgcctagtactttagggcatgtgtatagtattgatctgcagtgagtacagagtcatgctgcgctaagttattgattgatcatatttttaaaagtcaattgtagatcatctaagataaaatgtatatttgtggcaattgaactaattatgaggggaaaaattcccttttgatttgtatagagtctgcctttgctcagatggaatgggcagatgcctgagtgataaaatttctggaatttcttcctcaaacctttcctttcacaatcatgttttgaggttaaatttgaaatgctttagttaagaaagcgcatgttaagcttatacaaatgtaaacatcattagtttttaaaaggggctctgagaggcactaactcaaaggcagttagtagacattaggaaaaaacaaacaaacaaacccaaacatttcaatggtgtactaagttttaaaactcctgtggaagttctcagatgattttatatcaatgtacattgtgaaactctgaggagggggtatactgctttagtagtcaagtgtttttattgcaagccacaaacaccaattggaattcagtttaaaagagagaatttattataagaattcagagataccttgtggaatgtggcagtgggaatggagctggctcacaggaatggatgggctagaaaaccatcaggatcctgtccacgtccttattggggcttctgccagtgtttctgctcaatttcttccctttctccattgtctgccttctatggactctccttggaagtcccccgcttttagtaacagcataggaagctttaaaagtcattggttagtccttcacaagctgattcagtattggatagtcagacaacagttatagacatcagatagccagtgtagatcata

SEQ ID NO: 70316 - DNA, 1044 bp, Homo sapiens
ttgaggaaattatgtcttcctttctgtctcctttgtagttgaaattagaggaaaccaagttcattggatttaatagtgtagtaatgatgatgattataaataataataaaagtaactgtagtacagttctccagagaatcagaaccatctctctctcttctctctctctccatatatatgtgtatatacacacgcacataaatatatgtctatacatgtgtgtctatacacacacacatacacacgtgtatatataaatatatgtgtatatatatttgtgtgtgtatatatggatatatacacatgtatatatgcatatatgtgcatacatgtatatataatacacatatgtatgtgtatatatacacacgtatatttgtatatgtgtacatatagagagagagagagaaagagagagattgattttaaggaagtagtttacaggatggattatggagatgagtccaaaaatccaatagggcaggcctgcagggtggacactcaggaaagagctgaagtctgagtccaaaggcagtctgctggtggaattcccccttgcttttgggggaggtcagttttttgttccattaagacctttaactgattgggtgaggcccacccacatcagggagggtaatctactttactcagtccaccaatttaaatacaaatctcagcccctgccaaaaaacaccttcataaaaacatccaggaaaactgtttgactgagtatctgggcactgtggtccagccaaattgactcagagctaaccatgacagtaaccaacctttattgagcacattctgactgccaggccctgtgcgacattctttccaaacataatttcattcaatttttttattatctctgtcagttgggtgtctccattccccagctgaggaaaccttaggaatgaagtggatttgttacccactcaaggtcacacaggaaggaagtgtggggctgggattcgtgtttcttacctccctgtctaaacacgtaaacgacaaattaggtgacccatgaagggacacctgagtgga

SEQ ID NO: 70317 - DNA, 1070 bp, Homo sapiens
gggtggaatgggccctagatatttcagttcagcagctgagaaatgcctttggatttcctccaaatagcttctttatctattcactgtttgaaattccacattagagattctcctttttaaaaaaaaaaataaacttcaagtttcaaatcttctgtacaaatgcaaatatctcagcataactaagtaataaatatattgagtaacatgttagtaatgtgcagtagcttatagtaatgtgttagtgagtttataaacttttttgtggattatggggtttttctctggccttaaatagtactgataagggagagagcaacatgattcttggttattgggagaaggggtgggagaataagatgatgatgatgccccaactgtgagaatggggggcgtagaagaaaagctgggtgatggaagccaaacgccacttaattatctcttttgctctgggctaagccttctttcttgatctttgagaaaatggggaaaaaatctttgactttatgcctgaagacttttggttgtatctttaggaggagctgattgatatattttgcttttggttaagagctgtagatcacttttgcggtctcagaagaaaaatgatatttgagggctgaacggttatagttttaatgaaactgggaagactttcagatccttcccaagtcctaataacagactttaggactttttctagagtttagcgattcctcctatcagcaggctccagaagagaattctgtgtaataaagatgaatacttaattcgtggctttcaggaggatgaaaaccaaaggaagagtaggtgctacatcaatttcaatgatggccatagaactgcaagggctccccagaggacctcactctcgcctgcagtccctcgcacctgcagagccagccttggcctttgtcagtgaacagcacacacctgccagcccttatctactcacactctccaggccatttagagccagggctgcaggcagatggcaccaccctgggatcctttgtcattccaaattgtgctatcatgtggacaagtccatttgtcccatgtgaagctcttct

SEQ ID NO: 70318 - DNA, 1033 bp, Homo sapiens
caaattgggaaggtttgttctgtgtgtttcaggtgaaatttccccttctaaggaatccgccttctcaggcccagccagtgcagatgcagtctctttaactgttgcgggtctgatcactctcatggcatgtggttgaagtgttgacagccccggccctgtcaccagcatttgacttgtgttggagatcgtggacaaaacacttaagtcagtttgaggtttactgtgtgctggcccagcttccagggtggtctggactgccccactgccactccaagcatctttttattcagtctttttcttaaggtagctacaactgtaagttgaaacttcagagtaattccttagtgtgcttagaatcccattaagtctcacactggcttactcaggtatttactcccagtgtatcatttgccttcctcaggccaagacagtgtgcaagtgactttgtttcccatccatgaactaaatggaaagacatgtccttcattatggcccttacaggaaagttgcctcctgtaacagacatgctattgggttggaggagcaacatagcacagatgttcttgagtaataaatacaggatttccagctaatttatttgagctctgagtaacagggtgatcaggattctcctgctttcttaaaactcagcaaaagttcatgtagaatttctctctgtctctgtgtctccctcccttcctgtccttatccctatttctttacctgacactgaatcaacaggattttgctgactaattacttcattgaaaaaatcagagaataaagttacccactcttcccagtgggtaacttgggaatcttgattatctttttctaaacatgattttgaatcccatctccaatgtgctgtgttacattttctgcagcttagctcaagtagtgttgagcgcatacactctggagatgacctacttccattcaaatcttggctctgccatttattagctatgtgaacttaggtgcatcttttacagcctctgtgactcagtttgctaatgtgtaaaatggagat

SEQ ID NO: 70319 - DNA, 2738 bp, Homo sapiens
tctcctgtctcagccttttgagtacctgggattacaggtgcgcaccaccatggctgactaatttttgtatttttagtagaaacggggttttgccattttggccaggctagtcttgaactgctggcctgagatgatctgcccacttcggcctcccaaaatgctgggattacaggtgtgagccactgcacctggcccccagctgtagtgtttttatttttattttttcgcacatgacaaactatatattttactcatttatttgtgtattttatatgcctgctgtttattgttaatggaagccacttgaaagcaggaatttttatctgtttcgttactgttgtatccccaacacacagaagagtgcttggctcatagtaggtgcttagtaaatatctgttaaataaatgaaatctctcaggttgtgttactaagagcataagagaaatgatttgcagatgatgatataattgcattcacttttaagatttccattgcttttagggtttacatttgagctttaagcatcttgatttcaggggaagaagaatcaggaacaatttatattccatatcttgcctggtcttcccattgtggatgaagaagaattggggacctaaataaactttacctcctctcctgccacaaataggtagatggccggtaagcagtgaatttctctttcaccactggaaatctatagagtggtccttgaaaactgccttttaatgtctaaattttcaaattatttctgctaaaatatacctctgttgaggatccacatgatttttaaaaatgttttaattgtttaatttttatttatatttatttttttttttttgagatggagtctctgtctgtctcccaggctggagtgcagtggtgcgatctcggctcattgcaacctccacttcccaggttcaagtgattctcctgcctcggcctcccaagtagctgggattacaggtacacaccaccacgcctggctaattttttgtattttttttgttagtagagatgaggttttgccatgttggtcttgaactactgaccttaggtgatatacccgcctcagcctcccaaagtgctgggattacaggcatgagccaccacgcccggcccaaggatacacatgatgttttaaagcagaaaaacagtagaggaatgttttgtagtgaaaatctttgtctcgatatttattctgacatatgatttttgtgttagcaatcgtgtcataatcttatttgtgtccacattgcctgccatgggtcaagacatggtgtagatgtttaatatttgttaagtgaatgagtaaatgggataaaatgagtttacattttaaacaatagggcaggaaagagatattctatacttctatattcccaaggtatctgcttggtttctctccttatcccccagctttggaatatcagaataacaattttatgactttactacatttttttaaatgcctggcacagcattcctcaggcattcattaaatacttgttgactgagtgatctaccccttcctcctgcagactatttaacctaagggagactcctgaatgaatcaaaggcccctcatggattcctcatcatggaactagtcagttagatctgggatatatgcagtggatgaagaatgaatattcactgatataattttttccttctgttatgggaaaacaatctaggaagcttgattttaggatagagatttgggctttaagaatctgaattggattctaagtctaattcctacactaagtggtcctatagatttgaacatactatttgacttctcaagttcttcctttgtaaaataaccatagtaatacctactcttcagggttgttgtaaagatttccttcctccctccctccctccgtccctccctccctccctcccttcatttttgagagagagtctgctctgttacccacgctggagtgcagtggcgtgatcttggctcactgcaagctctgcctcacgggtttacgccattctcctgcctcagcatcctgagtagctgggactacaggcacccgccaccacacccggctaatttttttgtatttttagtagaaacggggtttcactgtattagccaggatggtctccatctcctgaccttgtgatccacctgcctcggcctcccaaaatgctgggattacaggcatgagtcactgcgcccggcctgttgtaaagattttaagactacctgtaaaaatacctgtcaagagtgggccaccagtaatgatagctatatatagaatagtaaaatttagacaataatgtagtaattacaagatcctatacaaaacaatgtccaggttttcttgttattacacatgatgcagttacctgagggtcattttagaaggtgagttccaggatgtttggagatccctgtgtctcatgaagatggttgagggagggggacatttgccagtttctcatgctaaaataaatatttggtaacacaataacttcttgttaaaaatatttgaaaaaatgattatgaatataacccagaaatttatctaggctaatctgtgtcagacttaaggcctccaaacgtgtcatagaataatacatacctggataaaggattgattttaaagaatatgcctccatttgctttgttactgatatgtggttcagcctgacctcaggctctttaagtcacaattttccagttctcttcctgtcagtgacttcatttgatgaatagcttt

SEQ ID NO: 70320 - DNA, 1212 bp, Homo sapiens
caggtaaatgtcggaaacatgaagagtgtagatctctggttcaagtactgattagaatcagaattgtatattgagacccagtatcttgatacagagcctggtgttttttctatcacatattgccttttttattgcctcactccaccggtcaatgtaggggaaaaagtaaacataatgtggtagaataatataaaaataaggaaccaccaaagtgatggactaccagactgtgccatgatgatagcttattgtacaatagctttcttcttttatttatatacaatttatattacctattcttaaaggaaaaataattattctgtacatttatctcctaaaactaatttagaattttacatgagtttttaagctgaaagagagggaatggttgtactgtatttattttttagatttatcttccctggtaatgcaattgggtagggttttaagtttattattttctgaaaacaactaagtactctgtgaataaagttttaatatacttcttgtactatactcaaaatcagaaagctggagtttaagtcttctgtctcttagccattttccctggctatttggcctaggtatagaccgaccatcttgactgtggctttctcatctgtaaagtaaggatgattcttggcatactgacctttggggtttatacttagaggtgaaagctattaatgtaacgttactatatcacaaaggccagaaattgtgaaagacagagggtcttcaggtacatttgcctattagcaggccatctctggatggaggcattatttggataacttgtgtttcataaattggaaatttttattaaaaaatttcaatccgtagtcttccaaaatgaagttcaaacatgaggttcccctttggactcccatttgtaacaaaataactcaagtaatgcaacaaagttacaatgcatacaatgttgcagttatccaaggcagcctcatttctggctgcagctggaaaagtccagctcaaatactgagtgggctctgccactccctggtgttacttatctgcttctttcagtccaggcttctgacaacccaatatccaaaagatcattattctcaattaaaatgatgtttggaaccttttgaagggagaaaaaattcttgcagctctccactgccaacacatttttttttttttttttttttgagacggagtttcgttcttgttgcccaggctgga

SEQ ID NO: 70321 - DNA, 1319 bp, Homo sapiens
ttcatttcttctgaaattgaaaagattcttaaatataaatataaaaaatctacttattcaaattttcttattcaagaagcctactcatttaggtatgtcagtggccaaagggtgctatcagctttatgggaaaattagtgttcttcaagtatatctgcatattaaaagcacctgatttaatttcttaccacttttcatttcaacagcgactaaactttaagcaccaagtgaggtgatgaatacaatgtaaagaagatatggtctgtgtactagatagattccttaagtgccagcacagtagttgatgaggagatatttgaggtccagatggcattgggtttaaattcactccagcacttactaactctaggggctttttaactttttaaagcccttgttttctctactttaagatgaggacaagaaatatctatgtcatgtgaggattaaatgaaattaacaaatatggaggaatgtatgatagtaccttgcagatggtttggagttcagtaatggcaactaccattttaatggtatgtttatataggtctgttaacaccttaggatatcctgatgatgaaacaatcaatcaataatttttattctttaagaacctcataaaacatttttaaaaagtctaatgttttgtgaaaaactacactgaaacatagaacttgatgcagccaaggtctttgatgtattctagcccagctctcatgaaaacaaagaatctagtgtagagagagaaatgtgcccaagaccacattttatacacttagcaaatgtttattgagtaccaactgccaaagtgccatgatgggatgagaaaataatggtttccattttaaaggagattattaagtatagttgtagagtcatgggctatgacagataactctaggacagcttctctactcttgtacagattaatgcggagggagcagagaagaggggttgattgtgctgggggtgggtgggaagaaagaagtttctgaagacagctgtcagaggaggtggcatagaggaagtgttaaaagacttgaaggaaggggaggagattagagagttgggaggggatagaaggaaaggaatttcaggcaaggagcatggtatgttccaaagcattgtgaaatgagacattctgggaaccatgactggtttcttaaaggggatggagtgtagagtatgaacatacttatgagcatagaatataaatattcatttcccctatgggatgaggaatggagctggatgggagcattagactagaaagggccagattggaaagggcttcgtatgccaggttaaagagtttgatt

SEQ ID NO: 70322 - DNA, 1044 bp, Homo sapiens
cataatgcttggaaagattatctgtttctgcaaacatactttttggcatttttattattgaggaaaagagaaaaatattaatttgtattttctcatttcctttgcttttatatttagatttaacaaatatatataatctaattatataggtgtgttaagtgcatttcacattagcatatacattcaccaggggaaaacacatgcattttttatagcacttcacccccttgcctttttttcctcttacaagttttggaggtctacaaatgaaactgagaacttctctttagatttctgttttagcaattattatttcttgacagggtctcactttgtcacccagtctggagtgcagtggtgcaatcactgcacaccgtagcctctacctcctgggctcaagagatccttctgcctcagcctcctgagtagctggtactgcagacatgttaccaccatggctggctagttttttttgaattttattttttgtggatatttggacccctttagatataaataaagagcttttataaaatatctatgagaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggattgttgtggggtggggggaggggggagggatagcattgggagatatacctaatgctagatgacgagttagtgggtgcagcgcaccagcatgtcacatgtatacatatgtaactaacctgcacattgtgcacatgtaccctaaaacttaaagtataataataataaaaaaatatctatgagaaagcacagggagcttaaggagtagacctttactacaaacttggcctgtttcatttcccaaatcacccatatcgaggagatctggtgaccccacccacaacctccttaacaaaaagtccaatgtggaattt

SEQ ID NO: 70323 - DNA, 2571 bp, Homo sapiens
ggggggcgggatgagagggcagcgggagaggggtggtgctgcagcagggaacttttcgcttggggaaagattttttctggcgaggatgtaggggaaactccagcttctgcagggcccgctcgcacgtggagctccgagcggccgtctgtggggtgggtgctggggggtgatggtgggcatggaggggggttcctgcagtgctttaagtgacttttcaaactttcctccacctcccgcggccaccctcgcgttgtccccgcctctggctgggctgcgacggcattgccaacccaaagttgctggagattcataaagaaggaagaggagaaggaagagcgtaggggaggcaagggggcgctgccgcaggtctctagaaggggagaggaggggaaagattgtcccctcgatcagggtctggggctgggagtgactgcttggagatgagttatgccccagcgcagtccccgctgtcagtttaataccgcaggactgcgggcttttcttaattactgtctattttctttgcaaaaggcggctctctgcctggtgccttgcagcccttttgtgcttcagcttgacaagtgtgctggacactttgcttttaagtaacttgcggagaggaaagttgaaggccttttgcaccttcaaggcttagttctgttgaggtcatttcatggtgtttggatggtgcagaggttggccagggagttcagcttggtaacctggatatgatgtactgagtgcaccagaatttcctatacaggccccatggggctagagggatgtgcacggtggctctgctagcatccagaggaacgctggctggcaaggtccaccagggtttatccctttgcttcttctatcctgtcctgtcctgtcttcgaggaaggtgctttggaaccggataggtttcaggatgcaggggctccatgggctgtgggaaacagccggtgctgaggttaagcggcgcagcgtgggtaggtgggcgaggaaagccagaggaggccggccagtctggtgtgtggagaaggcagtgttgtcaagggggcttaatgcagcagtttggtgagctggtatggacggtggcttggttattgggcatgttaaaagtttcaagcttttgaataacacttactactgaagaaccaatgtacaatttccagtttttctctaggtggcacaacctgtctttggtttgtatcctgtttaatgactcagggaattcatccctttttaagcacctccttattagatatgtgcattcattttccagcacactttctggcaggtgaccttacgtctacccattcaaaaggcacccctgctttaggaatgcttctgcttctccctttagtaaatcatatctttaaagttgcaaatagcagtaccaataatttataaccaggtaaaagcactacatgaaagcattctgtcaagcatggagtgactgtcctatcaactaaatgtcacaatgtacttggcattaaatgtatcagtttgcttaaaaaaaaaatcaccatgcttccgacaagttttatcagaatgctgaagtgggtagatttttggattgtcacgaaatgtacttgtatgtcttttggaaatatatggtaacattgaaagatgattgtctaatctgcttggtggagataagactgaaattcctccagagcataaaaatctgagtaagaaattgagtgttctgccttatctcccccaataggagaaaacaaaaaatgtttgttactttttgccttttttcactttaaaggtttcttctttctcactttaattaagagatgcttttctaaataattagtatatatttttgtttggttgtagcatttctttttgaagtcctgcttcttttggaatggacaaatatatggttttgtttctttcacaatttcctgtctaactggtgtttgtgtttcagtttgtgtgtgtgtgtatatatatatatatatatatataaatatatatttaaactgagctgcctatgtgacttgtaatgcatatatcagaggacattgcttgagcttggcttatccttttggatgaatttcagtgtaaagagatgagagatgttttctatttgtatttcaggtcaaattgtgttaagcttttcccttgacccttgaaattctaagtgattcaaataacgttgaattggattcttttaaatataaacaaaaagattaaactgtcaggttggtcaggaaaataatgaacatggaacaaatacattttaaattttgtcttggattaacattaaccaaaaggtcaatttcgaatatcttactattaaattctaaggttggttgtgctcatctaaaccactgcgctttccacattccccacaaccccaatctacatgtaaacattctaaaacccattatggagattactctagcataacatttttttcatgtagattttatttagtaaaatctcttcttgagatgtaacgcaaattaatacaagatgctagcttctttgaggaccgcatatttgaaggagtatgtatcttagccttattcctaaaaaagaagaaaaacatgccaatctcaattc

SEQ ID NO: 70324 - DNA, 1034 bp, Homo sapiens
ggtcttatcgggtgaggacgtttgcctctgctgctgtccctggcctgggtggctgtctgtcattacagaactgcccagctgccaaagcaaatggctatctctcctaagcactggagaggctcaggtccagaagcttcaaggatagaggaactgaagggctaaatgaagggcagagtcaaaccatcccagggggttagcagtagaaatcctgtctgagctgttcaaatcttctttccagactctttgagaagtaaaatccagaaaatcaatatgaacgtcacacctgtcacctttaaatggcccacccttcatcctaaaatgaacaagactccttgggtactttagtctgctcctaaccttgtttcaaggtctagtcctgccaattttatatagagaaaggcatttgccattgatttcccaaagggacaaggacaatcaggccataaccaagacatttgatgtatgtatacaagcaaagacctaggttttgacaacaaagaaatgaccacaacattttacagcagcttatataacatttatatgtccgtagtgggtctaacaagtatcgttctggaaaagccacgcaataaatgccttgtgtggactgaatcatactcatacagttatagtgcaatcagcagtacacttgtcctgccaaggtgagtgatggattatagtgcagaggaagttccagcttacacctgttaatagtattttaagccacataggcaaaattcctacaatgtggtagactctgggctaaaagctaaggatacaaaaagaaaattatgctcatgcctgtaatcccaacactttgggaggccgaggtgggagaatcactggagcccgagagtttgagatcagcctgagcaacatggcgagatcctatctctatcaaaagtaaaagaaaaagaaaaaaaattaattagccaggcatggtgatgcacatctgtgatcccagctactcgagaggctgaggtgggaggatcacttgggcccagtgagctgtgattgtgctactgcattccagcctg

SEQ ID NO: 70325 - DNA, 1125 bp, Homo sapiens
cgggaggctgggcagggagaatcgcctgaacccgggaggcagaggttgcggtgagccaagatcatgccattgcactgccgactgggcggcaagagcggaactccatctcaaaaaaaaaaaaaaaaaaaagaaagaaagaaacattagttatctcggcattttgtcttcccaacacaaaatatcaggtaaagggtttcatctggaaaactaaaattttccccacctcttacctcataggtgatgccttgtagacacagctttggacagtagatggaatgaaacgtcagactggaaggatcatgctagtttccctgaattctggtcaatgtcccaagattgaaatgagttgttcctagagctgtgggagtggatatctgaaattacttctttaaaagctgcaggaggctttgggactatgaaatggtaaaatgaaatggtaaaatgtcaacttgcaggaaattaaacgtttcaaatcctgagcttgaccttggaaaatgttgattcctgagcaactacaggaaggaaaatcacagccacagtggactcgggcaaagaaggtcatctaaacacaaagcctaagagctctcccaaacagtagaatgctggaataaggaaaaaacaggacaaataggtcttaactccagtgctactggatcctagtcactcaaattctctaaaagccattgagcccatataatatagtgatttagcatctgggctctggacagtctcggtttctagtgctggttctatcatttaccactgtgtgacctcaaactctctacgcctcatctgtaaaatggggctagcaatagaacctaacactcaggattgttgtgaagaatcagtgagtgaatatgtgtacacttggcacatagtaaatgctcaataatagagctcctgttactattcccatgagctgctgtgagaacacctgagataaaagatgtgaacatgctgtgaagaacacaaatggccacacaaattcaaggtgttgctagtttgtttagttttccagtagacctaccttggtagctcaccagagatctggatgaaatctcaaattgtattgggaaagagtatgccttctataatcctggtagtacctgcaacttgtgtttccaa

SEQ ID NO: 70326 - DNA, 1035 bp, Homo sapiens
tacctaaataagtataaatgggatattagaaatttggggaactatgttttcagtatcatgctcttgctatttcttaattgtctttaatccctggagttatgatgtgtgtccagactaaacatcttctaacttaaatactagctggttaatccttttgatctgcagtaacatttataatgcttttcaaatgtcaagggactttcatcaattctccctaattatctgatgattgccactctttatttttccatgatctccttgaagtttccttgacctccttggaaccttcattttaagtccaggtagccatttttccctttgttcctttgagttcagtccaggaatttaatgtgtataccttcagttagccatcataggtccaaactctttgccagatcatgaaaataaatgacaagagaggccatgaaggcataaaccatacacaatgcaaaatagacacaacttaggaaagcacattgaaatctcattgactgaaagcacttggcagcatttgcagcaaaggaaaatgatatattaacagcatactgtaatatataataaaaacaaaaatcactaaacaaatcattgttacatgggtgggtctagaaggatttcacctggtgtgactaaagtgtggggaacagtgggaggttggttgaggtcagagtattgagagttttgattgacatacaaagcagtttaactttattccgtgaacaatagagtgtttttgtagttattttagtaaatcagggttgtgtctcaaaaagaacccaaaggtagtgtgaggaacagagtgaaataataaatgtctagagacggaagactggtcagatgctgttataagagtccagatatcaaaagatctgatctaaggcaggagcagtgggaattgagataaaagagaaggcttgttaaatcttttgcaaactaaatcactggggctcagtctcctactgaatatgtcaaatgatatgagaaaacaattaaaggcatttggcttccagcttggatggcttgggggaattttgagag

SEQ ID NO: 70327 - DNA, 1051 bp, Homo sapiens
agcgacggttaagggacaggggacgagtggagcaagtgggccttaatctgaaaataacttgattgtttaatgacattaagagaaaaagattacgagctttgagaaggaggaagcctgggagtaacgacagttaaggagttagcttgcggaaccaacataagaatttataacagggaggtgtcgtttgggatcagacgcgtggcctgcattgccgtagccaccgtggtgtaatgttgccacgtaaaaaccacaaatcccagaattcagtcgggtgatacactggctcagaatgtgattggctgcgggaactagtagcttcctcattggctcccgtggaaggagtgaatgctgggatttgcagtctgatgggggagccgtgctgggtaaaaaccttagaatcgtcgcgcactccgtttctgccgcggattcttatattctccaatacaggctttttctgttatgcagtatttgcagagcaggctgctgcagtttggccaggcgcattgcggatcagttggtgttcttgccagaggcctagcagcagcttcctagcgctactacttgcacctcccaaggcagctgagcctccccacttctctggccagacacactcctaccgtgcatcgtagaaccacctctctgacgccagcaggaccttagtaagagtaatgggtatgcgacagatggctgtagtcaggccctactgatttcaaaatagctaaaagactatctctgtagttagcttttgtggccttgatggacctgcagctgtgtattgctccctcagacgtacaaattcgtggagatgagttatgaaagtatttagtatccaagtttttcatctgcttaatatttgggattttaaacacaagttttgccagctaggggtcaacatccctgaaagtgttagggatggagctagctgacaggcctttctaaaagaacagagagcctggtgaagagatgaaaaatcaatctcacttgatactcctgttaaaaacaacaacaaacctttaaatagctctctactaacacataactcaaatccgat

SEQ ID NO: 70328 - DNA, 1050 bp, Homo sapiens
attgttttttaactctcttctccacagcgtgcgtggggaggcctccgtgaactctgaccttagctttccgtagcgcccgcgtctgccgcccccgcccccggagcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtgaggccgagatccgaccctcaccccacctcggggttctcgcagccgcggccctggccgtcacgcaggccttgccccaccccttcggccgtagccggtagcttctctgccccgaagtctccagcccaccggtccgctggcctcccgatccctgcggagcccctttcctctcccctcttgcaaccccctccccccattctttctcctaggcagttgcccgccgcggtctctaggccccgtttgcttgtctcagcgcccccacatccttccctgccccaccaggaggcgattcttgcgtctcaggtagcgcgaaggggctaaaccacccaccattgtggagaagggagttgctctaggccgggagaccgggcgccgggcctattcgcttgccatcctgcggcgctaggccgccttgctcgctggggcccaagctgctgcccactcggggacccggcagcctcctctctgcccgcaggtgcgcgtgggccttgctgcattc

SEQ ID NO: 70329 - DNA, 1061 bp, Homo sapiens
ccattgctgtcagtttggctcatcctgtaaaggtggtaaatttcattctgattgtggtcaatttcagtctgaaggtagcactttataataatacaattttgttcaactagtcattctcctgtataagtttagaaaggctaaagaaattatgtggtgataccatacatgtgattattgactgaagcttgctttcttaaatttcctgtgaaagaaagataacatgtacatacctagttgtttttttcttaaataaattacatgaaagaaatagtgctctgatactaaatgacagtcactgctgaatttggtaaagattatgtatgaattttggttgtactgaatcaaaacaattcctggaggattagtgtaatattgatatattcctaatagttggtgaatgctaaacaaggtatatttaggagcagtacgtgatttccagtaatttggcatcattaagatatttttatcaactgtcttctaaaaaacatttttataatgcgctgtagccatctagttaataaacaagtctttggaactaaagcactttatatgtttagtttaaacagacatttaataattaattagtgagcgtttggagtcaagaattttgaaattttttctgcatatttttagtataggcatttattttaatttgctcttttttaaaaaaatgatgccttgttctcattagaagtttatttattttggcttaaataccaagatttgtggctacatattttaaaaatacctagcactagaaggatcttgagggcaaggttaacattatggaatgaccaacatgtgcaaagcactctgcctgtactaaggacgagagaagaaacaaatgctgccaaaatgaagagcaaattttattatcctcatggtagaatccaaagagaatttgacctagtcacaagatctgggttctaatcatgtgtgattctttgttatgaactgtaagatcttatgcaagctatttaatttgagattacattttcacttctgagaggcatggacatgactaattacaaaaggttgttataggcataaaatttcaggtc

SEQ ID NO: 70330 - DNA, 1036 bp, Homo sapiens
tgaacgtactagttattggaattatccttaaaattgccttacatgtaatgcatttctaaattattaagttgttttgccaacctttaccacacagtttatttcccatgttgcggactatctccatagctgtttatcaattcagctccaatagttgtttttttgtttaaacatggattttgacatttctctgtagtgtacaaaataacgtatttttactaaaactgtatctggttcaaataaaagaaaaaagtgttaactagttatcttagttggattgcttctgtaagtggaggggagccaagaattatgggacaagttcatttgacttttaaggaggtcttagggctttatttgaatgtgattatctcatattctgagaaatcacttttaaaacaatgaattgtttggtaaggcatgtggagaagaaaatctgagatgccgtttataccttattttacctgagactctatttatcttggccaccattcagtccttttcatttaaagctgagattagatgattgatcactctgggtttttgccaggcaacacactgttaaaccttcctttggcagtggttcttaaggggaggggaggtgggcgatgtcagggggaagagctactttttagaatcacctcttcactattttgaaaataagcctggtggctgggcacagtggcccctgcttgtaatcccaacactgtgggaggccgaggtaggtggattccctgaggtcaggagttcaagaccagcctgggcaacatggtgaaaccctaaaatacaataatactaaattattttttataaattatttcttataaattataattattataaataatactaaattattatttttgtatagtaaatactaaaaatacaaaaattagctgggcgtggtgacaggcgcctgtaatcccaactacttgagaggctgaggcaggaaaatagcttgaacctgggaggcggaggttgcggtgagccgagatcctgccactgcactccagcctgggcgacagagcaagactccctctac

SEQ ID NO: 70331 - DNA, 1026 bp, Homo sapiens
ttcttaatgtttggaaggtgttcttaatgtttttggttaagggcttcctagatagaattcaaatctcatgtaaagaaaaagtaaagaggaacttttctcacctaaaagcagtgatgcaattaattagaatgaaagagtactcactgtaggtcctggtagtcaatttgagatcaagactgacctggggaaaataattttggatagtggtacctcatataaaagcatatcagtacttaaaaagtctcaccgtctctctggatacaatgaattttaagtacattattgctcttttccttggtagcttttagattaaatttatgatcactttttttaaaaagtggatgagttttataataaaagatgtttctgttgagtgaatggtatagcagtggatttgaaaaatcattatctttttaaattaatgctttaaaattttcaaattaacaaattttatttttttgataggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatggtaagttgttttttactggttgagtctttcttcctgctcccccaaccctgtttttaaaaactctatgataagtagtaaattatcttagccttgtactatctctttctagtgtgtgtgtgtagaatttttaggtgactaatgtttagtgtttgtatatggtatatatagtgtatttccttacagcatataagttactaaatggtattttcttttaattcttacgaagtgcatgtagggaactccaaaaacaatggttctctcatttgtttcactatagtctacatttttagttgagttaaaggcctactttcctctatgtatctctgtattccagtggggatgaaattttaaaatgaaatgactaaggaaaattaaaaactaataataataacattctttttttttaaggcagggtct

SEQ ID NO: 70332 - DNA, 1028 bp, Homo sapiens
cattttttgagttccttttaacttcactcccaatttttattattttatattcggtctctccatgtatctgccatgtttcagttatcactgtcttcattttggattaggctatatttaacctttcagttttttttatttttatcttttcttttaaatcaccaaattgacctgcctactacttctttggtcaagcagtcagcagtcatcagttgagcatctatttgagacactgatctgagcatttatcaaattaaattttcatgatgttacttatgcttgaaaaaatgcattggctgccagttttatcacatttcaagtcattgaccagacattaagagttctctgtaatatcataggtggttatttttcctatggtgttttccatctgccttttgtataaagcagttctttttactcctaatttgtttcaatatgcattctacttgttttagtctctgttctttacaagaacttgtttcctcatttgaaatgcttttcttttctcactatctcatgaaagctcagtaccagcctggcgtggtggcttatgcctgtaatcccagcactttggaaggccaaggcgggtggatcacttgaggtcaggagttcgagaccagcctagtcaacatggtgaaaccccgtctctactaaaaatacaaaaagtaatgggacatgttggtatatacttgtagtcccagctacttgggaggctgaggcatgagaatcacttgaacctcggaggctaaggttacagtgagccaacatcacaccactgcactccagcctggcgacaaagcaagacagtgtctcaaaaaaaaaaaacttaatacctaaaaatctgactgttaatgttcagtctcttaccctgtaaatgctgacattgcatttaaaagtttttttaaatttgtttttaatcatgccagagtagtgaatgccttcatttcataaatagttatggagttccttagttcatcaaccagatggttaagtttttgaagataggggccatactgtctttgttattcaat

SEQ ID NO: 70333 - DNA, 1068 bp, Homo sapiens
attaaaaagttttgtgccagccatggtgttgtgcccttgtagtcctagttactcaggaggctgaagtgggaggattgcttgagcccaggagttcaaggccagtgtgaacaacagtgagaccctgtctctcaaaaaaataaaaaataagttttctgtatatttgtcaactaattagctttaggggtatgacgtggggtatgatacggaaagcagcttcagtttcatgatactaggatggaaatcaatgagaaaaacttggaaaccaactgcaaaaatcttaaccaatcacaattttttatgtcatttgtatactatttatgatacagacatggtatatactttatcttgaaagttctaggcggaaaggttaacatttctacttatgtattttcctgtttttgtgcttatctagctttttttaaacaatttcttctttgtattacagtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggtaagcaagagcacatttttcttcctatttctttttgtgtggaggtatttctccccacccttttttccccttctggccaaggagggagggaggtggctgtccttacagatgttcataggaatccctttggacaattaagaaaattaaagcgtgaagccttattttccttagaaataaatgttaaatgaatattttgattgaacttgtatgtaatatgaatttcagtgaaggatttttatatgttggagcaagattttatactgtgtgtaccatgactgcagactagagttatgccaacctatgcagtgagggaagagataaccaaaatattgcatcctgattagttcactgtttccagtattaattttactttgcgtcagtatttgctatgtaaaatgtaacaccattcagacatagctgtggaatagttcagtttactagtagctttaattaaagctgagcctttta

SEQ ID NO: 70334 - DNA, 1050 bp, Homo sapiens
gtctcatctgcaaaaggtgagattatcacctatttcatgggaagatttagattggtaataatgtagtctgggggccgggcgaggtggctcacgcctataatcccagcactttgggaggccaaggcaggtggatcacctgaggtcgggagttcaagaccagcctgaccaacatggagaaaccccatctctactaaaaatacaaaattagccgggcgtggtggtgcatgcctgtaatcccagctacttgggaggctgaggcaggagaatcactttaactcaggaggcggaggttgtggtgagccgagatggtgccattgcattccagcctagggaacaagagtgaaactccgtgtcaaaaaaaaataaaaaaacaaaaaaataaataatgtagtctgggtatgttatttccactcatgtacttgaatcattcactgtgctagttttcatgctaaaggctgcatacgtaaactagtctaaacatcaatcatatgggaggtcttactgttccttctagtttgtagatgggagaactgaaattcagagagattaggttaattcacccaaagttgggtgagtaattgggtaaagattcaaatccattttcttttaatcgaaaaaggatgctttcttcaatgtatcataccagtgttattttacctttattaaatagttacttatttcaataaaacatttcaccaactcagaagtatgttatttataattgtattagctatgtatatattttttaattttttttctctcattgaaatgtgtttgcattgagccaatttccggttcttacaagaatttttttaaccattcagattcttactttcacagtgacttgttctttttcttctctcatcagtaacaacatgacctactgtaagtagtaacaattctgatttatgagtcctggaacgaggtttctgctttataatgaagttacggaatctttgggttggaaaggaccttattaaaagttatggctgatttttttttttaaagaagctgctaagcattggagctcagaatatatgctttttaatt

SEQ ID NO: 70335 - DNA, 1034 bp, Homo sapiens
caagtgatctgcctgcctcagcctcccaaagtgccgggattacaggtgtgagccttcacacccagacttgtggtttttgtttttgttttttaatattttcccaagccaatcaattagatatcctataattggggatttaggtctagattcccggagtcagtttggcaatgtaaatttcagtgctgcattcacttagctcaggtttcagttgcattggtagataaagtgataatttaatttttctttcactatgaattagtctcaactaaatttgtgttctgaatatttgcattgaggtcagaggccagacatttagtagtggccaggcatcttgaattcatttgttgttttctttctttttttattttattttaaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtaagaaatctttaaaagttttacagttttctttaattaaaaaaattaatgcatgtttttaaagaaccattatgcttttcttaggtgaataccttgagaagataattcctttggtggtaaaattttgcaatgtagatgatgatgaattaagagagtactgtattcaagcctttgaatcatttgtaagaaggtaagtttttaagatctctattttttacaaaaagtttttccttaagagtagaatcataaggtctacattaggtgtgtgaggagaagcggccttttggatttcagatataacagacaatacagtatttgaaactaatgtcatcttgctattataaaatgtggtcatcacatttattttgaaaattttccttgtcattgttaggactttattt

SEQ ID NO: 70336 - DNA, 2030 bp, Homo sapiens
taatatattttttaaaagcttagtaaaagttgtgtatttgtgtactagaaggcaatacaagataagtaacattatttttcctcttgactaatgcagtagcatggtgtcttgagaccttactggttgttttctgcatttatcccttgacactcctggttttgagaagtggcttttaatcataccatattctgaaaatcagaaattgttagattcatttttgttcctttagttgagaaacacaaagtattcttttatttgctggccctgtgggcatttatatgttctgtcctctcattacatcggtagaagaccaagcctaggtgaatatgcactggcatttccacaaataatcctagttactgaagagcacattcatctgggtttggttttctaataacatgttgattatataccgatttctgtctatactgccatacattaaccataacatagttaaaatcgggattaggggagttcatcttaaaattgattaaataagtacaatttgaaaggtaaaccttttaaaatagtaagtccatgggagagaaagagcaagaatcattggtgctagatagtctgggaactactgtcctatgttattgctggtaataaagcaaaatgtggcaggtaatgaatcaaggagtaaaatgcagctcttcaaggcagcttttgtttttgtctttagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaaggtattgcaaattaaatagaatcttttgagtttttgtgaaagacacttatagatggagatgattcttagtccaaattgtactgtttgttttatttagttataatagtgaaaagggaaatgatctcaatatttgacaacagcaaattaagttagagggcatccatgtattgaactgttatgcaacacattaaaaaatcatgtctaaaaatcattcattaatgctgttaataaggtgagtgaaaagtatgtagcaaaaattgctcaccatagcccaattttatttctttaagtatacagaaaaaaatctgtatatttacaactagtactattaccacttgttttctcttggctaggaactatgtatgatttttggttttaagtactattcaaattttctacaaagcatttttgtaaggagataaaccaaggttttagaaagaattgaatctgtagatatacatatttagggcagcttggcttgaaagaatattagtttgtttattcatagttcatgaaaaattctaaatactgttcgaggccccatttaacattcattaatagcttacaacatttctgaggctcctaagattgatgtaatcacacgatgatttatgatatttactctggaaagtagtagcagcacttcaaggacataggggttgctcatgtcagttgtttctgtttgtattggaagaatcataataacaaatatttaagttggtaaattactaggtaaacaggttggtggattttttgttatttttgagaatactttttagtttgattctttgaatgaatttacataacagctttcctgtcaagtcagtaatttcacccatctttaaaaaacaagtaccaaaagagtttcttaacaccatatactcctctagcagctgctgcctagtttctctcctccacaacagagctccttaaaagaatgcagttccattttcttttttccattctctcttgaatccactcctccagtgatggatgagattgcaaatgtttgactctgcctatcgtattactcagtctcggcaacatttctttatttagcttctgggataccattctagcctggatgtagtcctatcgttgtgattactccagtcttcgatgctgtttcttcttcttcaccctgaccactgtacttagagtatcccaaggctcagtccttgaacttaacctgttatactg

SEQ ID NO: 70337 - DNA, 1088 bp, Homo sapiens
gttctacagtgttttgggattggtaaccattctttttatcacctactctattaccacaaatccatttcatggtttgtcttataaagtccctgattgtttgcttgatttttcctatgctgttaagtaagttctttgaattttgtttcaaaggctgggaaatttatgactataaatatttatattctaaagaagttgaatgtgttaattgatgattttaaagggttaaaataagcagcagttcattacaaagtaaatgagaaaatgtttaactaattaaaaataccattatgtttgttttttaagtttaatttatgtgcagatttacagaaataacaagctctttgttcaagttctagttctgttgaaacctacctgttgctgtatatgttaccggaaagttagattaactgatttggttaagaatatcaattgattttctgttttaaatgatatacttctcttgtcattaatagcctgtttacattaaaacttacccttagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggtgggttttaaagtaaagtttagaaaatcatgatagtaaatgcaatgcttttaaaattgtctttatatggaaaggtgagttccagaatatctatagagaagcagaaagttctaggatatgtttatatagttaatgcatgttcatattatgttagttgtaaactattctaattgaattattcttggctttacatgataaacaatatttaaataattttaagattcagtaaagtagtctttatctttgatgttaatagagaagtcttagagctgtggagtcatactacttgcgatca

SEQ ID NO: 70338 - DNA, 2662 bp, Homo sapiens
caggctggagcgcagtggtgctatctcggctcactgcaacctccgcctcctgggttcaagcgattctcctgtctcagcctcccgagtagctgggagtacaggcatgcaccaccacgcccagctaatttttgtatttttaatagagacagggtttcaccatgttggccagaatggtctcgatttcttgacctcgtgatctgcctgcctcagcctcccaaagtgctgggattacaggcgtgagccactgtgcccagcctattaatttctttttagtcatgtatgtttcacaattaaaaattaagtagggaagactattttgttgctctctggaaagctaaatgatagcttttctgtaatttcttatcagtatcaagcaaatatagttacaagagaacatatataatacatgcaacaaacttgatcttgtgttagcaatagcaatagatagctgaattaggaatttaacaaaaaaagataaactcttccctttatcctcattctccataattcatgttaagtgtactgaggaaataccaacagctgaaccagctaatgactatatgataattgcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggtatgaaagaaacataaatctcttttgggacttattgtagcctttttgttaggacttagataagcttaaataattgtttccttttaaaggaatatatgtgacaacttaatatgcacatagagctaactttttaatctaacaatcttgaatacctgaagttagaaatttgtaagtaaaaggttaaaagtctcaccctaaaatatttggctgtaatatttattgtagatggtgaaaatttctacttatagaaataatataatgaagtgggaacattagcagtactataggggttgatttttaatttttctttcttaaaagtctgcacagcaatgattggattttttgttggctttttaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggtaggtatctagattttcttacttaaaaagttttttattgatagttggttgccttaaaagacacctaataaagaagttaagccatgtctatatttt

SEQ ID NO: 70339 - DNA, 4194 bp, Homo sapiens
tctgtcttcacttcatttttttattcttattttgaacttagtttaaaaatatttttgttgctgcttttagtgaactacaaggagaatcaagcatgtgattagtctttttagctctgtctctgtcatatcttatatctatagaagtgatattgaggaactttatggactcttcttccataccctctgcattataagtgctgagagtggattatcaattgaaaatatattcaccttcagaaatgatagttgcgttgctgctgaaagaaacgttatggttcacttagtgtttcatcaggttcttccctgaccgtcactgaagaaataacaatgacaccagcaaaaataaattatatcaacttagagaaaatataatgtatattgtattttaagtttatcatgtctgtctgttgcttttcttgtaatatttcaggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtaagttagatcacactgtttatttgagcttgtctttgacttaagtattgtatatccacacgttcttttttgctttaacaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaaggtaagatgtttgtgcctatttatacaatgttttagaagaagactttgctagagcaactttcacccttgtaatttactcatgtgtctgagaaaaatcaggttgtctgtgaagattttgataagcatattgtaaactataaagtgcaaaagtaataggcagtgtaacaccagttgacgtgtaagaaagatccagagccctttttattggaggaggaagtggcagtggatgcaaaatgctgtgtgcccacttgcttagtgaatagtccctagatcctttccctcaaaaaagtcccgacagattttgctgtttaaagtataaatctgtaactttttggcctgtcttaacattggaccatagttgctacccatggagggttttcttagcattgtcttgattaagtctcctgagctacctttggggctagtctgaattgtaactgtatcatttacctgaatgaggaatttttgtttttcaatataatatactgtgtttaatatcaagaattttgttataggacatggaacttttcagatatacaaaacaatctgtagaagctacttgagagaaatcatactgcgtcttatgtttggataatgaattttgcatataagtgttctttgttttcctgtgtgttcgtctccatttaaaatgtgaacagtaaaagggtgatttgaaaaatgaaaaatatatgcattgtgtctttttcatctactcttccatttagggcttttggccaagcaggacaaaagtggtaactcagcagtaattgagccatactacccgaactcctactcttaggtttccatgtgtggtagtgacctgagcctctcaaagttcaatgaagagggcctccccaccaagaagtaaaaggatgtgcttgtttaattctatgagtttatagtccaagagaaaaaggtttatgggttatcaggttttacatggattaatctgaataactggtcaactctgttatgatagtggaaacttattatgaaattgtgttccagttcagtaattttctagttctatgattctcaattctggtgcacatgagctttaaaaaataaaaataaaaaaaataatgtgtgccatattctgacaggttcagtaaaactctctggggatggggcttgaagaatgggtatgtttctaaagctctctggatgattctaatgtgcaaccaagattgaaaaccacttttctagttcttatatctgtttgagacaaatctgtctgattctgattggcagattacattaaaaggaaggtttactttgcatgctagttattttcctttaaaggatttgtcagaatttagtattttgtttttagaaaatgatgtcaaatctaaattctgtcttttttattcctaatagatgctgacatttttaatgttggtgagactgtctaccctttgtccaagtgcagtactgcagaggttggaccgacttgttgagccattacgtgcaacatgtacaactaaggtaagaaatgataagtatcaacctaggtcagacttggtgtattggggattcctagccaattcttttctctagctttccaaatataactattccagtgctctgtgtagcagttggtttaaaaagttaacctatcgaatactgatattttataaaacttagccctgttaacggctattcttaaaagtttttgtttattgctatatcaatatgttaacattttgaagtactgatacatatttgaagtactgatatgggataaaatgtgatcaggccacaaaagaggaaatttttaattctggttggaaggggagtcagaaggtttcatattaggttgacaacatttgcaatgaacctcgaaaaatcaagatttttttttttttagaccaagaagatgaaacgggctttgaataaaggcctggagatgtcatcatatggtgtgtttgaaaaagtgaataatagagtatagcaaagaatagggtagctagaggagtactttcttgatgggggctaaagtgtgagacttgctaagcagatagttgaaacaaagagtgtcctactctctttgttacaatcatttgggtctagattttctgtttttataatggggctttgtgtaaaatattcccttaaaagaaaaggagacagctactttaaaaataagtttaaaaacagttgttcttagaatgtaatatgccttatggacctacgagagtagcttttagcaggaagatcttatgtgcttaaattttgttcatgtaagagctgtcttttatagcatgtaatctaagtttactccatcttacaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctatta

SEQ ID NO: 70340 - DNA, 1070 bp, Homo sapiens
tgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctcaaaaaaaaaaaaaaaaaaaaggcaggaaggaaatttggtatggcagggcctaacctaaaaggttatttataaaatcaatagcactgaatgataatttttttaatgacagtcatgtattttattaatgatatctgaaagctgcttaaccattaggaattacaattctttatggttggagtatgatgatttcatcaaatgtttgaatatttacataattttta

SEQ ID NO: 70341 - DNA, 1122 bp, Homo sapiens
attgagggcttactatatgcctgggtttatgttaatgaggacttggaaacataagaggggacccagccctggaattgctcacagccagatgagtacatctgatgttaaaacaattgcaataaagagaaataagtaaaagggtgaatcacctaggtatgagaaaggagattacaagaaatatctggaaaggacaataataatgctctcattgactgactactaagcactttacacatattaccttatttaatccccctaaaagccctaatgaggtaactttgttaccttctttttgcagacaagggcactgaggttaacagagatgaaataagttgccctgggtcacacatttagtaaatggtggagctggatcatttaatgtgtgtctaactgaaaatctaccattatgaaacctgacctcactaaaagcagaggagtgtaaaagtgtgtggtgttttttgggtcctgggctatctagctttgttctcttggagagaagagtgacagtagttgatgagaatggaaggactccgatcatttagcctctacattttagagccttgtgttcttactggtaagttcttgcattagctatggaaataggttacagccacaggccttgggcaaaagcaagagtggtctcaggttgagacttttaaatcagactctagaagcactatggagaagagatttgaggaattctagacttagaagcaagggggcatgttacgatgctgcctcagttgtcccagtgaaagacatcaggagagtgagatgaggcagtgttgatggaaagggcctgggatagtaatgatgcatcttcttggtgacttgggaaggtgagggaggtgttgagattttccaggcacacagtgctgaggattcattcgcaggtggatagcctgagtgacacatggaggggaagccttctttttatcaaaaatggaggattatggaagtgggaaactggtttgttagaaaaatcatgagttaagtttgagttgcttatgggagagggagctgatcgatagttggatatgtgtgtcttccactcaggagatagcaccttggaaggtctgagctcagggaacaaatgcgcaaacatcaggccatgggcagttg

SEQ ID NO: 70342 - DNA, 1034 bp, Homo sapiens
gttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggtatacatctcaatcctgctctttctcgttggatctacttggaatccaaatagttcttaaacttttcttcagagcatctctaagagctttaggaacccactgtttatccctgagggtagataaattttctgttttttcagagactctttgggaatctggcttttttttttttcttgaacttcttccttccattttggcctttatgatacatatgatgaatttttcccaaagagcggccattcagtaatccatctgatgattttttttttcctttatgcctctgtgcattgttctaaactcatgcacacatctgaattctgcttttagtctttatgatgttgctctggggagacgggatggggcacatgtctatgtataaattttttttctatttgctcaatgtccagacccttagtcttttcttctcttccaggctagcttggctgataacaacacagacgttcgtctcattggggagaaactgttccacggagtcagtgtaagctacagttgtgacgaacagggccgtgtgccgtccatgggtacttggggtggtggtgatgatggtttaggtcttatcccttatgaccctttctgtttcccttccacctgcagatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtgtaagttcagctctcagcctatgcccacctacccctccttccc

SEQ ID NO: 70343 - DNA, 1063 bp, Homo sapiens
gaatgttacattgatagaatcaaagataataagtgaaggcaacaattacaagaaataatcaggaaagtttggaactgtatttgattttactggtttgccttgttttgtttttaatttaatttaattttttttttaaataaatagatatggggtctcgccgtgttgaccaggctggtcaaactcctggcctaaagtgatcctcccgtctcggcctcccaaagtgctaggattacaggcatgagccactgcacctggaccatttttatttttattttttgagacagtctctctccgtttcctggctggagtgcagtgatgcaatcatggcttactgcaatctctgcctccccagctcgagcaattcttgtgccttggccacccaagtatcccaaattgctaggattacaggcatgagccagtgtgtccagctagctgccttcttttaaaaagtaaaattgttcttgacttctaggacagtgatacatagtcattgtggaaaacagcaaatactgaccaaactaaaaaagaaggtaaatatctcacatgtactgttcagggacatccactgttaaatttttgaggtatttaggtatatatgtgttagtatatttggttatttatttatcatagtgtagaaaggttttataatctatttttagcactgttaacatattttcacatcatgaaatattcataatcttatttttatggcgacgtgcaatctatagttacaccacagttttttaaaaccagatgcttattgttaaaatctaatttttactcaaatttctattgttatttcttagtctgttttgaagaaatactgtaaagaaatccatctgtaactacatttttgtttatattattttgtgtttgtgagtactccccaagtattattgtgtagtcaaagaagtcaaagaatgctaaattttaaggcttctgctatgttttgccggccccccagaaagattgtactcccaatagcagtctatgaggttgccagtttctctacatccttgccagctctggtatcattgtgcttttaaaaattaatttttgaaat

SEQ ID NO: 70344 - DNA, 1117 bp, Homo sapiens
tatcatatgaggagatgatactgttaacctgcttttagtaaggcaaaaggcttgactttttttctgttagaagcattacgtttttgttgatacactttcaaccttgtcagtagtgactcaataggaagataaagaaagcaatactttcattgagcatctgctgtgtgacagttgtattccagctatgttccaggcattgttttaagtgctggggatatagcagagaacaaacagacaaaaatcatagccatcattgaacttacattctagtggaggagggagacaataaacaaaataaccaggtaaaatacatagtattttagatactgattagtgctaaggagaaaaataaagctgctgaagtgaacaggaagtggccagggaagtcctcggtgcgagagtggcatttaagcaggatctgaaaaaggtaagggattgacctgtatgcggatctgggaaggtctaggtgacaagaacagtaagtgcagatccctcaggtgaagggggtacctgcccccttgaggaacagctagaaggtcactgttgctggaagagagagagagagaatgagagggagagtagtgttgataatgggttcagagacataatggggtgctaaattgtgtagggctttgtaaatcatagcaaagattttgaatttttttctgtatgcagtggcaagctattggaaaggcagaggagtgacatgattttatttagtttttttccaaggtctttctggctgctgtgttgagaataggtagtagtagagcaagagctggggcataaaaacagttgggagtcacttactctatccaggcaggaggtgatggttgtttggaccttggtggtggcagtgaaggtcatataaagttcaattctggatacacatggaaggtacagccaacaagatttgctgatggataagatctggggtgggagaaagagaaaaatcaagggtgactcaagatttttggccttagcaataaggatggagtcgccatttaactgagttggagaagatcaagaattccgttctggacactctaaatttgagaagcttattagacatacaagtagacatgttgaatagggaactgactatataggtttggag

SEQ ID NO: 70345 - DNA, 1049 bp, Homo sapiens
ttggaataaaaagtaggtgtcaatatttttcttagctgctatgaatttctccctgcctgctggtctgaaataaaataactgcatcatgctttagcttgattgttttagtttttgcttaaatgcacagtctgatgactgtatgtggctaattttgccttcctttgtctttggtccctggctgtatttgtgcaatgtctttgatatgctacttggtgctgtttgtaaagaagcatttacaatagtatatgatgtctgaactctcctgaataggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctgggtgagatattctttgtggatggcaaaaaaagtttgttgaagcttatgtagatcatagaatgatataggaaaatgacctgactactcaaaatgtgtctcctagtcgaatggaattgtggcagccatttatttcatttttattctcagtgaaaaataaagcaatgtagattgctttatttatgtataaataacacataatgtaaatctggaaggctagatttttataatattttttgttggcagttaatagcggagtagggatgattacatggtagatgtaaaaagacctttagaaggtaaaaagaaagtcaacaacaataaaaaagtagagactgcaagctattaatacatagctattattcattaatagattttgtggctaattcagaacttggctgctgattttatggaagagcgctctgctgttctgggttaaaatgaacatgatttaattatctgtaagtgaaagtaattgaagaacttagaccatggggtcctagtttatgtgtgtaaatgccagtttagggctaggtatgacttgtgtcagcagatgtacacaagcatatgtgaaggtaggagtaaaagaagataaatacattttgga

SEQ ID NO: 70346 - DNA, 1077 bp, Homo sapiens
ttctctatttgagcacggcctgaagacagcacaggcaaagtaaaagacaaagctcaaagctgtcccggatattatctggggcaatgttcatatattcaccttagtgaaatcaagttaaaactaggagcatcgaaagcacccgtgatggaagaaaggcagtgagtcagctaaactcttgagcagtttatgaccatcccaagtcttggcaaagatctccctgactgaggagtctgatagtgggagtgaggaaaagcaggacagaggcagaacagtatgtgtggctggtaaattgatgtcagccgctggcctgttgtgtttaggcgtgacactaggttgaggttatgagaaactctttgttttgaagactgtgttttctctgagatttctacgcttgatctcagccaaaaggccgagcagcgatttctttaaactaagatgagtttaggcatcagaactaaacatctaattgagaagattgttaaaactgaagtcatagtaagatgagattccttatcctgccttgatggaagagaacattgttgttgtcaatttaagatagacttttcaaggtttcctattatgatatcttggtaatgcagctttttttgcttattaaatactataatggtggttgtaaatatttaaattagtggtatagtttgccttaatttctttgagaaaaataattcaaaaagtaaattgaagttggaaaagaataagaatttttagctaagaagtcagtgatcattgatgataacagttttagttgaccaggttatagacatttaatatgagccatgttttacttatatctcttggaagtcatttactataggcatctgattatgaggttcctaaatataaggtacagtactccttcattttcccactcctaacatttcaggaaggagtgtattcacactcctcacatgcactcagacataagtgactttgttgttggaatattaactcactttttgagtcacattagttttcgagtccatatatcatctttatttctttctatgtttgagatatactttttgaatctgtttatagtctagtcactggaaattc

SEQ ID NO: 70347 - DNA, 2254 bp, Homo sapiens
ctcatcccttctcatcttggtctgctccacataagagaagctttgtgaaaagttccaaattttgacagtaccagggcccattgttctgttaagtagcacaggaaagtaattagaaacgaggcagcatgtactgcctggcctgccaggtctatcacgttgcaattctagtgacttttgttaggataactggaacattttgtgaccccctgatttttaattttttgttatggtcaaatttttaatgcttttaaaagcaaaattaaatattttatgttgaaaagctgtacttttaaaatcctataatctgaaggatattgtgtgtatatataggtacatatatctgaactaaatttaaaatttcatttctcctccacaagtgttcttaaaagttgtctttgtaactttttgctttagtagctactatttttgtataccgtgttttgtaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatggggtaggcatattcactgcatttcttttcaaaagcatagaattcttcattggtttcattgtcatttctgtaatattacattttgtgtttcagaattttccattgttgttttcttgtctaatgtctataagaatagttgataacaggctgttgactttagttattgtgaattagttctattctgactactcgctattttgtagtagttgtactatgataatctgtttattggatggacctcctgcgtctggattttattcatcatatattagcacctgagtcctaagggagagatcaagttgagacagagaagggaagtaggcccttacttctggcagggtgctgagctgacttctacctagccccttttcagtttcttatcgtgtacaagaagacaaacagaaattcaattgatgaaatgcaaaaggaaggagagctctggctgtctctcagagatcttgcatttctgctctcttatgtcacagctggcctgcagcaggtccctgtgagcacataagcagaggctgcaggaacttgtgtggggatctcaatgctttccacatttctttctccattctgttccactgctcttctctggttcatgtccaccactgactgggaccctgaagaggcatttcagagtgttggagaagaatctgtagcttgttgaaaaagctgggggtgaaagggaacaaggaaggtgatgtgtgagtctggcaggcaggagaaggggtgttcatagaagcagtgtgcaggtgaggcaaagtgctgggactttttggtaatagatttaattatgaatgattagtaggaaaggactgagagtattatatttttcctgggatgcctaatagtcctttgatagaaaggaattttaaatagtttgacacttgaaaaaagatactatttataagttgaagaaagtttgctgtaccacaatgcgcatgtagttaacaattttgcactgtagatttaacattttgttaagaggatagatttcatgttatgcattttttaccacaatttttaaaaagtttgaatagaaatttttaatgtctttgagtggattttgttttttgaacagttggatagacttctgcgtaagaaagctggattgactgttgttccttcatataatgccttgagaaattctgaatatcaaaggcagtttgtttggaagacttctaaagaaactgctccagcttttgcagccaatcaggtagcttaatggatgtaatacatttctgagtaccattatcttatctagtaatgtagatttacatagaattaagagttgaaagaaattaagtacttaagtagcctggaggtaggttctagaaaaccaaaatgagagttttgctaaaatcatcctattacttatgatttatggtagtaatattatactgtcctaggcttctgatgatcattgttgccagatgcagcaca

SEQ ID NO: 70348 - DNA, 1728 bp, Homo sapiens
tgtagccagtttgttgtttttaatatgccaggtatcaaaatataactgaagaaccaatgctaaactgacttaattttaaaatgttgtatggggcatgaaaatgattgctctggctgggcgtggtggtttacgcctgtaatcccagcactttgggaggccgagccgaggaaggcggatcatttgaggtgaagagttcgagaacagcctgggcaacatggtgaaaccccgtctttactaaaaatacaaaacatagccgggtgtagtggcacgcgcctgcaatcccagctattcgggaggctgaggcacgagaatatgaacctgggaggttcacattgaatgaaccagcttgaacctgggaggcggagggtgcagtgagccgagactgcactactgtactgcagcctgggtgacagagctagacctgtcttaaaaaaaaaaaaaaaaaaaggagataagaaaatgattgctctgctctcttttacattctcccctcacccacgaccgcgtgaaagtcatctctcttaccttctatgacacgcattacttcctgcctcctgttaccattttatattatttattccattgaattgtgaactccaaccacaagatatatattgttttgtatgccttaacgcactggcatggtgccttgcaatagacattcaacaccagttaaatgtaagtaccatgagggtagggacttaatccatttcattcttcacagtaatcttcctagcgcgttgcctgggcacagtgtagcgcgttgcctgggcacagtgtaatggttagcgtttgaatttagggattaatggtaatgaacattcaaagagaggatatttgaagagaacagtgtaatcctttaaaaagaaacatttacatattggctttggaatcccttttacttgacaaattaattttcgttttatcctcaatccttttcagaattccaatattttctcttagctgtataaaggtaaagtgaccccctcccataataaagagctaccatgtaaggagggtatagcaaagaattaattattaaaataactagatccatttttgtaaggatcctttcaattgtatcttcctatctaattcaagattggtggaaggtctatgcaaagattgataacatggtaactgattagacatgttattttaaatgcagtccaagatttggatgaaaagctcacgttcaggttttttttgccttttgttgtaggtactcgataaatatttattgaggtagtgaaactaatctgaaattggatctgatacagagaatttgaccgattttacaaggtgtccatttactttttccccataagtattgtttaaataggctgttttattatcgactatcacacagatcttactgatttgcctcatttccttaaagatgtaaaataactgtgtttctctgtatgtttgtgttgctaaagaggaggttgggtattgatctgcagtttctagatttgactggcactaggagtaatttagcatttatgaattagctatttactgctgttttatagcagtgatgtcacgtgttcactctatagaaaagttaggtaaagattggtctgtcttaaactttctgagacataggttgtgactaaaaatatgccctgggttttcttccccctcctgtcattattgaggactccatggtctaagagattaggctgaagtttttgttagccttttcaaattgaattgaattttaga

SEQ ID NO: 70349 - DNA, 1054 bp, Homo sapiens
agtgcagtggtgcaatctcagctcactgcaacctccgcctccaggttcaagcagatctcctgccttagctagtactacaggcgcacaccaccgcacccagctaagttttgtatttttagtagagaggggatttcaccatattggtcaggctggtctcgaattcctgacctcaggtgatccacctggcttggcctcccaaagtgctgggattacaggcatgagccaccgcgcccggccaggttttgtattttttgtagagacgtttcgccatgttgcccaagctcacctcaaactcgtgggctcaagggatctgcccatcttggcctcccaagtgctgggattataggcatgagccactgtgcctggcccagcatttcactaagtaactttattttaaaaatatacagtgaactgattgccgaagtggtggattgcctctacctgtttcctttttctttgccttgtaggaagggaaaaagatgaaaggaaacatgttttgtctatttagtagcaatttttggtgaaagcttctggaaaggaaatggaaaatgctgggtaaaatgaaattataattatctgtgtattctaaaatttatcctcacattagaatatatttttcaaagttactttatactaaattcagggactttctaagttctcagttaatagaactgaaagggtatcaataaaataaggactatatatataatctatttttacttagtttttatgcgccaaaaggtatgtatgttgcatccagctgtttgttaccttgtgttttaaagttgcagttagaatgtggaatcctattactacattgtgccaacatatttgtggctgatgcttctaagttatccacaagcttctcaatacaatagcaaaatgcaggaattcctctggaatcttgaattgagggataggatgagatatataacatatgttatctgttgttttctcctactgctcttgaaattaacaaacttgagatagtgtactgatttgtatttataagattggctgagttcaaatatgtctttttgacgttcttaccaat

SEQ ID NO: 70350 - DNA, 1052 bp, Homo sapiens
ctgattcaagaccattttcaggttgtctgtacgttccccactttaggaataaatatttggtcttctgcttcctctaccaacatattatatttaccatttatgtatgccagggcttggccagatacgtaaatatttaggctctgttgtaactactttgctgttacagcacagaagaaaccacagacaatacacaaatgagtggatatggctgtgtttgagtaaaacttgatgtaacaaaacaggtgataggttggatttcttttcagacctgtgctctatcctggatcgggctcaaagtcatgtctgtaattctgtagttttcttctacctctgagcatcttttaataagtctgcttatagggtgctccatactagggttgtatagtaatcattttaaataaatctattttcctgaatgttttatttctgtgaaaagcacaggaatacacaactttacttagaattctttttttttttttcctttaataaggtactaggttttgacaagcttgcatcatgcgtgagtataagctagtcgttcttggctcaggaggcgttggaaagtctgctttggtaagtcattcttactttacctaagcctttcactccaagacgttctttttctgttgagttttaggttttgatgatttgtctttgttaagataaaattccttaatgactttagaagcaatataatatttttcttgtaattttattcaacttttaattatatctgggtggatcatattctctctggaacattgactccagaatgacacgagttatgctggaatacaatttgagctaagcacagagattgagagcgtacaaatacatgtctttttgcattcgcatttcagagccagataggaataaattttggtctttttatttatttatttttttgaaacagggtctcactctgttgcccaggctagggctcaagtgatctcagcctcctgaatgcttgggactacaggcacgtgccaccatgccaggctaatttttaaaattttttgtagagatggcgtcttgctatattgcttaggctg

SEQ ID NO: 70351 - DNA, 1039 bp, Homo sapiens
tttctttctacatctaattctaaatacctatttttccctaggaaatattagatggaaaggggtaacagggatatatgtgtaatttatttaatagctgtgccactgcttccttaattccagaaatcttgttccagtatggtgagggcatatagttacctagagaaatgaggtatatctaaagtatcatgggagaatttagacagaattacttatgatactgttggaactgttgctggttttgtttgtttatttgagctatttcgaaactatttttttctctagaattaagtgctgagaatccatattgagactggttcgtgtaggtttccctgtgttgacttgagaacacatggcttttgaacttgattacaatttgggggtctttgaatcttgattacttagctatttttcctcctgctttgttgaagtattgctggatattagtttgtaaagttgttaaaatctgtgtgtcttatttttgatacattagcttttttgtgtatattaaggtagttttatgtacattgaaaaaatgaacatgtattttaatttttctaccagcaagttgaagtagatgcacaacagtgtatgcttgaaatcttggatactgcaggaacggtaggtaaaactaaataccaaagtatatacaccgtttgtacagtattgacttcataaatgctagtactctatagacaaatattagttaagcttatttaaaagtactgcttgcagccggttgtagtggctcacacctctattcccagcacttcgggaggtcaaggttgctggatcacttgaggtcaggagttcgagaccagcctggccaacatagtgaaaccccatctctactaaaaatacaaaaattagccaggtgtggtggtgggagcctgtaatcccagctactcaggaggctgaggcaggagaatctcttgaacccaggaggcagaggttgcagtgagccaagactgtggagattgtgccactgcattccagcctgggtgacagagcgagactctgtgtcaaaaaaaaacataagact

SEQ ID NO: 70352 - DNA, 1103 bp, Homo sapiens
tataaatcgactttggtgtattgtttttaaataggaaacctatttccagctgggcgtggtagttcacgcctgtaatcccagcactttgggaggccgagacgggcagatcacaaggtcaggagatggagatcatcctggctaacatggtgaaagcccgtctctaccgaaatacaagaaaaaaattagccgggcatggtggtgtgcgcctgttgtcccagctactcgggaggctgaggcaggggaatcacttgagcccgggaggcagaggttgcagtgagccgaggtcgcgccactgcactccagcgtggtgacagagcaagactccgtctcaaaaaaaaaaagaaactaaaatgccaattttttcaaatagtatcttgtcatagattataattttaacaaagttacataatactacagtattcttcattgagctataattatagactgtgaaaattgtaaaaataactgtcaaaacattattgttttttaacgttcctttctttctattgtaggagcaatttacagcaatgagggatttatacatgaaaaatggacaaggatttgcattagtttattccatcacagcacagtccacatttaacgatttacaagacctgagagaacagattcttcgagttaaagacactgatgatgtaagctgacttccaaataaatatattttatttcaaaaccctgattataattgtttaagtctaaatttaaattcattttaaagcttgtgtattttggttggggggggggtgttggtttttttaaactttttccttgaaaggcaaaaatacccatacatgttttcaaatatatatcatgtggaaagtgagaaatttcctcctttgccattatcctgtgaaaattaaatgttacacccttccttttttttttttcctttgagatggagtcttgcactgttgcccaggctgaagtgctgtggtgcgatagctgtacctcccgggttcacgccattctcctgcctcagcctcccgggtagctgggactacaggcgcctgccaccatgcccagctagttttttgtatttttagtagagacagggtttcaccatgttagccaggatggtctcgatc

SEQ ID NO: 70353 - DNA, 1900 bp, Homo sapiens
gccactgtgcctggccttgattgacttttttaatacaagactatgagaaactaaaaattctattttgggagccttccgtccattatgataaaattttaaggttttttccccccatctctcataacaggatcatagcttgttttctcaaaagtttatgtaaaagtgtcttatttatgtctacattgactaggttgtgttcattttacttaacatatgagagttttctttctctcttttcttccctttggagttatcgtttgcatctccatgaaaagagaaggcagtggagataattgacatcaaagttaatacttatgtttatgttacagattaaattgttaaggctgtaaattttattatacattatttaatattttttgtggcatatgaaaagtaattcttagatttgactcttagaattcttttgatttgaattcatatagcatatttacttatttatttttactctcacaaatgtatttttaggttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgaggtatggtcaaatatacttaaaatgggtcttcatttgaagtacaacattgaagatgaatggaaaatgtcttaaccccaagttaatatgtactcagggtaatatgttgatgttacaggcaaaaaaaaaaaaccctcatgttaaatgtatctatgtagtaaataaacaatactatttcagtctctattaaatacttgtacattgatatttaccatgaaaaaggaagactggacagaaaatacatggatagggaagacagattaagacttcaggtatatgaaggatgttatatgaaaaatagagtaaaattccgaaaagtatgcatggttcttgaaaggctccaagtcatgttgtagagcaaaaacttacagtttttaaaaggattttttctttgtgtgatggtaaatgttctaattgaactaagttaagatctctgcagctccttcaactaagtattttaaggagcacaatattaacactccccaaaaatttgagcttggcagttataacacctgattttattctcattccttagctgaacaattctgggcattaatttatatccatggaaatttctgttttttcaatttacttttttcattgggggggataggtgttcctcctgtaaattaaaacaaattattgtatttgcagatcttttatgacctagtgcggcaaattaacagaaaaactccagtgcctgggaaggctcgcaaaaagtcatcatgtcagctgctttaatatactaaatgcattgtagctctgagccaggtatgttcacttatctttcctctaacttttaatcactcaaccttattaagggcactctgtcatgaaagcaagtatagacttctttttgttggttctgaaaaataaatggtttatttttataagatatccatgagttagtatgctatcttattaattatttacttatcatcatgagtaaagtatttcacataagtattctttttttgagatggagtttcactctgtcacccaggctggagtgcagtggcgcaatatcagctccctgcaacctccgcctcccaggttcaagcaatgcttctgcctcagcctcccgagtagctgggattacaggcacgtgccaccacgcccggctagtttttttgtatttttagtagagatggtgtttcaccattgttggccaggatggtctcaatctcttgacctcgtgatctgcccacctcggcctcccaaagtgctgagattacaggcgtgagccaccactcccagccaaccccgtccctaa

SEQ ID NO: 70354 - DNA, 3388 bp, Homo sapiens
ataacgtgattgtaaatctgtaaaacaccatcatgaaataaattctatttgtctgctctgaacgagctttttagccactttcattgaaagagtgaggaagaacttgattatctgatactagaaaccttggttagatgtgcattctatacttatgatctaattctaggagtacattacgattgtgtaaacacaggatcacccagtttgttaatattgctatctgacttttcaatcctaattctaataaggttgacttgactaacaattttaatgtgatttttttcctttttaatccttggaaggtaatgcacaaaaatttgcacaaaggtactttccctttctgttcctaagattttcatttaactgactttcaagagggcagcagaatagacttcatctttttggaatgaaaaggtctgccgtgaattgtggtatgttgccactaatgtaatgcctagaacaagagcctagattatattcatttctaacacttttaagactgttttcttaactgtttgcttttgggtctttactttttctagcccatgtttttaattaatttttttccttttgacaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgccacttgaatgtgttttgtgtaatgttttaacagtgctagtaaataaatacgggtttaccctggttttaattgtaataggtgcattttacacagcatggtttcataatttaacatctgggcaagccagactcattaattacaggaataaggaagtagcgagttttctggtattgtttgaatatccacataaccaccttttgaacttttccttgagaaataattttgtaaatcaagcagtattacttacgaataaatgcctttgggtaatgttcagtagctatttgatgaggtaggtaaaagaggaacgatttaacatactttcatggatgttacactatggattttttaaaatacaggattgaagttagaatattgtggttataaaaatctttgagtgatgtggattaagcacttagagaatcgatatttttcttaaatatgctataattgaattctgtaagaactgaattcttatagaattattttaaaactttttaaaaattgtaaagctcttaaaaaactttttgaaagtatttgccagctactggagcaattaatcagtgataatatctaatagaggggtatctgctaatcccctaaatacacgctgtttgaatgatacatttttaaaggctttcatgttaagaaaaagtctgattctttacaaaagggacttgttttggcagaactggttttatttataatcatttgggaaaaaaattaagcccaaaaaactgggactgtgaaacactaaaattacttcaatttactatgtcctgttacatccattgataccgccattattcaataattacttttaataaatgtttgctgcctaccagctatgtaccaggcccagttctaggctcaaacagctaaatattcattcattggacaaattaagtacttaagtataaaaattgttctaggcctaaggatgtagcagcaaccaagatcaactataaaatgctgccctcctagaatttatattctattgaagagtttctcagcctcagcactattgatgttttatgtttgataatgtattctggcgactctcctgtgcattataggaattttaatatctgcccactagatgccagtcacaccaccccagcccccaagttgtggcaaccaaaaatgtttccagacattgccagatgttccccagttggattgttgggggacaagggaggtgaacttggagggcaaaatcaccctggtgaagaactactgctctggtgggaaacaacacattagttacagatgagtgttagggttacaagatggatggtttactatatagtgaataagaatataaagtttggagccagacttcctgggtttttaatcccagctcttccagttcctactatatgcctttggttgggtgccttggtttcctcatctgtaaaatgagaatgataatacctacttcataggagagtgaaatgaatgccagtgctatcctctaggtctatatatatatatatatatatatattatatatagtacatatatagagagagtatatatatatatgtagtacagtggaggtct

SEQ ID NO: 70355 - DNA, 1049 bp, Homo sapiens
tttttttctttttcttttttttttttgagactgagtttcgctcttgttgcccaggctggcgtacagtggtgcgatcttggctcaccccaacctctgcctcccaggttcaagcaattcttctgcctcagcctcctgaatagctgggattacaagcatgcaccaccacgcctggctaattttgtattttttggtagagatgaggtttctccatgttggttaggctggtttcgaactcccgacccaggtgatccgcctgcgtcagcctcccaaagtgctgggattacaggtgtgagccaccgcacccagcctaatcaatacatttgatatttcaagaatacatgagagaagagaggtagattgagaacagaactaaactttatatatgtttccttaactattgggaggaaaatggatgagtctgtgttgggatacctgttgaaacaagactactaaacagattaatcaactaattccataggcttgacattagtttatctttgaaaagtaaaagtaaagtgcttattgctaaataggtctgtattctaaatgctgccattttttaaaaaaagtattccatgttacacacattttaaacttgcttcttaaaacatccctgttggtggcctgtaggttactgaccttaggaattacaggctttatccaaaattaggcatatctacctgatttttgtatctgagaatcaataaatgcattcagtattctctaccgtgtttcaggcgctgtttacaatatcggaggtacagcagggattttctgcccacgtggggaaaacacacagcaaatgaacaaagctctattggtaacagtctgttaaactttctaagagctttccaactttctaagagaaaattgtaatgattttagaaaagtgagctgtcatttttcatatatataaatttttttattcataggtaatctaatttttctcatttctccaaaagggtacgaagacagtttttactatgttgttttactatgaacctagtttaacctgactttccttacagacccacataaatgagacaatc

SEQ ID NO: 70356 - DNA, 1035 bp, Homo sapiens
tagtttcctagggctgctgtaacaaattatcacaaatttggtggcttaaagcaacagaaatgtactctttcacagttctgaaggtcgaagtccaaaatcaaagtgttaggatgtactcctagaggctctcggagagaacctgttcccatggcattatgccacatcacatgtgcctctatctttgtatctcctcctctctataatctttcttttaaaaggacaattgttttgacatttagggcttacccacatacttcaggataatctcatctcaaaatgcttaatcacatctgcaaagacacttttttcaaataaagttaacagacagaagtttgggggttgggatgtggacatgcctttgggagccattaacaacctaccaaaacattttaacaatttttcagtaccaaagactagtatgggtctgctccaagataactcaaaacattctgaactgaatcagcagaccctcaggtctccctagagagatcctgagcacctaggaaagccccagaattaagctactctacaaggattctgagggaagtctgggattaggtgagactttaatgagtccatcagaggtttagtatggactagttctacagttccagaagcaacatactgggtatggaatattgttaaccattgtcatcccacagaattaccttctacttgtgtcagtatatatcctgcctaccctacatattttatatttatcaatgatgacagaaacttccccccttttacttagatctaatagtaatataacaaacttttctttttcattttcagacatatccagagggttttctcttcatctcacgcatcccacctttaatcagacatatgtgattcatatgagagaaaattagtgtttctgagaccaaatggtggtgtttataagattttgcttctgcactgaattcaatgttttatttactgcttggttattttgtttttgttttttaagaaatgggaggagtgtaatatctagaggtacatgaaaaaaagaaatggaaggaatggacaggc

SEQ ID NO: 70357 - DNA, 1050 bp, Homo sapiens
aaaaatagcaaaagaaatgttatgtaagctgtgatgcagaatgacttcacctaagtattaaaaatacactatagtagccgggcatggtggctcacatctgtaatcccagcattttgggaggctgaggcaggtggatcacatgaggccaggaatttgagaccagcctggccaacatggtgaaaccccatacctaccaaaaatacaaaaattagccaggcgtggtggcacgtgcctgtagtcccagctacttgggaggctgaagtgggaagatggcttgagcctgagaggcaaaggttgcgttgagccatgatcgtgccactgaactccagcctgggcaacagatccagaccttatctcaagaagggaaaaaaaaaaaaaaagacgcatacatacatataatttttagaaaccttatttgtttttaaagtatccactcagtgacaataactccatcacttttctgtatttttacttttttgtttttttttaaggttactaatctggatgacagtaactgggcagctgcattttcatcacagcgttccgggctgttcacaaacacagagccccacagtataacagaagatgtaactatcagtgctgttatgttacgtgaggatgatcctggagaagctggtaaaatggcattgagctttgtgacaagtagcttttcactttagcaagatgaaggaaaccatttcttcctgtttctgaacgtcattatgtttttcttttctttctttctgtctttttttcttgagagagtagcttaaacaacagatttttgtgtgtgtgttttttgagacaagagtctcactctgttgccgggcgcggtggctcatgcctataatcctagcactttgagaggccgaggcgggcagatcacgaggtcaggagttcaagaccagcctggccaacatggtgaaacctcgtctctactaaaaatacaaaaattagttgggtatggtggtgcacacctgtaatcccagctacttgagaggctgaggcaggagaatcgcttgaacccgggaggcagagtttgcagtgagc

SEQ ID NO: 70358 - DNA, 1048 bp, Homo sapiens
gtatttgatacagtatcactagaaggttgagaacctcaccttggttctcagtctgagcagcatcttgccattttatcttttaatgtaaatagcagcctgttacgttattagacaagtctcatattgtaatttttttcttatttgtgctgttgaaagagcatctctttctttaggtttagttcttaatctaacattgttgatgtgttttgttttctcctggaccgtaatgctgttattttttttcagatagtgttatgaccactgtacaagcattaactcatgtaatccttatggtggtccattaaatagttacaataattattcccattttagagaaaaggaaactactgctcaaagtggttaagtaacttacctcaaaccacctggctaggaagtagtggtaccaggatttgaaactaagcagtttagctccagagccctgctcttaacactttggtaactactactttcttgtagtatctgtcaaaaacaggtactcgtattaagtgactcaaaatactttctacttaggccaagtgcctgtattttcccagagtggaacatgccatttagtatgtattataactttctccactactttgtaatggtgtgcttaaaatataattcagatatttttaaatctggctcaatttcttaagtaattgtttataaaataactagtatatctttgagatcttaaaagacctttaggtatcaaaagaaaaaatagataaattgggctacatcaaaattttaaacttttgtgcacgaaagaatacaatcagcaaagtgaaaaggcaacccacagaatgagagaaaatatttgcaaatcatatatctgcttaggggttaatatccaaaatgtataaaaactgctacaactcaacaacaaaaaaacaacccaatttaaaaatgagcaaagaaatagaatagacagaggctggacgcagtggctgatgcctgtaatcccagcaatttgggaggctgacgcgggtggatcacctgaggttgggagttcgagaccagcctgaccaatgtggagaaaccc

SEQ ID NO: 70359 - DNA, 1036 bp, Homo sapiens
tataaaagacttgtagccatttaaattttcaaacaggctgggtgcggtggctcacgcctgtaatgccagcactttgggaggctgaggcgagcagatcacctgaggtcaggagtttgagaccagcctggccaatatggtgaaaccccatctctactaaaaatacaaaaattagctgggcatggtggtacatgcctgtaatcccagctagttgggagggtgaggcaggaggatcacttgaacctgggaggtggaggttgcagtgagctgagaccgtgccattgcactccaccctggacaacaagagtgaaactccatctcaaaaaataaataaacaaataaatacattttcaaacaaacggaattacctagaagtacgtcacttaacttttctttattcctttttttttttttgatgtgttctagcatccatgagtatgttttctgatttcctgcagtcttttctgaagcactcttcgagtacagtttttgatcttgtggaagagtatgaaaacatctgtggtagtcaggtaagctaatttcactccgtcgttagtcaaacttcagtatttttagttttcataaacagcattaacctaattttcatagtgtttaagggaggtgtcttaggggaacagtggcaggagtggagggaaagtcaactagagcatccctgcgtcttacatattgagggcccatacaagatttctttgggagaaaaaaggattctgctgctttaaaaaaggaaaatccagccagatgcaatggctcacacctgtaatcccaatgctttgggaggccaaagcagaaggatcacttaaacccagcagttcaagaccagcctgggcaacatgggaaggccttgtctctacaagaaatacatttgccaagcatggtgctatgtacctgtgattctagctccttgggaggctcaggtgggaggattgcatgagccgcagagtttgaggctacagtgagccatggtcacaccactgcactccagccagggtgacagagtagaccctgtctgaaggaaaat

SEQ ID NO: 70360 - DNA, 1069 bp, Homo sapiens
attttggaatgaggaaggactttggtgatgttttgtttagaaatgataatgtttttggtgccaatcttaggaaaatatctttcttgattagttacctgatataaattttcaaacacaattttaagataactttttaaattttaattgctaaaatgttggcttatgttatgatttttccaggtataggtttgatttaacttatcctctgggtagatatacagggagaaaaaaatatatccatcactgccactgttggatctgaaatcaagagtatgttagacttatatatatactcagataaacacaccttgttccaaattagatccatttctagtgggaacattacattacatttaatttaaaaagacaaaatagagaaggcaattttataatatatacttattaaatacaattattttagcactctattcaaatacaaacttatcagtgactcaaaattgtagaaaattaacctctttacatctgtgttttttattcaggtgaatatactgagtaaaatagtgagtcgagcaacacctggacttcaaaaattttcaaaaacagccagtatgctctggcttcttcaacaggagatggtcacatggaggctgctggcttctttgtataggtaatggcgtctagaattcataagtgaaataaacataaggtaataaaccaacaggcaaattaatttaaaagttagggtaggtcgtgcttggaaataggttttgctatttttgatgcttatcatttcgaataccttagttgtcaagagtgagtcaagagggaagaggaagatatcagatcataaggctggtagttaccaaaattggatgtgtgtaaagacttaaggaaagtactaaaaatagtgcaatacttaggctaaattaagaaaagagctgaaagttagacttcatgtaatatggaagtttgaaagaagttaaccaaattttccagaaggcgaagattataccatgtacatatccttgaatctaggaattttatgcctagaaatttaacctaagaaaataatgagaaatatatacaaccacatatgaataaaactttt

SEQ ID NO: 70361 - DNA, 1050 bp, Homo sapiens
cgattattcctatagaaaattttattcttttgccataatatttatttatcttaaagtaaaaatagtgtttggaaaaattgttacttgatatttttaaaatcagaaacttcacgcctgtaatcccagcactttgggaggccagggcaggcagatctcgaggtcaggagatcgagaccatctggctaacagtgaaaccccgtctctactaaaaataaaaaaaaaattagctgggtgtggtggtgggcgcctgtagtcccagctacttgggaggctgaggcaggagaatgacgtgaacccaggaggcagagcttgcagtgagccgagattatgccactgcactccagcctgcacgacagagtgagactctttctcaaaaaaaaaaataaaaaatctgaaactgtttgaattaagggtagtagtaccactacaaataaaacacaaatagatttggtagttaacactaatttatttttttctttctttcttagctggtggtagattggttagagagtattgccaaagatgaaattggagaattttctgataatattgagttttatgcaaaatcagtatattggtaagttaccaaactttaattcttaaggtcactcaatgttgatattgttcattcatctttcaataagtattattcagtttttactttgttcacactactttgttcacactactttgtttggtgtgtgagcaaaacaaataaaggctttgcctttatggaatttataattgtttaagagagttagatagctgatttgcaaatatacagttggccctctgagtttgtgggtttcgcatccatggattgaacaaactgcagatcagaaataattggaataaaacaagccgggtgtgatggctcacgcctgtaatcccagcactttgggaggccaaggtgggggatcacgaggtcaggagttccagaccagcctgaccaacatggtaaaaccctgtctctgctaaaaatacaaaaattagccgggtttggtgacgcacacctgtaatcccagctacttgggaggctgaggcaggaga

SEQ ID NO: 70362 - DNA, 1096 bp, Homo sapiens
aagcaaaaaaagtagttagagggtacttgccttactcaataataacacttaatatgaagatacaacaaaacagtatagaactgacatgaaaataaatagatgagtggaacacaaagtccaaactagatccaagtatatatgagaacttaacagatgtcagaggtgacatttcatttcagagggaaagggatggtttatttaaataaatggcgctggcataattggctttccatccagaagaaaacaaagctagatcctacttcatgccatgtaactaaaataaattccatatagagcaaaggtttgaatgtaaaaattaataaatgctgaaagaaaatttagacagccaactaaataaaaattaaaatacgtttgacaacaaaaaatgaactatattcttcaaaaaatcaagctgcaaataagttagaaaaggttttctctactctgtacctgatcactatttttttttttcacccttggtgccatgtacagaagagaatactcaaagaatgctttcatgtactgctgctcatgttgaaagaaatcttaatagtttattttgcttaggtcacatgagttcttcctttctcgtccaccatgtgtagtgccaaggtaaataggaataaaatataagaataaaagtttaataccattgagagattaaattgttataacataggtctctactttcaaagatgcttttcagttctggatttgtaagctgtgagtatattccaaaggcagtatcctttccatgttttattttgttttgatctttctaaggcccttcatttccagctttttctttctatatgttccttcaaaagtttaacatttttagtttaacagtgaatatatactacagaatgactgctagaagatttatggaaaattaaaaacttttttttcagagagttctggaagagaatcaagaacattatcatatagttcaaaagtttcttatcctgggagacattgatggtaagatatggttttattttactttgtgttttttgtgtgtgtttttttttttttttttgagacaaagtctcaccctgttgcccagactggagtgcagtggctcagtctcagctca

SEQ ID NO: 70363 - DNA, 1005 bp, Homo sapiens
gctttatgactcaccttattttgtttttccgtactctgggactacagaccaaggtatataaaaatgaacgatttcttcttctctgtaatgttgatgctatatacctattgtcaagaaaacactactttttttattattgttttctagaaatggtgataaggaatcaaaagtcttccatatagtcttgtatagtcactcaatgataactcactgagagtggccctttagggttctagtctgtggccacagaatgctgttggttaactggtttttaataaattcataactttatccttgtctgtacccagctttaaatcaaccagctaagctaactaaacaaagtgagtgctatgtgagattttaaaactttgttggttgttgttttgttgctttttttctaaaaaagaagataacattttggtcagagtgcatgtagaaagtgaatgatacagtagttgaaagcttgggctttggagtaggagtcctgagtatatacccttattcagcagcttctatctgtgtaactctgggtaaataaaacttcccttggtcctaatttcatcctctgtaaaatgtgaacaataatagtaactacccaaaaagagttatggtaaggttaaatcaggcagtagatgaactttggtaagcacttagcttggtgtatagttactgctcagtggtaaacattacaattattaaattatttaataatggaatttgtatcaaaaattttgttactttcatataagcagtgtatttataattatgtctttttttcctatgaaggaggaagtttctattgaagttttaaagacatacatacaggtaaactttgagaacctacaacctgattgttttttactattttaatgaaaacaaaactcagaatgatgctattttaattctcagtggtaagaaagcatcagaatccataagagatcttttaattatcagcacagttgacctttgaataatgcagggattaggaaaacaacccccaccgcc

SEQ ID NO: 70364 - DNA, 1050 bp, Homo sapiens
gtatacttttaattttattattgacatactttgatctttttctattttttagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcaggtaaaaatggttgaaaactttgtcttttggcctttctaggcaaatgttcattttggctgtagtaacatttgtccttatagttttaaatcttatttctgttgaggggaaaagaggaataaaattttcagggaatttctgttttaggactaaagttacttatgctgtaactcatatgtaaaatatcttttaattctggcattttcttttatataaatatctttcatattttacatattttatttttaaggaattactgttccaaatttactgaatcattatgactatttagagaatattagtatcaatgattaatctttgttttttgtcgcttcaaaaaattatttagatttggatgttgcaacaataacaaaaactgtagttgagaatattcgaaagaaagataatggtgaatttagtcatcatgacctggccccagccctagatactggcactactgaggtaatttgggatgggggggcagaggtttctataacttctaataatcttttatgttattccttggtgaacttctcccttcgtaaaagaagttctattaggttttcttttttaagaatgtgtctttgtcagcccagaccttttaaatttaaagtcttatgtaaaggattacttatagtagtatgttaaaggagcttctttaatagaaaaaaatctcagctttggcttgttgctcatcaggttattttaaatacttgattaatcactaacttatgtagcttgcttactcatattttcagaaaggaatagaaagttatatctaagaaaactattttagagtaacatttaaaggaatcacgtggttaagttggtaaggcatacaatatataat

SEQ ID NO: 70365 - DNA, 1035 bp, Homo sapiens
atacttttaggtattccattaggcttttcaaaggagcagttattattttagcttgtcctgttttttttttctacactattagtgctattgatttccttcctatttttaagattatttcagaaattgtagtgtgtaatttctgtaatcccagcactttgggaggctgaggcaggaggatcacttgagcccaagagttcgatactagcttgggcaacatagggagacctcatctctacaaataataaaattatttttttttttaaatagaaaaattagccgggcatggtggcacatgcctgtggttcttagctacttgggaggctgaggtaggaggattgcttgagcccggagatcaaggcttcagagagccatgattgtaccactgcattccagactgggcgacagagtgagatgctgtctcagaaaagaagaaaaaggttaaaaaagaaaagaaaaaaaaaagaaattatgtggttggttactttctaattattttaattttcaaattttttgtaagtaaatgtagtgggcataagaggtttactcttttttctgtacttttactgttcacatcgattttaagaaagatccatgtatgtataaaggaatgccaattgttttttctgcttgttttccttatatatctgttctgactcattaattgtattattcaaatctataggttctgtttttctgtttttaaaaattatataaagaaattataaattccattttccatgtgtataagcaaagtagtctgcaatgaagttgaccctccctgtgtgcccctccccacatcgtctttttcccagcaacagtcattgctgtcagtctgttgtgtcctctcaggcctccttagagctatctttatttatatgtataaacatccaaaggagtggtgattgttttctgttctgatttttgctctaatgatattcagtttccaactcattctttttatgcatgtttttattcaggacatagtaagtttattagaaatacaaatgcagaagcattttattttcactgtcatac

SEQ ID NO: 70366 - DNA, 1023 bp, Homo sapiens
ctaaatttttgtctcttgaatttaatctgaacaacatttacctctttttcgttacagattcctataactttaggtgtaatcctaaattcttattacgatgtgaagtttaatttccttggaatggtgtttgctgctcttggtgttttagttacatccctttatcaagtggttggtaatttttttttctttatgtgcctttttagcagatttcataaattttgaagctgtattccaaggtttagaaaatacagtatagagacaatagactgttgggaagaaagcataattgcataagttgtctgactcaaggtgaagagaagaaaggagacagagaaacttgggtgtgtgatgctcaccaaatacctacctgtttgtaagtgtataatatccatgcttaacagtctcagcttggggtgaagttattttctgggaaatctttacaaaatacctagtaagactttttacttcctaagtttgttatgttttctgtttactctttacttttaacattgttgtgaaggagtgagtatacttccagaaatctgaacagtaatgaaaaatttcagatttttagatgtttttgcctcaaaaattatactgctgttacaacttgtttattggcttttaataatgtgtctaatatagattattacaatattatactctatattaataaatatagagtaatttatattaatgaatatttttccatttgtgcaagcgcagtgccttgcctatagcagatattcattaaaaatatgttcatggattcacttacttcattaccataaaatcctaacaagtatggtttttgattcttatttagtggagaaaaaataacttgctgtaggggacagtgaaacggtattctctctatactgaaaaccttggtctggaaattctgggtgtgcctgcatggggaatcaaagccaaaatgtgtaaccaattttatttttttcacaaacatccactggttattaaactaaggcattcttgtttgaaattttaggagttcagtaatag

SEQ ID NO: 70367 - DNA, 3074 bp, Homo sapiens
ttaaacagctgttaattttggtttctttttggtaacagcgacacggagatccgcatttgtcgcagtttccaccgcgggcgggaagtgtaaacacaagaaatacaaacatagcgcaacggctaaaggagtgtcacagcgccaaaccttgctggctccgcgccaggccgagccccaccctctcagctcgcggccaacacccccaccccgcctcacagcccgccgcgcccgcggggcgacaccccccactccatcatcccggaggtggtgcggccgagccccggacccaattggcggaagcggggccggttgtgtgcgcgcgcacaaatgcccggatgcgccgcgacgacccgcgcgctcccctcgggcggtagggggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggtactggcccggcagcgagcggtcacttttgggtctgggctctgacggtgtcccctctatcgctggttcccagcctctgcccgttcgcagcctttgtgcggttcgtggctgggggctcggggcgcggggcgcggggcatggggcacgtggctttgcggaggttttgttggactggggctaggcagtcgccgccagggaggagggcgggatttcggacggctctcgcggcggtgggggtgggggtggttcggaggtctccgcgggagttcagggtaaaggtcacgggggccgggggctgcggggccgcttcggcgcgggaggtccggatgatcgcaggtgcctgtcgggtcactagtgtgaacgctgcgcgtagtctgggcgggattgggccggttcagtgggcaggttgactcagcttttcctcttgagctggtcaagttcagacacgttccgaaactgcagtaaaaggagttaagtcctgacttgtctccagctggggctatttaaaccatgcattttcccagctgtgttcagtggcgattggagggtagacctgtgggcacggacgcacgccactttttctctgctgatccaggtaagcaccgacttgcttgtagctttagttttaactgttgtttatgttctttatatatgatgtattttccacagatgtttcatgatttccagttttcatcgtgtcttttttttccttgtaggcaaatgtgcaataccaacatgtctgtacctactgatggtgctgtaaccacctcacagattccagcttcggaacaagagaccctggttagtatttttgtctcgtgtaacttttaagaataatttattttatgaagtgataaactaaatttcgtatacctcaattgtagcatggctctgtaaataaaattgtatgtgcatagcttaaagtgtgctacctctggcgtaactgcgtggagttaaaaactgttaagaactggtcagtatttttttagccatttgccacatttgctttaaaaattagttccattacattgttaagcgtggttgaagttacgtttgttacgtgactgatttttttttcctttttgacctcccagtatttaatttttaaaaatggtttctaaaagtcaaaaaagttattcgtgcttgttttaaagatttttgtcattagagaaattttaaagtaaaacctgaaaattccaggctttttgctccatgtttccttttagattttttgtgtgcgtacccacatatatttacatttgaatttaaatctatgttattgtcctgtttgttgtactaacaagatgaaactgtagttgttctgtgacttgcatccttgtcaataaataaagtctacagaattctttttaatggctgcatagtattccacagcatgagtataccattttaaaaattatttatgcctttactgataggtttttaaaaattgcctcctgtttttgagtattacagatagtgccgctttgtacatgcatcccgtgtgactatttctgtaagaaagattttatagaattataggctggcctcggtggctcacccctgtaatcccatcactttgggaggccaaggcggaccgatcacctgagatgaggagttcaagactagcctggccaacatggtgaaaacctgtctctactaaaaatacaaaaattagtcgggcatggtggcgcgcgcctataatcccctgctgaggaggctggggcaggagaatcgcttgaacccaggaggcagaggttgcggtgagccaagattgcgccatttcactccagcctgggcgataagagcgaaactccgtctaaaaaaaaaaaaaagaaaagaaaaagattttagagaattagaactcctgagttctcaattttactatttgattgctactggtaacttgctcaccaaaaggctctaacagtttcactcctgccaatactgaatatcaccaatctttaattattattattattattttttttgaggcggagtcttgctctgtctcccaggctggagtgcagtggcacaatctcggctcactgcaatctccgttccccgggttcacgccattcccctgcctcagcctcccgagtagctgggactacaggcgcccaccaccacgcccggctaattttttgtatttttagtagagacggggtttcaccatgttagccaggatgatcttgatcccctgacctggtgatccgcccgcctcggcctcccaaagtgctgggattacaggcgtgagtcactgcgcctggcctcttttattattattactatttttttgataaaaggtactgtaccattgtttaaattcatttttctctagtttcttggtgaggctgggcacctttcctttttgtttttgtttttgtttt

SEQ ID NO: 70368 - DNA, 3794 bp, Homo sapiens
tctagcactgtctcccaaagtgctggggttataggcaagagccacctctcccagccagctgcctttctttctgtaaggaaaattttactggaatgcaaccatgcccgttggtttacatagtagccatgctttttacttggatagaaccatttgtatgaaaagcttaaaatacttacagtctggctctttacagaaaaaaattgacccctaatctagttggcaggctccttgcatacaggtcatatgtcttatttgtaatttcttttgcagtacctaccactgtccagtgcatagtagaagctcaataaatgtttgtcaagtagatatttgaaatgtagactaactaagaggcagcatgatatagtaggaagaaaatgctgagttgtagttgagggacctgggttgttatctctgatctgttcttaattacccttgtcagcttgggttagttagttaggttctctagccttcaggaacctaatctttagaaagagaagattgataacaggacccactctaaagatttattcatttctctttgattctctaagttagcttgcaataagctcgttggatcagtacggtaagctcattggatctcagtaatttatggttgtttgtaaggcagtaagcaggtaatataaatagctgaaggaaaaagtaatctttgctcttttggattggatactgtctgtgatcacaactgatacttgatgattccatgatacttgcataatgattagatcctccccagcattttttccaaatcccctttattgaacttgatggatatgtttgctgcagggcctatagttctgggataattttggaagtataatagcagttcttttctctttataggttagaccaaagccattgcttttgaagttattaaagtctgttggtgcacaaaaagacacttatactatgaaagaggtaagctgaatcaagagataagtagtatctcactagttacatgtagccatacttaaagttttcaagaccatgtggagaaattggccatatagaaggatttttcattaagcagcaacatttaattttgtggtcgtttggactatattttaaagctgaaaattctaattatactcgagtttcatttctcagctaggaactcagataaatggaagccccgtaagggtgcttgaccattttatgctgtcaaccctttggtagactccttcccagaatcatgtttttaaatgtatgaaataaaatgtatagaattacaaaggaaacatactaaaatacggttaccaaaatagtaaactagtttgtgatatgtgtgcttttgttattaacataataaatactaagatttagaagaagatataataaatataatgtttttttgttttttgagacgaagtctcgctctgtcacccaagctggagtgcagtggcacgatctcagctcactgcaacctccgcctcctagattcaagcccttcttctgccttacccttccaagtagctgggattataggcacctgccaccacgcctggctaattttttgtctttttagtagagatggggtttctccatgttggccaggctggtcttgaactcctagtctcaggtgatccacttgccttggcctcccaaaatgctgggattataggcatgagccaccatgcctggccaataaatattatcttgatatagtgaggaatataagtcatattttgaaatgtttgccataagtacagtatgataggaaaacacctctgatttttgttggtgatgaaatcacaggtattaatactgttgtgatttgttgcctacatttataatcgaaggaaaagctaaattctagttagaagtttgtgaaaataagaatagaattttttttttcccatccaaattaatggaccccctgaattctatccaaggacttcttgggcatccctggatcccaggttaagaacttctgcactagagatacatgagtacagtatactgatctttctgggatagaggtgagctgattcatgaccatatattctatctaatggttccagcattttaatgcattccccacctttaaatttgtgcacagaagcatgattttcagtgacagattgagcaaccttaggcagaatttcagtgtgattgaaatatgcctgttctctgtctctcccacttagtttatgggactcagattacttaaaacatttaagtttctttcttacaacggtatagtggggcaggaagagcttccatttttctttttcctctccagctatacttttagaaacttccttaaaggatgtttggtagaataaatctaagttctcttcctttttcctttcccactgctggacagcaatctgtccaatccacagtcacataagaatattcctttaaggccgatgcctgcttagccagttaaatccaaagacagtgtttgtaggaaagggccaggttaaatggtatttttaaggctaatttgggattgaccttattatcattggataatcagttaaggaaacaaaaaagtatggatttagcagtagatagaaatgagaaaattggccaaggccatcataaagacttagaatgcttatgctaaactatgtaacagtagtgtatgtattgtctgatatagttctcagttataggatctttgttctggggcacacaggaaggtagtgaaagctagtatgggtagtaaaaagagcgttggattaagagtcagaagagctggggccagtttcttcttcttttttttttttttttttttttttatgtgacagtttctcactctcttgcccaggctggagtgcagtggcatgatcactgctcgctgcagcctggacctcgtgggctcaggtgatcctcccacctcagtgtctgcagtagctaggactacaggcttgtaccactatgcctggctaatttttgtatttttttgtagagatggagtttcactatgttgcccaggctggtctggaactcctgggctcaagggatctgcttacctcggcctcctaaagtgctagatttacaggtgtgagccactgtgcccaacgcaatttcttcatttctaatacagtgataataatcttatgaaatatcagaatgagataatacttataaaagtacattgtaaactgtaaaatgccatatgtatttaggtagttgttaataggtttatatctggatatcttaaaaatgtattgccaacttcttgtcttaatgcagcacagggaatataatttaacttttattaatggttcaaagtcattattttgattatttatcataatatggagtaaattgataccttagagggtttatttcattctcagaattctctcaaactgttttgtagctgtcattgattgattgtttttctgtcttcctcctctggtgacctcagaggctattgaggtttatagtatttatgactatttactaagtggctccagaccactgccatattttagttgatttttgtttctgcaacttttttggctatcagttttttattttgctgccttttcccttcctaatatgttagtatctaagtatctgggcagagttaaagtctacaaggaaaaaaacctcacattttaaggtttgcttaagtaaatagagaagcagttatttctgcttctgtcaaattaaatggaaaaggcttaaaagtagcttttttttttttttttttttttttttttgagatgaagtctcactctgttgcttaagccggagtgcagtggcgcaatctcggctcactgcagcctccacctcctgggttcaagcaattctcctgc

SEQ ID NO: 70369 - DNA, 1035 bp, Homo sapiens
catgtatatatacatgggtaagtcaataagtgttttacaacctactttccatgagaaaagccctgatttatgtgcttgctgacttccatagtataatactctcatttgaaggctaaaaacatggagttgggaagagatgtacacagtttgctttttttttttttttttttttgagaaggaatcttgctctgtcactcaggctggagtgtagtggcatgatttcgactcactgcaacctccgcctcccaggttcaagcaattcttctgcctcagcctcccgagtagatgggactacaggcgtatgccaccacgcccggctaatttttgtatttttagtagagagggggtttcagcatgttggccaggctggtctcgaactcctgaccttgtgatctgcctgcctcggccttccaaagtcctgggattacaggtatgagccactgcacccggtctcacagtttgcttttgagtgctgcttagagctgtctctaatacactacactgctcctaaagcccatcctcgaactacagttaagaaatgctcttaggccaggtgtgatggctcatgcctataattccagcactttaggaggctaaggcaggaggatcacttgagccgaggagttcaagaccagcctgggcagcatggcaaaatcctaactctgcaaaaactacaaaaatcagcttggtatagtggtgcatgcctgtagtcctagctactcaggaggctgaggcaggaggattttttgaggctgggaggtcaggactgtagtgaactgtgatcatgccatccagtccaggtgacagagcaagacctcatctcttaaaaaagacaaaaacaaaacaaaacaaaaaaacacctctcaggagcttgtttagttcctagaatgaattgaccactcccttgtacttcctctattccatattcagattttattgtaaaattgctttgttttacttgtgggtttttttgtttgtttttgagatgggctctcactctgtcaccctgcttgaagtgcagtggtaatcttggct

SEQ ID NO: 70370 - DNA, 2167 bp, Homo sapiens
ccacgtccggttaatttttgtatttttagtagagaaagggtttcaccatgttgaccaggctggtctcaaactcctgacctcaggtgatcctcccaccttggcctcccaaagtgctgggattacaagtgtgagccactgcacccacccagcctagggcttcctttttattacatcttttttgtagcatctgtttatactaatccaaaattcctggacaatataacctattatgtacaacttaagaaaattagtgtaatgccttacccatagtataaagagaaaattaatctatgataatgcataatttcaaaatgttaatgtccaggcatgagttcactgttaagatgaaaatgtttccaaggggggtagtaaagggtatttgatgataattgtctgtatatcccaactctgaaactttgacttttgagctcaaagtctgtatatccaactacaaatgaaacctatgtgcctgaataactcagtttgttatcttcccatccaatctgtttatctttctaaagtttctcttttagtgaatggtaccactcatttattcacccaagttggaatcttggaatcatcttaactcctttcttccttgccttctatatcaaataccaggtcttgttggtttttacctatttaatttctctggaatttgttttccatgccttagtttaggctttaatagtttttagtttgtattattgcaattgtctaatactggttttcctgcctctgccctctttttcttatgttttgctagagtgatttgtcactcttctgcttaaaattaccatttaggggttcattattgctctctggatgtaatattttctgtgagctagaaatcagtttcatttcttggacaaaaatcctttttaatggtgagtggctgcaacatcgcattaaggaagattctgaagtatctgcggggaagaatgcagtgataagggaatgacagcatgagtcctgctttggctagaccacaggatcctttacagtctgaacctgcctacattccagtaataatgaactgcttgtggtgtcctgcaacaggaactgttgttagtttgcttttggatactttttcacatggcgttttcttggtctggaatggcctttcctagccctattttcatattgtcctacaaaatatttcctgattctttgtttctcagacactccctgtccctaccaaaataatgactctcctgtctctctgctaatttatctaacagtcttttaatgtcttgattatactttactcttctacattaaagttgaattattttatttacatctgcaacatttagtatgaggatgccacctggaaaatacatgtttaatgtttattgaaaggttaaattgcataagggtttgtgttagactgatagcatatctactgagtagcgccccgccgccccccgcccaccaccaagtttctgatcctttttcttttctctcagaatcatcggactcaggtacatctgtgagtgagaacaggtgtcaccttgaaggtgggagtgatcaaaaggtaatctaagtaaatttctcattctaatgtaatattatttgcaaattggaaaggttatttacaacaagttagcttactggttatgttaagtttgttgtattttatttttttcctaaatgcttaggaccttgtacaagagcttcaggaagagaaaccttcatcttcacatttggtttctagaccatctacctcatctagaaggagagcaattagtgagacaggtatatatgaatatttatttgacgcattcacacagctttttgatattctttctctaatgaaattagtgcttttagacttaattaaattgttccctttttttggttgagatgaattaacctctgagtttttttcattcgtgattttatttgatttacaaattgcttatttagcaatatttttctggctgactacagcaggcacagtttactgtgccccactggagtttatagttagccaactctctgttaagatagtaggaggtggctggggtgtggtggctcacgcctggctcacgcctgtaatcccggcactttgggaggccgaggctggcggatcacgaggtcaggagttcgagaccagcctgaccaacgtggtgaaaccccatctctactaaaaaaaatacaaaaa

SEQ ID NO: 70371 - DNA, 2054 bp, Homo sapiens
aaaacataagtatctatgactcgagacatttttctaagaaaaaaaacccataagtattacaagtgttgtgtcttgttacgtgtattctaccaatttggacatagaaagatgagtgacaggttttagctcaaagtatatataattcagatgagaaacatgcctgcaaaattatgttttgcataatttatgtgtgagactatataattcattattatacaagtagtaaggataattaaaggtggaagagccttttcagttatggtattgacaaaggcttagtcaaagaaggatgaataggattttgaaactgaaattattctagttagagggggaaagtgtggaagttgaaatgccaagattagttgaggaagcaatctagatctggcgggattatccatatttagtaagggaggaggggtgtctagttgaagacagacgaagatgttaatacagtcacactgtaggtactttcgatgccaagaggctttggtgtttttcctttatgcagtggggttttgaacagggaaaataatgtagtaataaccttgaaaccttaatctagtttcagtatgcaggatggatctgaggaggaaatgtgcgtggcaaccggctccgggatggctggctggggggcctagtcttctgcccgccgatctccctcgggaagtcccggatcagagcagcaggcccatcccccaactgttacaccctgctggcagcagcagaggcacagggatgagttaggaaacagatacagaggtcaagaggtgatgtttattaagttatatatttttttcttgttttaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtagtattttttttcccctctaattatattggaaaattattaaatattttctatgttcattgactttgagattgaaataatattattcagatttcacttgaaatctttacctcttgatttgtttaaactaacacattggtttgtggacttgaggatttcatagttctttatcatctgatttatattattatattactactaattgccaagaagtcaatagacctcaatgaacatgcttattataatggtctgttcacttttaaaaacatataattcaactactgttttaatattaacttactttctataaaagtaaaacatgcatacagttaaagtcaagtagtacccttagagatctgtttcccagaagtgactgcctttaacatttctagctatttccctattatttaatatctccatattagttatttatgaagtaaaaccacctagctgaatgttttgttttattcatcctaaacatcctttgtattgacttttaccattgtgggtaaggatttctctctcctccattttttccccctttacactcacttactctatttgatattgtctaaggctttctcatatattgtagtacatgatatttgtttaggacttattactaggaagccttctgattgaaggaaatagggcgatgaattgatgctaatgaatgtgttttattaggtatatcaagttactgtgtatcaggcaggggagagtgatacagattcatttgaagaagatcctgaaatttccttagctgtaagtatacatctacttttttaagaaataaaaatttcattaaggtcaagattaggagactatatctagcttctttctgaaatgaactgatttttataaagttaaaatgtttttgtaaagtctgaataatttaaagcatttttcttttatttgttgtgatgagacctgtagctataatttttatttttaggtgctggaatttgaacttttttttttttttttttaaacagggtcttacccttctcccaagctggagtgcagtggtgcaatctcagtgcactgcagcctccacctcccaggttcaagtgattctcgtgcctcagtctc

SEQ ID NO: 70372 - DNA, 1755 bp, Homo sapiens
gaaaaaaatgggtgtacttactctactttaggagagactgttacatattgacctttaaaaatctgttttgtgtataattgagacatataacgtgatgttttgacacacatgtaaatagtgaaatgatcactacagtcaagcaaattaatgtaatccattatcttgaatagttaacctttcttgtgtgtatggttaaaatacctaaaatctattcttttagtaaatttccagtataccaatatataactaactatagtcctcatgctgtttacagtgactattttatataaaacatgaaacactgaatattgagccctatgatatactttaccttagacatagcaaagttgctagcattcctgtgactgagcagttaaagggttacagaaactgactgtgtgtcttatttcattgaaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccat

SEQ ID NO: 70373 - DNA, 1133 bp, Homo sapiens
ctgacctcctcagagaaggtttggaaacctgggttatgggggtggggagaatgagctaccctcctcaaattcacaaatatttccttaaacacagataatacaaatttttcataatgccatcagaaatataattagtatacttgtcaaagtgctacaagaatgttgtacaagtgtaatatgtcaaacatttaaacccaaactcttctccccacattgggaacccagattcagactttaggtcaatgcttagcttaacatttaatgtcttatcatgggcctcttatttagtatgccctaaaaagcacatcaaaaagagaacaaatgtttatgaaggcaggtggagctcttttcttttaatggatcataaagcaatgagcttccctgggtttcattggcgttagctaatgtgacagggtgtagattaataatttaaaatagaaatatacttggaactagttcactgttggatcagagtcatcaatgaaataaggaaaggtgattttctcctttaccctcccaggaaggcaggcagactggcttttatgttctggagttctggactctctcacctcttgccccactccagatcactgggtggctgaggctatagccccttgaagactggaggtttatcttctagagagggcaaaatagagtctctggagtgagagataccagacataggtgaaggaatggtaccctctgtggaaagcataggtgtagcggctgcttgcattttaatgcccatgatgcaggtactccagacctgtctcccactcagctcccagaatctgacagtttcccagaccttaccctccaggcaagaggctggaagactcttctctgggaaatttccaaccagcccaaagggaaatacttttaaatactgacatggaggttaagggtggggatgaggggagtcaaaaaatagtctacccaaagcaccttggacctagagtaaaggtcaaaattaataagcctcagctttgaacttccaatcagtctttactcccccatcctcaatctggagctttagtaaggaaaataggcaaaattactatactccatcagcttatattctaatggccgtgggaatgggttgggggcagaaaataacgaaataaaatatatag

SEQ ID NO: 70374 - DNA, 2981 bp, Homo sapiens
ttttttaatgagtgaaaaagaaattaagaatggaggggaaagtttcaaactggagagacatctttgagtaaagtatcgtggctgaatgttcctacctttattgaccatgtgacctggttaaatcacttaggttctattaggcctcagtcttctcttctgtaaaatgagatgtttagacctaaggacacctttccagttcccttcccgttgggacattctaggattctgagagagaagcccccctggcctcaagatacctccactctcttgggtgtgctctaagatgactgcattcatgttagaagcatctgaactacgccagagacaacctactgtagatctaaggaagaaaaaatgaatggcaatgaatgcgagaggaaggtgggggggaaagaagcccacgaagattagagatggaaatggcaacataaacagcatgcaaagataaccactgacgggtatctagcgtttacgatgcaaataaaactctgctggtctctgaggatgcagaaacaagacattgtttttggtcttaagccgttcacagaatgcccgggggttacactttgcatttaagcacggacatataacttccacctttaaaagtcctggatgtgagaaagataagaacaacggataaatgaaaatattaacaaaacgtctgagtatgccagaggccacgtgaaaagacggtgtgtggaaacaggtgggacccactgctaagctggatgcgcgagtaggacaaaaaaattggcccccactcccgggcctcacccagacacaaaagaaacgtcctctgccctcagaggcgcagcctttcctcagccagcagagcggctgggctgcagagtccccgcccccggccggcccctgtcgcccgcgcctccctccctcgggcctcggaagtgacgcaagcgcccccccaccgccgctagatccgctgctgctgccgcggcgggcagacctgcaggaggcggcggcggcggcggcggccgaggctgaaggaagatggcggacggcgtggaccacatagacatttacgcggatgtcggcgaagagttcaaccaggtacgtgagagcccaggtccccgccgccgacgcgggcggcgctgcggccgggaagctgacccggggcccgctgcggccgcgagccgaagcgactgcagagtgtgcgcccttgccgcctctgggccgcgccgccgacccctggcgtggcgcccccccgcccctcgttctaccgcgtcgtttcacgggccgcgggcgcggcgagtcgccgcggggcccggagcgcggacgcgggccgctgtgcagctgccgccggctcctccctcgccggcgctgcctcgctccctattgttggcggcacccggctggcgcttcccgccgcgctaggcccgggcggtggggccgcgtgtaagcggcggagagaactggccgccgccgcgccccctcccccgtcgctggtcggaggaggaagccctggcggggcgcgtgcccgccgccgccgccccttccccgccgctgccgctcgggctccgattcctcccatcgctccattttgtctccctgcccgcgcactgtcgcctcatggaaggccgcgttcacggccctttgtatcccgcgcgcccagtccccggggctctccttctcgggtttgcgacaggtttcggcgtggcgccttcctcctcccctcacactttctgaaggcgactgaggtgcgggctcatttgcaacaagtcctttgacttttggagccacagataaaagtcggtgcgctggtcctgcctcattaatccagggcttgcagtgctttgaagcccagtcgttgttggcctttgtgatgaaaatacctgtgaagatgagtggccggggaccaaaaggaagaattggaagcgcgatggttggatggaacaaaaagatgttagctcacccacagatctcatagtgattaaaatgaaagaacgttcaccccaaatccttatgatgtggtttaaaaataaagagttatagataagaccctattttcgaaaacaaagtgttaaatccccccacccccacccccgggccccgtgttaccttttgaaaggttgagcgaaagtgagaatgcaaggttttcctgaacgacgttgcttagaggtaacgcggggctgtgatgtctgttaatgggcatccttgcaaaagatgtcgtttgttgctagtgacgtttaaggtttgaacctgctgttcgtatctactgcattttatgtagtaacacatttaaaacaattaaattgtgcttaactgcaatgttcctaaaagccttatttttttgtatttcccaggtccctatgagaagtttaatgaaatattactggctaatgtggttttcccacctccattaaccatcatattcgtgactagttgctcaggctttttaaaaaacaaggaaactcaagagatctttactgttttatttttcaggaatgactttgtgcctctggtttaaatattagaaaacagaaaaataccagttggctttaaatgtttgctattcagttaaagactggatttgtttaaatgtaatacattgtaatcaaaggttaagtttttaaatctttgtgtttttaaaattgtgcttatgttttaaataataatacttgagttgtgtccattacaaatcagatacattcctcgagtgcaacacaggttctaacgcttataagacctctaggaaatttttttccttttatttatcaaatgaatataactgcgtttaaaagagggctgtaactgcaaggaacaacgattgagtgttcaagactgcctttattagctttacttacaagataatacattggttcacctttctatgcacaataaaagaagaattgggtctcaattttagaagttaagcttttttcagtacctcttaatgaaatatttttaggcttttgcatacttaatttgagagggacatctcccttatccggatagctgggtgg

SEQ ID NO: 70375 - DNA, 1067 bp, Homo sapiens
agaggcaaccacaaaataatttacaactgatttaatctttactagctggcgaccttatttctactagttgctatagtagactagaactcttgttttattgtcgttgagtaaaatactaaatagtagccagttttgacttactttggcttcaaagctgttgtaaacattaaaaaaaaaatctttgttttccagtgtaaactgcagttctcattggatttgtatactttgaaattcgggatagtctttatttccattttctactattttttgtctgtatcctgctgagtcttctattttaaatgtcatacttttatgaagcttttttgtattttggtaaggcacagtattatttcaaaaagtgatttgcatctattgaagtagaaaaaagtgaggcattcaacagtcttagcagaaactaatttggggatagattgagaataataaattagtgaagctctaatagagtgcctttcttcaccaggtgaacttaagaatggagaatgaaggggggaggaggcacaagggactggctactccttatgggttctctttagttcttagaggtctttggatgtcaccaagctgagaacagctggaaggggaatttgaacatcttccaaacctctctattacttgaagttgagaagaaagtgattctgtctcacagtagcatatcaattcagtttaaactgcatttatactcaagtgtagtaattactagcccaatatttagtaattgtagattttaaaattctggccaaaactaaataatttaaaagttgaattgtttagcgcgagtgtggtggctcatgcctgtaatcccagcactttgggaggccaaggtgggcagatcgcttgaggtcaggagttgcagaccagcctggccaacatggtgaaaccccatctctatcaaaatacaaaaattggccgagtatggtggtgcctgcctgtaatcccagctaatcagtaagctaagcaggagaatcgcttgaacctgggaggcagaggttgcagtgagccaagatcgggccactgcactccagcaagaccctgtctcaaaaaaaaaa

SEQ ID NO: 70376 - DNA, 1264 bp, Homo sapiens
taatgaaaataaatttcttggacaaatatcagagaaacattgtttatgatttatttatgtttactagaaaaccatctgaaataaagctgtcaggttgagaatgagctaggtagaattgattcagaaaaatggatagaaatgttcagggaagctagaactcttctctattttgttatttatgggtgcagttaatttagttgcctgtgaattgtccactatggtttatgtggcatatttttagtaccaaattccttaccattatataaggaagggatttttacagggattactagccagttttaataactactgagaacataattagataaaaccagaaaatgatatattttctttaaaaatgtatgcattaggttatctgctattggattttgcatactagtatttcttttccgaggtataggatatattttgtaaatgcaaaatgtaacttccccccttcatatatttctctaaatggaaataatttaaaataggctttgaaacaagtggcctttgctgtgcatttactgatagtatcatataatgcacgaattttgtatgtatttatgtatttttatggtagagatgggatcttcctaagttgcccaggctggtcttagactcctgggctcaagggatcctcttgccttggcctcccaaagtggtgggattaacaggcatgaaccaccatgcctagcctcgaatgatattactgtaattttagaaccatcaaaaaaatatcaggcctgtcagggagaatgatgaatattttgacagccaacaagttcatcccaatagtggtatacagtatgtatcgtatatctgtgatattaaaattgtaagaggggtaattagggaaaaaatgtctaaaagtaacttcttgaagggagggaggagacagggataatgaaaaggttgagaagccatactttaagggaactaataggattttggtcattttgccatccattttctctggcttggcaacagatatttgtatatcatgtggagcataatcttgttgtgtaaaatgttgagagaataccttgtctaaagaatgattgtagtgatttagaatggtagggaatgaaaaaaattagtgagttttttttttttttaaacaaaccctaagagctgttgtttattccaagctttatgtaacatagctggctagctactatgaacagcagataagattgggcaacatttggtatcaaagataattagaggaatgatgttgatattttcttgttttttgaatgcc

SEQ ID NO: 70377 - DNA, 1815 bp, Homo sapiens
ttcagtaggctcacagagctttatttatatatgacctgtgatatacattttgcataatttctcatgcaaacatcatgcatattttctcactttatgaagtaagaacaaagttcagtatgttctgtatttttttttacgctggaggattgatgtgatatgaagctgattaaaaggaaggttactgataactacaaaagagtgtgctttgagtttcatttttagtaatggcagcaaatgtattcagattcattatgttttttcacaaagtttaaatgtataccattggggctaagtgtacaggctgtggccttggaacagagagaagctaactagtccacatggagatcaaaccccaggaccatggtcttaattaggatcgtactacaaccacttggaagcagtacaactaccagacaaaatggctgatcctaaatattggtagaatcatatcaatgtggaaaattggtttgtgtcaacataggaattcatggatggacaaaaatagtaagtgattgtgatataccaggttagtgtagctgcaattatgcttgtaaattttttgtctacttatgtaaacattttcacaggtttgtagctaatagaagaaaacaaagaatctgttcacctatttatgtaagtgaaagtgtaaatttaaaaatacatttagtcctgctgttaataacccttccattcttttttactttccctcagaccatatattgtgattatagtttctgctgaggaggatggaaactcaactccctttgaataatattagtaattctacttgatgttcagaaccggattgcaagagagtttaaagtgcccaacaccccttgtgggaaactttttagtatcttaagtgcatggaactactgctgcagccacaccgcctgaagcttcagccacactgaaacttcataacaaaacttaccctcttttttcctaatttctgtggtcattgcaatttgagcatgttactttgtttaacaaaaactcatttcttaaagattattttagtattgctgtacaaacagaataaaattatggcattattcagtgacttgtggtcttagtttctgccctttgttaaatttagctttgttctctgatttaaccttgagatcccagaccccttattaaataagtcttatagacattctacctcgtaacaagtaaaattggtatgtaaagattctgtaactagtaaattggataagtcattaattacataaacgattacctgatgattacttgaggtccctttatttaggaatataaatgatatttcccctactaggcttttttctttttcttttaaaaagatcttattctcggccgggtgtggtggctcacacctgtaatcccagcactttgggaggccgaggcgggcggatcacgaggtcaggagatcaagaccatcctggctaacccatcctgcctaacacggtgaaaccccatctctacaaaaaatacaagaaattagctgggcaaggtagcgggcgcctgtagtcccagctactcgggggggggggggggggctgaggcaggagaatggcgtgaacccaggaggcggagcttgcagtgagccgagattgcgccactgcactccagcctgggcgacagagcaagactccgtctcaaaaaaataaataaataaaaattaaaattaaaaaaatacaaaataaataaaagatcttattctggctctcctttaaatagcaaaacagtagcctgggcccataatatcttgttgctctgtttaccatcatataacaaatgcttttctctgggtcattctatccatttagggac

SEQ ID NO: 70378 - DNA, 2925 bp, Homo sapiens
aataaaatggttcacaccaatacaagtacttagttgtggaaagggagagtagaagataaaaatggagattttcctgtgctacaggcttagtcaagcttatggtctatttaatggttatcaaaggcaattaaatagtgttgagtgttctgcttttacctacatttcatttttcatgtacttagttacaaattgaaccctcttctatttttttcctgctcctgtttctgtttcattttagttttccttttccctgattatcatttaggcatgtaagtgacacccagtagcattgctttaattctgctggtgacagtgccaaagctttactatactctttttgttgtctgttgcttttctcttgctaatttgcttgactagataactaagaattcaggtaagcattagctctttgttcactgagaataatacaacttgcaagataattaatttggattgttctacatgtatttcgtttatttctctttaccttgttcatttattacgacattttgaattatttacatacccatatttcttctttcttttatggctcagctcactatgcttttttttaatactggtagcttcctcaaggttggaaaacaagatctgaatactatagaaaataataactatttttctgtggtcatattaaagatataatggctttggattttggggtgatttttctactgtcagtttaaaaaaaacttgtctatttgcatttgtgtgttattacttctagttaagagtatttccaaggaaagtttcatgttacttattttgtttccatgtctttttccaaaagaacttattttttatattataataaatatcagtggaaaagtaggtttcgttatatagaaattaactttaggctgggtgcagtggctcaagcctatatttgggaggccgaggcaggaggattgcttgaactcaggagttcgaaactagcgtgggcaatgtagcgagacctggtctctacaaaaaaaaaaaaaaaaagaaaaaaaagaaaagaaataaaggaaaccccctttttttgtttttttgtttttttttgagatgaagtcttgctctgtcgcccaggctggagtgcaatggcacgatcttggctcactacaacctccgcctcccaggttcaagcgattctcctgcctcagcctcctgagtaactgggattacaggcgtgtgccaccatgcctggctaatttttgtatgtttagtagagacagggcttcatcatgttggctaggctggtctcgaactcctgacctcaagtgatccacctgcctcggcctcccaagtgctgggattacaggtgtgagccaccactcccggcaagaaattcactttttagacctgttcaagaatacatctattgcataaagtggaaaaagatttgtactgaaatccttggcctttttccatcagatttttaaaacaaaaagttgaatttgtattcaagtctattttagtagtattttgacttttgtataatctagagcattatttctgtatctcaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatgggtaagtgaagttaatataagaattaaattattggtaattgattttgaactgctctagtaattaatgtttttctccagatttttataagtttgaagttactgtgtttttctatatgtgtttgcttgtccaatgaggagggaaatacaaatatctttgcaacatcgttaattcgaattcttctagttttgagttttgtggtcattcaacttttcttggtggagatactagttaaatatagttaaattagttttgtcttcagttaccttttttatgctaccactttaccttgcttccgatagcccagtttcactaaaaataatgctcacatggggtctcaaaccaggattcaagtgtaaaaggaaagagacatagtatcactcctggtttaaaaatagtgtccattatttaatttgtgttacaaatttgagttttatttctgcccttaaatttgaaatctgatttatagaagcacttctgtgcgtattatattttaatttgggttgtcatgagactaagattattgatttagagcttcattaaatgcacatatgtatatttattttttattaatattacatcttaagtatcattaaaatagtcctatagaatgtttgtatttctacttagttatatgtatacttgaaagttaaaaacttgtatatgcaaaaatcaataaaacttggcacccttgcatttccttaataacactgtatttttaaacgttttatttacatttctttttttcagggggagacagaatttgcaaaactctgtcacccaggctggagtgcagtggtgtaatcatagctcactgaagcctcaaactcctgggctgaagtgattctcctgtgtcagcctccaagtagctaggaccacaggcatgtgtcactctgcctggctaattaaaaacaaaacaaacacttttgtagagctgacttcttgctatattgcttcaggctggcctcaaattcctggcctcaagtgatcctcctaaccaagctctcaaagtgctaggattatggtgcccagcctatttacatttcttttaaaactaaatgtaacagatctcccaccacccagtctgagtattctataaaattggagacagtagcagtgtagttatgaaagtatggttgctaagtaagtatttggatcttagctccaccatctattattagttttgtgaccttgt

SEQ ID NO: 70379 - DNA, 1490 bp, Homo sapiens
aatgaagttaggttcccagatggtttttgtgctgtttaaaaattggagtctgactggccataactagacttagatttgcactcagcatttattttctcttttatgtctcaaatttccccttaaaaactagactgggataataaaaatcttggttttattttaatggttaatgagggggaaaatatcttgcagtggacaacagatgaagacttaactgaagcagttcattctttgggagtaaatgatattttggagataaaattttttgaaaatcgggcaaatggccagtcaaaggggtaagttttttttttctttctttttgatttagtagctagtgatacagtttttacaagttaactttcctttaagttaatgttaattacacatgtatacacatgtatacaaacaacacatgattgtttacattggaaggaggttcttgggcaaagattgatacttttcattttacgtaccctattacctaacacactaaaaccagtagagtggaaatgtggacagatttattttctatttttcccaagttttctctatctgtggttgaaatggttgttgaaatgacagtttaagaaccattactctccctgtgattaagagatgggagaagatgggcaactgaataatgtgttacatggatattttgctttatttcactactaaactatacaagtgggatagcctcagcatgagaacattataaatacagatatctaaaagtaagaaaataaaataccactgtcctaccattcattgatgtttacttttaacattttagtgaagattcttttgggctttttcctaaaaataaataaataaataaataatggaattataattcatgtgttttatatgtttgatataaggaataaaaataaatacacatcctctctaatgtctaattcttttgcatcatacctggtatgctactgtaatttacctttcttatttttggttatcgtggtggtttccacttttgcctattgtaaataatgttgcagcagacatcattttatataagtcttttggtacagattttggattttcttttaaggataaattgttagatgcacaatgataaagaattttcttatttcttatattgcttacttatcttagaagattataccaatttatactaaactgagaatattttcaaaatatatgcagagtctgaatacttctcactaactttacttataccacttggtcaaagccactatcatctctcacttaaactttggcagtagcttcctaactggaagtatagactgccccctacagtctgtactccacataacagaagttctaaaaaaaaaatgacattctgctcaatcttctcatggtttcctgtctgtctcattctttaccattgtctacaaggtactttctggtctgttttcccaccacctttctaaccctatcctaccactctttttcagccacattagtctctttgctgttggccagaccaa

SEQ ID NO: 70380 - DNA, 3188 bp, Homo sapiens
tcagcctcccagcgtgggactacaggcacacgccaccatgcctggctaatttttgaatttttagtagagacggggtttcaccatgttggtcaggctggtcttgaactcctgacctcatgatcctcctgccttggcctcccaaagtgctgagattataggcgtgagccactgcacccggcctctccacatctttaatacttgtctttttgattatagccaccctagtgggtatggggtggtatcttgtggttttgatttgcacttccccaatagttaatgatattgtacatctttttattgtagcaaaaagtggaagcaacccaaatgtccatgaactgatggatacatttcttttaatgttgtatatttataatggaaaattattcacccataaaagtaagtggtgatgcatgctgtaacagtggatgaagcttgaaaacatgctagttaaagaaggctggtcacaagggacctcctattgtatgattccatttagatgaaatgtctaggataggccagtccagagacagaaattaggtttagtggttccatagggtacagggatgggaaggaatgggagcgatggctaatggatatggagtttctttttggggtgatgaaaatgttttaaaattgattatggtggtggttataacactgtgaaatactaaaaaccactgaattatatattttgaatgactgaattctatggtatgttatacaagatgaacaaaaatgtgtactcgtatagttaagaaatatttttagtttttaaaattatttatttttagagacaggatctcactgtgttgcccaggctggagtgcagtagtgtgattataggttactgtagcctcaaactcctgggctcaagcaatcctcgtgcctcaaccttctaagcagctgggattacaggcatgagccactgtgcccagctgttgttttagataaaagcagattaagacctttttacagaagaataacagtaataatattgatctctttttactttgtatcctcaccccttaaacactttttaggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaagtaagcagtcctcagaggcttttattaaaatatgtacattttaaccagtgcatttgttaggtgttatactagagaagtcatcttaatactagctcactaggaactccatttcacaaagtccatgctttgaattagatttaatcactggttatgactgtgggcctgtgtacgagaaacctactcctgttccatttttctccagatgtaacagacccaatactatacaacaatgtgcaagttctatagccctgccattcttgtcctattatttccatcttagatacagaaagaaactacattctaattcttagattaaaggagagctatgtggatgtgtattatggtgggggagagatcactgataaccagaaaatgttcattgatttttctgcttggcaacaagacctttcaccacttggtaaactgaatatagaaaagatttgtcattatacatttaagtacattatctttaaagagatgagatggatgattatgtaattaacagaaattcaagtggttccttttcttttaatgttttagcacttaagacttaactgaagaagtgtgttacaaaatttaaatgatgtaatactgaaattaagatatctgttgaagaatttcggtcttggctgctgcagagtgctggtattttgaaagtaactcacgattacctatggaaaatatatttaaacctggatattttgagtctttaaaagtacccaaatagatgtgaatgttttcctaaaccatactttcttatgtagtttgcataggcacaaggcatttgcaagttaatatattagaaatagagttgtttttaataatagtggttacatttcagaaaactatttttaataagtgctatttatgagtatttggatatttgcagctacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccaggtaaaacttttcttaaattaccatggataaaacatgtctacctaatacctcttttccttttctctctttttcaagtaatgcattattaatgtgacttactctccttgttatgctatttttggaatccaggaaatttgatcaagcatcttgttaaaggaactcggcctttgttcctggaaactaggattccatggcatatggggcacagcatagaggaaatacccatttttggcctaaaaggtctttatttttctccaaacttgcttgacttatatatagaatatttacatccgtcttactttcttacctcttaaaaaaatcctttcaagatcatttttccttgtttcactttctagcttggcatcagagtagaatataaggtgggtgatttcactgtaagaagtgtgtgtacacggaaagatggaaaatatctctaggcattgtaatatttttttattaaagttttcgtttcaataatttttcttaagcataaattgagctagttaaatttgtaaggatatacttcattgtagttggtagtgtaacatttaccatacgggtttaatttaaagacaaagacttggtgtatgctctatgcgtttaaagtataatcttggcatataaaagttaaaatatcttattagtgaagtgtttttttttctctctttctcctttgttttttagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccac

SEQ ID NO: 70381 - DNA, 2144 bp, Homo sapiens
ggtccaccaccaacagatccatatgggcgacctccaccatatgataggggtgactatggcccccctggaaggtaagttagtgtgtatctgtgaaagtacttgatgataaaagataggaacaatgactgtaaatattagattgtaggtatataaatatgttatttctgccttccaagaagatgaggtgtttaagctgctaccctgttttagctgaaagatactggtataggagaatttttagatttgttctctttgttggaaaagtagcatgcttcaatatggaaaagtaactactatctctaaagcacatgtcagaagcagctagtatgaattgctatacactgttgtgactaactgaggaaatctgttgagtatgagttaaggtttatgtttttgttttacagggaaatggatactgcaagaacgccattgagtgaagctgaatttgaagaaatcatgaatagaaatagggcaatctcaagcagtgctatttcgagagctgtgtctgatgccagtgctggtttgtgtatttcttgtattaatatttcttatttatgttattaggaatgacctaaaaatgtaagtacaatctagaagataggtcatttacatgtagtagttctttttatattcccaaatcattacctacgatttatttaaaaagcattgaaaaaagttgtgtgtcacagtgtagtggggaaaatccaaattttaagttatttggtatagatttaagtcttacccttgacatttaatggttcaggggcctcatgacaccttatttattcttatatttgcaaaatgataatgtgcttcacacacgtataataagttgagtcaatatcatgagcatgaaaggcttttgcaaatggtgaaacactgaaagaagacattgtcttgcatagttattttatagcacagtacttttgtaaaatgccttatcactcttatcccaagtggtttgatggtgttttgaaaacaaaatttgtttgacttcaaaccctttcctttccctcacaggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaaggtaaaactttcctgtctcatttccatttaaaaaaactgttagtttacaaatggaaaaaatactgtgagactttaaaaggaggactttgcttttacttactgattatttagcagctggagtggtttttttttttaactctaaatgttagttgcttgcttaaaaccctttaaaggctcctactcagtcttaaagcaagactgtaaagattgagggactgtgtgataaagcccctgcctatctttttagcctcattttgtacctctccccttactcactgttctccagtgagtatttctccatatttctccttttctttaggtacaccaaatgtttgaccacctcactttatattccttctgctgggagcagttttccctgtctcttcacatagctggctccttattcttcacgtctcattctaacttcttagggtggggcttctcccaagttagtctgtcgtattgttctttttatttcttccatagtacttaccataatcaattcttacttgttataaggcatatttttcctcattagaacacatgttgaatgatggcaggggatttatctatcctgcttactatatttcttttcttttaagagatgggtcttgttaagttacccaggctggtcctgaactcctgggctcaagtaatcctctcagcttggcctcccaaagtgttgggatgataggcatgagccagtgtgctcagccatgctcgttataatatttctaatgcctacagagtgtgtggtacagaatgagtgctaaataaaaatttctcgaatgagggagtgactgaatgaatgaatgatctatcttttaggtagttcctttttttttctttttagcattgctgctaactttgaaattttatatatttttgaaaggcagacctaatcttcacttggtattcttagatatgtctttagtgtactctatctggtagtaatctgtaagagaaaagag

SEQ ID NO: 70382 - DNA, 6298 bp, Homo sapiens
ttagccctctcccatgcctcttctcctcccctgaatataacatgcgtattagaaggtttctttgtgttggatgctgctcatgaaccatatgttaagaggttgtcatattcatgtatttaagccccattgtgtgttgtgatttcatgacttttatatctaaaaaaaccatattgtagatgttctttagcttgaaacacgagtgctttgaaattttccctttacctttctatttgtgcattcagtaaatactacacatctgttttaggctactagtttaatagatgatgtgatgcatttctgtgatgtgtctggttgctgatttttttgttaatgtttttaatagtgaaatttctggttcatgcttacctggtgagttggtaagtcgttattggcagctcaggatagtaagtttaaaccagatttacaaagaatttttgctgcctaagtttttttagacatcaaaaaattgaatatttttaggctatctaattatggagagcattaatccagtaatttcttttagaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaaggtgggtattccttgttccctgttaaatgtgtgtgtattcttaacagtaactataactccaaggctactgtttatacagtatatacctacattttaaatggtccaactacttgtgaatttaatcttctggaaacatctgaaacaaattataggtaagtaatgacaggtaaaaattttgaccctttatcttatgaatattttattgctgagttatcactttcaggtttcaaatagttaatggtcttaacaaagcaaggaaataatcaagaggactcattgtgtacttctaaaatctaaaaattggggttcttgtatcacatacataggttgcatgcaatttaaaatacaaaacacagggagttatttcacatatatgttatgtgtttggatttttaaaaataaatggaaagttactatttttgaactagttttatttgtccctaaaaatttatgagaaaatctaacacaataatagtttataatacaggagggtgttttctcaacattcaaagagaattttcctttaaaaaaaaaatttttttttttagaagagacactatcctgacatctgctttttgtttttaaaagaaacagtatcctttaatttgcaaagaagatgtaaaagttaatcaattaaaatgggtttagggtgcactgatttatatctaaaaattttaaattgtgtcaagccatatacccaagtttagaataccttgaaataattttctttgatgtttcattcataaatcataatcattgtctttttttctgtattttaaaactttcttgtgtacatttttcatgaagtgggaagagttgtctgtttatgcttcattttcacatgtaattttattttttatatttgttaatagcatttattcatgtgaagagctgggggagggcactataaggcttatgcatgtgacacaaaggttattctgtaaattaaaatattttttctttatatgttggttggcatattcaaattaaattaaggctaaacaaacccctcataggtaaatactctttatgtgattattttcagtaatcatgggaaacttactgaaaattcagtcatggtaattgttagtatttaaattgttatgggcaaaattaaaggttttatcaagtgtatgtaattctgtgacagaataccaatttctttaaccataacagatacgcaaatgaagtccttaaatgcctagaaaataagcatgctatttttatggaacacagatataagctcctacactatttacaattttaagggctttttgagttaaaaggctggttttgatactttgcattttgaatatgcagattgaatatcaaaactttaatttgtagttttccatgtattacaaaatttaatataaatctcaaaacattcttttaatatgaggcaaaaaaaccttttacttttaaaactaagcttattgaaattgatattgtttttgaatgtaaaaattgaatgttgtattatgtaaatctaaacactaaattttaaagatgtagcacttttttcccctgagttaaatacatctgatcccatcttaatgaaaaaattctcaatatccatcagttgcttaaactggattgtgactgggttattagttgaaatgcttacctatgtcagtcatttccattatagaagggtacaggttctgtaagttacctatttttttggactttataagttatcagcaagcttcttgttagtaaaggcatgataatgaaacttgaattcatctacaaaattggatgtgcccatcaaggggcctctaaaccaatttaagcccaaagttaactaattacaatttctactggttttagtaaaactagcatagtcaaccaagtaaacaaagtccattgttaatcttatttgagttagctaacattacattctagtaatgggtacacctaaatatatcatgacttgagtttcattacattcagacataaactacaaattcctaatgtgcaaactattgttgacatttttcttaatcactgatgtaccataccagaatttccatgttttgtttgtacattaatcagaattgagttgtaatactgtatgtgccttcatccaagaaaaattttacataagcatttctagtgcaaaaaattctgttatcctggattattgtacgtttgctatatcaaacagtattgtggatgtagacttgaataaaggggtggggactgggattaaatatattcaagtaaatctttaaaacaaaagctatctgcaaatttgatcaccatcataataaggtctgttgacctttttagaagttttaaaatatgagtccttttgagctttcatgtaaatcttaaatggaccaaatggactgagtgatttgaaagctaaagtgaatgtcactagtaaggctgtatacaaataaaatactaatgtaatctattaaagtgatgatgaatggctaaaagggcaagttcttaactttttaactggaaacgtaatgatcttggcaagctgttaatgtctgtcccatcttaatttttttttgtgtttgaactgttggtaatgttaattgcattctctcattttaaaatgtattggtttttctaaaagtattcaatatctaagttcaaatagataatattttaatgagaaaataccaatattgtaaatttcagtatgtaaatacgttgtgcttcatattctgtaatttctacctctattctcagaccactctgagcaaaataaaagtagttcagtgctttacgattgtacattttttactgaaataattttagtttcatagttgagttacttaaaaggttacgttcctcttgtcacttctttggaacatccctactcagcaaatttgtgttaacaattcagcttttctttgtttactgaaaccaaattatgtttttttaaaatactctttattcaggcttttcctctctctattttatgaggttttacaattctcaaatcatccatgacaatttttaagcattgggtatggggtctggattaaataacttgcctttgctatctgattactttttttttttttttttttttgagatggagtcttgctcttgttgcccagtctagagtgcagtggcacaatctcagctcaccacaaccttcacctcctgggttcaagcaattctcctgccttagcctccggagtagctaggattacaggcatgtggcaccacgcccggctaattttgtagttttagtagagatggggtttctccatgttggtcaggctggtctcaaactcccgacgtcaggtgatccacccatctctgcctcccaaagtgctgggattgattacaggcgtgagccaccgcgcccagtctagtctgattacttttttcctaccttaaatatcatgatcttaggatcttagattttgttattgcccaagatttaggatgctttgcattgtgtattcagcttattagctttgtgttaattttgaaaaaaaaaaaaaaagccaaaagaataaaaaaaattcttacatgttaaagatgtttcattttcttcttagtgttgctttgaggcttatgtgaaaattaaattctcttaattacctggtgaatgatactggttataataagattttaaaattgtttctgcagctcttaggttatctgaggtctgcgttatagctcccagccctgtttccttgttttcccatgtatcctaactgctctgcttcatctggatatgtatgctagctttcattgctttagctctgatttttctttgagtattcacaaaacctgtctcactacacagctgacttaattgaagttacaagagggagtaggaagtgatcccttgaatggatgtatagtgtgttttgctcactgtggtttaagaatatagttttgtttacaaatgattaatgttccctgttgaaaaaaaattcaatgccagtgtgagtcatcttgctctctcaccgtcatctcagtgttaaatttactaccattgttttagtttgtaaaatagattgttttgagtaaattctgtcttgaatgaatatttagttaacgttgtttaaagaaacctaataaccaaaaaggggtaagggtgccatttatgctatccaaattttatgaatttgtggtagcatgttttgactctccatgaattataaataacaggttattttgagatgttcattttgtaaatcttttgggaacaaacctcatttttctttgaatgtgattaagtttatttctattttactgggttgtaagagcaattatgtatgtgttttatagagtaataaaatgctttacttaaaatgaggtaagtactatgtacagaggtagaagaaaatatgaaatgttttggtagcaagaacttcttgtaaatatctacaataactagaattgtttttatgtaatatgttctagtcaacacaagaaggaattttgattttagagttaactcatatgtagataattatttctcttgcccacctcatttccattcctcttattaaggagaaattttcagatagagaaaagtgaattttatttcgttgagttagtagtgcatctctaaaattatgagaatccttttaattcagtatattaatgtgaaaatctataaaagtgccctgtcaagtatttatttaaatcttaaaagatgaatttaccatgaatttaaaatactaattctaacaaatgtgcatagataaatttctaacagaaacagttataatttgagttgttaataatggcttgatatagtatcttaaaatacaagtacttctctgtgtgttgaaattttacttagtgctcactttagtttacagactttattaaaaaggtgtagattccatttatcatcttagttgttttaacatctgtttacataggcctttcttttataattaatagctaaagcaagtaattgtgtggctttgacattacagattttaccaaatgatacattgaaaacatggacgttgaatgtatttgtcacttttaagcttctttttgatatctttgttgatgtagttgcctacttagacatttgagagtataatatggaattggattattggaaatgggttgtattgccttcaaattcactttcgtttaagactgtaaaatttgtatttccaagtgcataaaatgtaaagtgtttagaaatagaaataaaaactgctagactatcccccatattttatgtctgtatggtgaaaattagatttattaatagaaaagatctatctataaagtataatcaaacaaaagagtgcattagtcctgggaaaagatgtgtgttgcaattttacaaatgggattctctatataaaaatagtataattctccactggagtgataatgacacaaagatgcagtgtatgtgatatgttttatggaagagttgaatatttttgttttgctatgactttaaatagtttttccctcttaatgactttttatcccttccagcgcaacagaaaatttagggagatagcattcttttgcagttagatttattaatttcccagtaattattatttcaggttagaacatatgccttgtctctctctaatacataaacctgttttttaa

SEQ ID NO: 70383 - DNA, 5986 bp, Homo sapiens
ctgctaggcagtgtgaatgcatatatgtactgatgctcttaagatacaacctaggaaaggacataatagaaaaatttatagcagtggcagaagtaactcttaattgtagagcaaaaagtatttttcagttatttttatttcaaaatatcactaaactgtgccctatgaacatgttcaaactgaaaaaaaattttaaaaaaccttctgccctcttgactcttaaatcactttattattgaagtggtttcttgtcatttatactttcattaccgactgtttcagtggttacttatatccaagttaattgaatgtttcttgtgaacctctacctgaagtttgcatatatatgtattctttaaattttagtttatcaactttattctattttttttcttttatgtgagttttaaatgaactttatcattgtagattcccacttagcttgttttggttagtttataatactacgttaggtatttctatataggtggaatagactaaaagtaaagtaaatgttttaaatttgtattacgtctaaagatttgtacgtggatgtcattaatttaaatgtccatactctatttataaatcttacttacaaattttgtaacatggaacaccatttgatttataatacttgcagaagttcctgtatgctgttaaataaattaatttgtaaaataattttgcattttatatttagttcagcatttaattgttaaatgagtttatagacttgatatgtgggtgaatgaaaaatatttacataaaaatcatccaagcattttccatttatttttgtagtatgcatattttagaaaatgacttatgaatgtttccatcatcacagaaacagtagctgctatgttttcattactgcttcagtcattaaatttataaggcaataatatttaagaagaatgaaatcagaatgtctcagtttaatcatcaggtaaattggaacatttcaccaccacaaaggcagctactgtttcagttaattcttattttgtgttagaatacataacagtgaagtagatgcacgacttgtgtatgtatagttaagccagcgtttttctgtgtattttggggaatagcaaaatctacatcacaaattttgacacattacagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgtgtaaaaacaatccaaagagataaatccttgcatagacaccaaaaacagtgtctcagagaccttttcattttttccttagttaataactgtagtggatgtgaaaacaaacgagttgaattttaaaacatagcatttattagtgctatacagtcacattcctttcagccagtagtaaagttaaacagatgagtgatacagtacctgaatggtactgcttctgaggcaacactttggattgaaagtgctgcttttggttaaaggaactatgttgtggaaagcatattccagtgtaaatttgcagatgtgtgttttttttttttgtcacttttcataaggtttggagtaagttgcagtggcttttgatcatagtttagcccatttaatggtccttttacctagaatgttcttaagcagttaatgacaatttggaatacacagataacttgtagcttaagatactattttcatttaattctcctgtggagaatattgctttattttttactagtttcaggtcagttattaaaataaacatggaggttttaatgaatgttgtataatattttatagtgaaggaaaattgtggaaagggcaaagactttctctttcccttatgtatttaactgtgccaatctaaatacatactgttttatacaatgagatgcattacaagacttttctgttggagtgctctcgacattttggttttcatacctgaatgatcattgcattttctgtattttctaaaatggctccaattttgtgttttaagcttcagcttaagaggaagtttatgttctaattcttgactgagaatacagtattgagattctctgttttacagataacaactggtttttattactcattaagttcatttgcatcccgtagccctctgtaaatgtttcccctagttgtatgtacgtaaatgcacgcttatccagtgtatattagacatttttgtgctaaaatatattaagtgggatttttgtagcaaagcattctatttttctgttcttacagtgtgtgtgtgtgtgtgtgtgtgtgtgtatgcgtttttttaaccttaacttcagtttaaacactggtgtatttatttttttaagcaacttgactcttagaagccttagactgattttttcaataaatattcaaccaaaaattataaatttattaagatgtggccttacatatggcattccttgtgttcgtaatgtgagatttttgatttagataaatcaagattcaggattaaagtttcattgtaagttgaaatagaaaatgtattaaaatgtctaggcttctgggaggaagttcttatactcttctttcttggcattagaaagaagcaatatgaatttttgtgaatattctaaatattcaggcaacactgttcagattgatttaggtttgtcttaaccaatgttctttttttagaatttcaggttgtggcattcactgagtatgcagctactatggtttttgtatgggacgtataaatacttgattatatacgacagattttaatgtctttaaagacttcctgctgtattaacatattgtaatggagtcttttaaatactaggttgaatttaattgaagtcacacacatcttgaagtggtaactgcatagtaaatactaccaagagtttttttcacgtgggagtatcctaaaactctgccatgggtgtaaatgttttacattaatttcataattggacagaccctgcatttagcgaaaacattttgttttgaaagtgtgttctttttgtcgcactgttactgcgtaacacttctcaacattctgtaagttaaattattttaaaataactatggtgaattcatgtttatttttttactttgaaaattgtagtactcaggtggtatttaatgggaaaggatcctttgggtataaatcataatgtattttaaggaatgcatctataacattgataactttagccttaaaaaaaaggtctattattccttcctctgcatcccatggtatattagcaaagtagtttacagccctgtacagccttacaaagttgttttacaatttttaatggaaagcccttaacaacaacaacaaaaaattgtatcattttaccaatatccacgaattactgatcacagtttgtaaataatttgtttaatatcagaaggccaaagaaagtcttaaaattttagctattgactctatggtgacttcacaataagatttctgtgcaaaaaggtaaggtgataattgatctaatagacttttttttttttttttttgctgtccatgagaattagacttcatattagcttcaattaaaaagctcattccattttattaaaatgtttgtaattgcaattttgtgtttaatgtttactttgtctttcctttctttagcatttaggtgactgttcggcagtttgatatatggccattgtcggccttaaactgcactagtaacaagcatggtatttatcttgtattgaaaataaaacaaacttttgataagactttgcag

SEQ ID NO: 70384 - DNA, 1063 bp, Homo sapiens
tctaatctatcaaaccagaattaacctaatatattctattatggtggagttagctaatcaaatcaaaccctttttatttccattcttatactgaaaatgtttctaagtttacttagtgcacacaatgagagtcatttaaaaggaagttatttagtatttagattgttaccttagagaatccttagataatacttttatttttatgtagggtctcactctgtcacccaggctggcgtgcagtggcatgatcatggttcatcatagcctcaacctcctgggctcaagcctcccgcatagcggggactacagatgtgcaccaccacacccagctgatttttgtattttttgtagaggcggattttgccatgttgcccaggctggtctcagatcctgggctcaagtgatccaccctcctcggcctcccaaaagtgctgggattgcaggcgtgagccactgcacctggcctgagaatacatttacttttttttttttttttttaaggaaatttatagtatcctaacattctgaatagaattctcatggtaggtgtaagaaagtggtcttaattttacttagctatgtaatgctgctttttgtttttgtttttagccctaggtgaaagcctattataggctatatatataaatatatatataatatatatattacatattatatatattatatatataatatattacatattatatataatatattacatattatatataatatattacatattatatataatatattacatattatatataatatattacatattatatataatatattacatattatatataatatattacatattatatataatatattacatattatatataaaatatattacatttatatatataatatattacatattatatataatatattacatattatatataatatattacatattatatataatatattacatattatatgatatattacatattatatatattatatatataatatatatatgtagcatttgaatgtctatgtatgtggtattcaggaaggagatacaaagacagtg

SEQ ID NO: 70385 - DNA, 1012 bp, Homo sapiens
agccaagatcatgccactgcactccagcctgggcaacaaagcgagactccatctcaggaaaaaaaaaaaaaaagcaaaataacttcccaggtgtagttcatgttttttagaaaattagattccataaaatttgaagggaagtatgttttttataaaactaagtatatacgctcagtgtattttttttcctagttttcatttgtagatcataaaactaactaattccttatattttaggatatgtcagcatatgtgaagaaaatccagtttaaattacatgaaagctatggcaatcctttaagaggtacaatatagtcttttgattcacaatatccaaagttaaaaatggctaggaaactaaaccgataatttactattttttttctgtctttagttgttactaaacctccatatgaaattactgaaacaggatggggtgaattcgaaataatcatcaaaatatttttcattgaccctaatgaaagacctgtgagtagcattaatctttgtaaatataaaatagatttcttagtaaatgtgaacatgtaataatacttaatgaatagtgttcattcagatgtgttttatgtaaatttatggcacagtgtatcttgccatgagttaagtttttcatttttaaatgtagcgcctttcaaaatccttttttttttcaagtatggaaaaaaacatataatatgaacatgtattggaaagaaaccatggaaatcagatgactactgcagcaaaaaaacttaaaactattattatcattcggttattagtaataaataagttgagcccatatgctgtgtaaaatagtttttatagtttttggtagttaaaccctaagaaacagtgtttttgcttttttaagctgtcatcagtactagcgcttcattttatatcttatttatgagtctttatttttatagccactggctttttcatcttttgatctcttcttatcagattgttgcttgataatgtaaaaaaaaaatccctccaggctttt

SEQ ID NO: 70386 - DNA, 1854 bp, Homo sapiens
gtgcatctcatatatttaaatccctaatactggatttctcagcttcagatagtatctttcagtgcctaatgattgattataggtgatcctttttcgtcctctttccaagtttctttttttcattttgccaaaggaattttttcagaaaggatgcctgagaaataaactttcagagatattgcccatctgaaatgtccttattttttcttcatagttcattgttggggagaaaaattctaggcactaaaggtagatatgctttcttgtctatgaatggagagagaagagaaagtcaagaggcctagctaccccatagcattcttgactttgatacttgccagttctgagcttggagcactgtagggctcctgggagctctggctcacacctcttaggcagttttcttaagttttcaggttgtggtttttctctggtgtcattgtttattatccttcttggtagactcatctgctttctgtctgttccagaaatttgttaaattatttgctttaaataatttgatatgtaattcatgctctcttattttgctgttattttagtagaattctgtgcatttccctcctcccctttctacattcttagtgcatcatcttgagcctggaagatgtcctttaagtaggatatttccacttgctgagccatgtccagggaaatctgacattctgttaattgagctagattgtctttagggggagttgatggtgcttgtttaaattcagttgcaaggaattttatattttctgactttttcagtgtacccttccttgctccctatttcatgacttttttgaagagtaccattctcttacaattatgctagctaactttttagaaaattatttggggtctggttttcagaacttcaacatgaagtctgatgttttccgaactagattttattttgctgaaataatcacacattgtgctacaaagcttttcctttgatgtcttactatacctgtttttaggtatttgaagacatgttgctcttgccaaagtgaattattactgaccaactttttatttatttattatgtcatttatgtaataatcttatagatccccaaagaaattatcttgccctcactgaactttttcattccccacagtaaatttgtaaactctaatcttcaaagcagtcacaattaatccacttgtgtaagtaaaagaattcatgttttagtgatttctcagtttaatttctatagctttatcttgtgttatttttagtttcctctctagagattcttgaacagattcttaattaccctctaaagagtattcatgttaggtagatatgaatggatctaataggaaaataaaggtacagaaaatttgggtgatttgctgcaataagttgcagttgaaacaagatcatgaatttgacatgtatatacttattccagtctctatttcagttaaaaaaatgccagtatcttatgatgataaaaaccattgcacagatttgacatctgtttctatttcacaggtaaccctgtatcatttgctaaagctgtttcaatcagacaccaatgcaatgctggggaaaaagacagtggtttcagagttctatgatgaaatggtaagaagattttataatgatagttttaaaagcatttgaagttggagaactttgaagttattgggtttttgttcattttatcccattagatatttcaagacccaacagcaatgatgcaacaattattgacaacatctcgtcagctaacattaggagcctataagcatgaaacagaatgtaagtgccatgcattcataattctgaaaaataacgtattctgtaatagtgaaagggttgtatgattcgtgcct

SEQ ID NO: 70387 - DNA, 1008 bp, Homo sapiens
gggtttgtgtgcccccttatttcaatcttaatatgtgtatggaaaaaaggacattatgtcttaaaattttaactgtgagttggtgaccagaattttatttttagttgtaggaaacatcttagatcctctcttgggaattcagacattcttcccctcccccaacctgcacccatgtttaatgttgtaattcttaagttatccacatttcatcatggaaacattgtcgtcaggaaatgccatatttattaccctgtcatatatcttaaacatgtgagaaaaatactttagtaaaagtatttgttttctttagttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatcctatttctccctcctgatgtgtttcttcctctttgaagactttctggaact

SEQ ID NO: 70388 - DNA, 1048 bp, Homo sapiens
tttcatttgagtgaaagagaataaaaatagtttaaaaattaaatgaaaaggaaaaacagatgtcttgattaacagaacattgcctcctatgatgaagtatcatgtgacagttcaaagaaattaaacatgacctgtaaatgatgtaagggaccagggccaggactccttcaggaactttactgaagggacttacgggtaaggtccttgctcttcagtgcattgtccggtgaactcggataaataacattatggtcctaatgtaaaaataggcagttaaaggtatgagtttcatctatctcctgccccagcctggactctctgatctggcttttaaattatttttagttatttttacttaagataaattttaaccaattgaccacctagatttcagtaaccttatgtaatacgcctcatgtcaatccccaactctaggtagccctcctggatctccaccctaatctgtttactctttctcactttcactggctatcctgagttaactgttctctaccctcaacacggcttcattgctctttagtaattccttagtctacccttagtaaattctttattgttgctgtctgaaaatttccagtctactgaatcaccagtctgcttattcactaaatgaatagagtcataaagctgggagctaatcatctaacttaattccctcatttgataagggagtagagccatgaagaaattaaatgactttcagagtcacacaatctgttgggacagagattcaattttaattcagcatttcctgactgaacagtcatggtacagctcccccaaagcttagaggagagtgtgcaaactggaaatcaactgggaaacaaactttccaagaaagaagaaatctgtaagctgaggtttactgttactgttatagtccaatccctattattaaaattttggctcattctggttaaatcatgttctcatgattaatgagttaaatctggttaactcatgttctcaaaattaatgagaacatgagttaatctggttaagtcatgttctcaaaattaatgagaat

SEQ ID NO: 70389 - DNA, 2963 bp, Homo sapiens
cctgggcggacggtgagtggctagggaaacggactgggacggccgcgggcccgcgtcggagctggcgttctcgtgcccccgctgcccgcttcgggatccgggctgagggctcggctgccggcgtccggggaaggggattgtcgaccgccgcggacttctccgggccagcgggacgggaagagctggctgtgggtccatggggtgggcggggcggagccagggagggggttcccagagctgttgttgctgttgggactcgagagtggggatgggctgggcctctgttcgtccgtccgacccccctcatgtgtgctgccccaaacctcgccgctccctagtttggtattctgtgtccggcctggggtagtagctggacaccagactcaatcttgggctccagttcccgacttttcgcctcctctgggtctgtcctggggtcagtaattaacccgggtcccaggggtgtcgtcttttccctccagggtggggcgctgcctgtacatgccagggatcttttgcagggcttttcatccagatttgcttcagggttgtccgggatcgatttggactgggctcggaaccggtcctggatacgtaggtcgctgtggcaccagcatgctctgtatcatctttactcacttgaaagcttgctgaagctgttgttgaagtaaacttaaagaaaaaacttgcttaaggaaaatcagtagtttagacaccccctcccccgcctttttttgcagacatactaaaaaaaaaaagatgcttttctctaatctacactcttaattcttttggctatctgatgtcacagttgtatgatgagttcattcagaggctgtacgaattgattttaaagagttggacagttatatcctttctcccaaagtttgtttaccttcatatttggaactgtcatttttcttaaggaaaaattgttcttggattttcttgagagattccttacactgttaaaattgttgctgcaatgcagagtttcacacaggtgggcagagatgttttgtttaaacttattccatgaagtgtttacttcggataaactgaggatttcctaggggagaaagtgatgtaggtaggtttagtgaacagattttaggtagtaaactttactgctgaaaggtttgtaggaaatatgggttttccacaataaatggtgatttaaaaactttttataagggaatgcagttactgcagattattgctattagcagatggccactgtttttgcagcgtaaagtattcacaaatcaccttcttgaaaccagtgacgctatctgcaactctcatcttgtgtgtagattagggtttattctgtagttttttgggtacttatgtcattctctttcctcccacccctgaaaggggaggtggtatcatgaatcaggaaaaatagactgaagtgacaagttcagtgagcttttcctatgcaaaggaaaatttatttcaaggttgttgattttgaacaggcaaagggtagatgatttttaaagtccttggaaaaaattgtggagagattagctgcacaacttttctttttcctcttcctttcttttcttttttctttcttttcgagacagcctcattctgctgcccaggctgcagcacagtggccccatcatagctcactgcagcctccaactcctggactcaagcagtccttctgtctcagactcctgagtggctaggactataggcaccaaccaccacacctggctaattttttttttttttttttttgtagagccgaggtttcactatgttgcccaggctggtcttgaactcctgggctcaagtgatcctcccatctcggccttccaaagtgctgggattacagttgtgagccaccatccccagcatatttgcacaacttttaaatttagatagaaactgtagcttcttccacatgtgaagtacttaattatttagagcataagattggaatattggaattgagagaatctggaaaaatagttaagttagatgtagttacagatttgcaggtatgacaatgtatttttaagggaaatacttcaagagttttaagagcagagaaaggtgattggggaaaatcagatactgattgtatttttatattatacaagtcaattcaacaaacactgagcatttgctatgcatgttatgctatgttatgcatagcatgctatttgctatgctatgttaggtaactatgtaaggagcaaataaaggtatagccataacagttgagtttcatgttttggtaataatttctgaaatcatgaagagttgagttgtattctttaggcatactaacaattttttttgtaattgggacttaacattggcgatgggtgttgagtgcttcatgaaaagcgctatactaggcattttaggatataaagattaaacttttggtttttaggaatttgaaatctagaaggggatataagatttgtgtaaacatttacaacataaacatttgtaaatacttatgggtggtttgaggtaaagtttggagtaaattatacaaaagaagaaagggttcatttttagcttaagtaatggaaatttgtggagatagctcagaagctactgtttattgagcatttactgaacagacttaatgctagttgctgtttacagcattttcttagcttcacagcaatatgtaagtaccttaataatgaggacagtgaggctcaaatatgttaagttacttgcctgggctatgtggctagcatgtaacagccccaatttgaatccaaatctgtctggtgccaaagcctgtgtgtttctactgcatcatgttgctccccaataaactggtaacctgagtttaatgttacagagaataagacttttctaagacaaagatttatggattgggagtaggtgggtgaagaaggcctttcaaataaagagaatgatgtgagcagaagtgtggaggtgggaaagttcattgtgta

SEQ ID NO: 70390 - DNA, 1023 bp, Homo sapiens
atagagtagtgtgcagaatgatttgatgtggaaagctgactttcaatgtagtataaatactgggcaagggcagtggtaatggaattagagtgaaggctctgcaggacctcaatgtcgtaggtgggtggcgaggaggaggggtttttggagcaggtttggaggagatggaaggtgaagattacacttttgtttttgagacagagtctagctttgttgccaggctggagtgcggtggcgtgatcttggctcactgcaacctccgcctcctgggttcaagtgattgtcctgcttcatcttcccgaatagctgggactacaggtgctcaccaccacgcccagctaacttttgtatttttagtagagacggggtttcaccatgttgaccaggatggtctcgatctcttgacctcgtgatccgcctgcctcagcctcccaaagtgctgggattacaggtgtgagccactgcgcccagctgaagattacactttttaagtgtcggagatgttgacggtggtactcttactagaaatacgggcaaggaggtacgtaatgagatcagttttggatttgttgacttttttgtatacttgccaaacgctggaaatgtccaaaggcttttggaaatgtggatttgtggttaaggggagaggtcaggactaggcatatattaaacatgggtttagtgaataatacaaataggtgtactggttgaatctgtgtaagaagatgaaagtgccaagggagaatgtagaggggaaagaaaaaaaaaacttctgttttaaatggcatctgtttaaaacagaaggaaatatgctaagtgatttattttatgcagtgggtaaagaatttgatagtatgtccactgcttcttcacactgtaggttcacacggagtagaaagaatctgatcattaaaaatccaattgggaaatacagttttcttgccctgggtagcaagaatactatgctatctttaccctgtttcagggaggacaaactacttcagactcatttcatccagagtg

SEQ ID NO: 70391 - DNA, 1050 bp, Homo sapiens
caggaaagatagagcaagaaaagcctttttattaatacagcaagtaaaccttgtacaaatatcagtattcaaaatgctttctagagaaagaatagtgcagcactgtgcgtaatgggttatgtaagtggagtcacagaagtcctcctggggacacaaaccaattatgaacataagtgcttattgaaattgcatcagttgtctagatgaggagcttattgactccctggttcacttgggtgggcaggcggctgtgggggagggacgggggggggtgtgggggtggggaacttaaggtgcaaacctagcctaggtgactgttaaattaaggcttaacatttgtttcttttgagtgtttttggttgcgtaattttaaaagttgggaatgctatagaaatatttaaattctattagaatgtccaaggcaaaatgttcaggttaagtagaaatagcttggaccctctgttaattttaaagaaaactgtgggtttgctgctttagatattaaaatgatatgggtttatagagttatgttgtgtatcattgttgctggtaaataaaaaatgtttaattcatttattttaacagtgcttaaatttttctcttaaagtactcccaatggcagaaatgtggatgaatagtaccctcagaagtctaggaatgcagcccaaagtgtgcctgctataaattgaagtttttgatgcctgtagggttttatattttaaaatttatataaatgttgcattttgctatcttacatgcatgtcgacagtattttaaaatactttttttttttttttttttttggtttgagacggagtctcgctgtgtcccccaggttggagtgcagtggcgcgatctcagctcactgcaagctccgcctctcctgggttcacgccattctcctgcctcagcctcaccagtagctgggactacaggcgcccgccaacacgcctggctaattttttgtatttttagtagaaacggggtttcaccgtgttagccaagatggtctcaatctcctgacctcgtgatctgcctgcctcggcctcc

SEQ ID NO: 70392 - DNA, 1002 bp, Homo sapiens
cgaaactccgcctcaaaaacaaaacaaaacaaaaaagaaatttagctaaatattgctaaaatggcaaatgatagcacttgtcattttgatgtttgtgcgttaagtgtactttcattccctttagaaaatactagctgcatatacataggatttaatcaggaaaatatgctttttccctgattaaatatctttaatactatttcatctgcattccattaatattcaatcgtggcctcagctatttacgtgaattttacccatcaatccatgagcttttttgagtgcctactgtgtgttaaatctatctgtatgttttgttttcttgttaggcttcttttcagaatttttccagggcaagaattatgttttcttatatttggcaattttgcacaatgcaatttataccttattgtaatgggtaggtgcttagaatttattcgtccatttgtgctagacgctgaggctacaaagtccaataaggtaaggactcttatcttcaagttccttaaattttgataggcgataaaataattatagtaccataataatttaaaaatacatctttgagtgggccagagctctgtctgtgatggagattttactctgaagaatggtaactaacatttgtagagtgtctactctctgcctagggcttctgtttcagtttttcctcctagcaatctttcagtataagcatgatatccaatttatacatgaggaaactctctcagagaggttatataatttgctgcagctcatttagctaatgagttgtggagctggaattctaactcagttctttcttttaaactggggcttctaaatgttagcattattgacatcttgagccagatacttctttgttgtgggagactgtcctatgcattgtagaatgtttaataacatccctggctctacctaaggccagagtgagtcaaggaggcacgtaggacttaaaatttaaggaggcagtcactctcaggatcttgtaagtgctgaccc

SEQ ID NO: 70393 - DNA, 1045 bp, Homo sapiens
tttggctgatctcaaacttctggcctctagtgatcctcccaccttggcctcccaaagtgctgggataacaggtgtgagccaatgtacctggcctcttctaatttccagtttttgtttctaaaaactgaatatcacatggtacctaatattagcaaatgaggaaatggaagcaaaggaagtgtgaactttcttttgtagtagtcaacttttggcttaatgttttgggaatatagttctgtggaacatttctctgcttttacagtggtggaatagtaggattcactgtgtagctaaccttgaaatactaattccataaaataaaggatatacataataagaatctgtttagcaatagggtaaataagcactaaggtggtattctcatactagggaaaatgtttgctttattacatcagcaaataatgtgttccacaagttttgatttattattttaactgtataggtggtcttacatctaaaaaagaataccgcttaaaagacttgtagtacagcatataagttatattagacatggaactatgtttctgccaataactcgacattttgaggacagatagcatctcatttccaatttgagattgggtacaaaaatatcctagggctgagaataggcatagtaaattgcaccaacacaaaccttttgtgtatttgtagtggaggaaaagtctacattgagtttgcgtggaaaaatgtcataaaagctctttatgcttttaaccagtagattggacctcattttgtgatgattactttgtatgattagtttccaatgcagattccaagaatgtttctgcacatgagttccttgtcttttttctgttattttcacctttggttgattgcaatccacccccgaccaccatttcttgttcaagaagtgtttcattagtttttcttctcttatttttattttcatgttttctttaatgtttttatactaacctaaaaatttctcctagtgctttaaaaaattatgagacagtaaagttgtctttggatgttttttatttttacccgaacacta

SEQ ID NO: 70394 - DNA, 1022 bp, Homo sapiens
caatattgagaggaaaagcctttaagaagtggttaggtcatgagggctctgccctcatgaatagattaatacattcatggattaatggattaatgggttatcacgggaataggactggtagctttataagaagaggaagagagacctgagctagcatgctcagccccaccacgtgatgccctctgctgcctcaggactctgcagagagaccccaccagccaagaaggctctcaccaaatgcggtccctcgaccttgggcttccctgcttccataactgtaagaaataaatttcatatcttataaattgctcagttttaggtattctgtaataagcaacaaaaaacacactaagacacagccctactacaacatacttcttaccccctctcctacactagtcaatttcaaactccttgagtgcaggaggagtatgcctttctttctgtcatgttccgacacataataggcactcagtgataaatacttggcattttttttggttgttatatctctgactatgtttctgtcctgttatatgggtgtgcaatgtaaataataagacaaatattattttaatctttttaagcttttataatacttgtttaattgtttgcaaatttgttttatagttgacacatgaaatccagcaactctgtgttgtagatcaacagagcccattagtactgctgggaaaggaaaccaaggcctcatagcttttctcttcatatgaaaagaacttcattaatttttaaaaaatttaatagactgtgatgtagttttaatctcatggttttaatcttgtgtttttaagcattttccttttctggatgaggttcttggttttgactgtgtagaagtatgttaattcgattatatttagttgatgaatttgtgcccctaagtatggtacttaaaaagttgcagccgggcccggtggctcacgcctgtaatcccagcactttgggaggcccaggcgggcggatcaccttaggtcgaaagttcaagaccagcctgaccaaca

SEQ ID NO: 70395 - DNA, 1120 bp, Homo sapiens
gtacattaacaacaatatacctttccaaattcttctttcttttttcctaaattttaatctgaaaagatttgcttttttaaactctctttttttttaggttggcagtcaacaatcacctttttaaaaactatgcttgattttgttcatatatatatattttattcattaaaacatagtttcaaccccatatggtaactggctcctgagaatagggaaactagtccccaagcttcagcctccccacaaaccttgtatcaacatttttactgatgagtaataaaattaacagatttgagctgtaacattctgaacactggaaaaagcattactgaactgtaaaatagacctgcagagaaatctggcagaggaggaggagtgtgcgttagcctgtgacaatgaggcactgacttactatgcactattttaacagagaattgaatagttttgctatttagatattttactgagttatttttttaaacaaaagaggaatatatatggttttctgataataattaaaaattttttgacctaaaaatgacccttgggggtggggctcctcaagtgtaaagctcctgctgggaagaaaattgttgggaatacataggttggttttaggcatggtggaatcatttgttacctcaatgaaagctactccttggatagagttgttttcctgtgatatcacttctccttgacagtgttcctttgaaataaatctaaatctgcctagatatttctcactttctaaattaagaaaataattatctataatttataaaaataaaattcgaagtcttcccaggataaatccattggttaaaagcaaacaatactttttgagtttctttggagagatggaaaattgcttttttttttctgtgtgggtgaggcaggtgagaatagatttcgcccctgcatgatgtcaatcagaatttttggttagtaaaaaccaaatcaaatatgttttaaaaggaaattgggtagagctcagtggcttatcaaattgttgtgagggttggagaaccagattcagggctaagcaaccagaaacaatgctccaaatcacattgcataattcccatgaggatgccagtaccatctagagacagacggatgg

SEQ ID NO: 70396 - DNA, 1052 bp, Homo sapiens
attaagctggagtatttattcgtaaaccacctctcgttaattattactttagtacaagtctgtcctacagatttttctatacttcccaaacagtatttcataataatgttattttattcacttgtgcctttaagactaaatgggcagatatatttttgtaaaagtgagtagattattattattattattattactattttttttttttttgagacggagtttcgctcttgttgcccaggctggcgtgcaatggcgcgatctcggctcacagcaacctccgcctccctggttcaagccattctcccgcctcagcctccggagtagctgggattacaggcgtgtgccaccacgcctggctaattttgtatttttagtagagacggggtttctccatgttggtcaggctggtcttgaactccggacctcaggtgatccacccacctcagcctcccaaagtgctgggattacaggcgtgagccactgcgcccggccaaaagtgagtagattaagtgcccttccacacacatgctcttgtagaccgtctgaatgtgggctgggtgctagagatgtgcttgatgtaaggtaaatatccatgaaattaaaagtgatttgtgttctgtttaaatattaaattgtcaacattgagtatactataccttttgtccttatctccatctgatctttcctagcatataacttttaatatgagaaatgttatttctttataatttttttgttttaatccagtactagctgtataaaatggatttttgcataaaagcagttgatgttatatattcttctattctgccacttttaagatttatgcttcttatacaaactttttagtgaatcagttttgaaatgagcagtagtccatttttgaaaacagtgttggcatatatagacttaggatccctaatccaaaaatttgaaatctgaaatgctccaaaattcaaaactttttgagcaccaacatgatgctacagtgaaaatttcacatctgacctcgtgtcatgggctacagtgaaaacacaggcacacaacacaca

SEQ ID NO: 70397 - DNA, 1144 bp, Homo sapiens
gaatctttcttcatttgtcctcttgtctgaagcaagaatggagcaaagtttttttttttttaatgatttttttttttttttttttttaaagagacaaggtctaggtacatcgtccaagctggactctaactcgtgggctcaaagaatcctcctgcctcagcctcccaagtaactgggattcttgttgcgggtcaccatgcctggctttaagcaaatttttacataaacagcctggatttacatgttattcctatggcacaaatatgggatttgtcgttaataactgtattccagtttactgcagattataatagtgaacaagacaaactgggatttggaatcctgaggctatctctgatttagacaagttagtaaccaccgtgtgctttaacctttttgattgggaaattctgagaattaactaatgtaaatatggggcacatagaagttgctcaataaaagtttttaatattactagctttctttcaagtggttgaacttgctaaaattctgatttctaaatgagtgggagcatttcggtacaaaaatattcaagggttctctccaactttccaaacaaagcagatttgaacattaaatttcatcatccaacttttggaacccctgctaattgttttctttgtactcttggtttatttttatacctaaggtctgatagacacataacaaatgctttatgtaccttaaagtaagtgaaaatagattgttcagatgaaaggtatgtggataagtcagttttgcagcaattctagagaactcttgccagaactgtatctttgttttggttttcagggactgttaaatgtgatcactgagtcagacttgctgttttctctgtcccctggctatctctcttaagaccctgaagtttgccagccatagaatgtttaaaaggcagaggagggcttagcctagggggagtttgtttatttaaagaaaaaataattaagtttaaacatcctaccatgtcatagctagtttagtcatgttaagagttagtgagttcttttgattgtttcctggtggtcttgatatctaaaggtaacagataaatttgaagcagttaaacttcctgagattacctggaaccttataatataatcccaaacagaaatccctaaca

SEQ ID NO: 70398 - DNA, 1440 bp, Homo sapiens
tcttaaacactcaatgtcaggtatataaccacttacctctaaccttctatgggaaaggagtattaaatagacatgctatatcagttttgccagtattctgtgtgttactttactgcttaattttgagttgtctttctctcttaccaatgcgctattcgaaatttgattttgttttaattaccaatgaactcttgtcttgtggagacataaaagatactacaatgagtaacaacagtcaaaatacctgccaagccagaagttcaccatccctttggtgattttttatttaaagaacaagccaggtctggtagtcctgtagtcccagctactcaggaggctgaggcaggaggatcacttgagcccaggagtttgagcccagccttgggcaacataatgtctgcctgcctgcctgcctgcctgcctgtctctgtgtctctggctgtctctctctctctctctctgtctctctctctctgtccctctctgtctctctctctctctttaaagaaggacatgaaattcctgataagccacaaagggttaatttcattattaactcttgaacaaaaattaattatttaggtaatattatatatgagaccttaagttggttttttttttagatgattttagaataggtgacctttgcaaatttaactagaaatttgagatttgtttgacattattaatgcctcacaaaatttattctcattattactgagtaaaatcaactagctagttgtataaaatctagctgcagccatataccttgttggacttaattttctgcatcagaataatgtttgtgttagatgatttctaaagtctttttctgtttacagtttttgtatccttcatctaataaatttttccaaattatttttcatgtagtgcacacatggtcttctgaagaagccatgggtagctgttgtagctgtccagataaagacactgtcccagataaccatcggaacaagtttaaggtcagtaaaactggttgagttatatatcttactgcctagttgggtgttcttcttttatttcacttaacatatcttatttctggcttttatcaccaaacctttctatttccctttctttccaccctgtctttcttgatttaataaatgatgacaacattttcttacagtatggaattttttttagttttccttcggtcctctgtatctaattagccataccgttctggtaatactgtttttaaaatgccattttacggggtgccttttcaatctcatcactatctgtctttcagttattattttcatgtgtgcctgtgtgatttcttaactggactctacctcaagtcaccctctgattcatcctgtagtcaccatcaaattaatcttcttctctcatcattcactaacctctttgctaaaattgtgtggtgttattttacctgtaggctaaatgctg

SEQ ID NO: 70399 - DNA, 1014 bp, Homo sapiens
cctcatttggagatgcttcatcccatccgtcaagcagacatccttctgtgggaagtgctcgcctgccttcagtaggggaagaatctacacatcctttgcttgtggctgaggaacaagtaagcatgtgctactgtgtaacagcaataatgattgttcagagttagggtatcactgtgctaatactggaagattttattcagcttgaagtttaactttatctgtttgtaaattacttttgtagtgaacaatcagaggagatagcatatatttgctggtttatgctcaaatatatgcgggtattcaggggaacttaccattacagtagcttgtgggttcacagaagaggtacatctatagattaagaaaggcataactaatggtcagttcccattataagaatgtccaatggattaagagtttatgctgcttttcatattttagccattatagtcagtgaactacgagtaggaaggtagattttgctgttaatgttatggagttatttagtgttcccgagtatgctagttttcatgtgtggaatgaagtatctggttggaacctctgtattaattagttatacttatgttttgtaaaccatatgtcacattaaaaagtttttagtgtttttaaaatcagtttctttgtgttctttacataatgagttgttatattatttactgtaattacatgagtcttggtctgtcgcccaggctggagtgcagtggcatgatctcagctcactgcaacctccacctcccgggttcaagcagctctcctgcctcagcctcccaggtagctgggattacaggcgcaggccaccacatccagctaattgtttcatatttttagtagagaccgggtttcaccatgttggccaggctggttttgaactcctgacctcaagtgatctgcctgccccggcctcccaaagtgttgggattacaggcgtgagccactgtgcccgacccttgtaaatatttttatattatctccccaaaatactattaagctttt

SEQ ID NO: 70400 - DNA, 2664 bp, Homo sapiens
tgaagtcgttattcttttatcaaattaggaagacatttctacatttctccttctctttccacctttttattaataaaaaaacaggtgcaaaagttttgaagtaagagtacatttggagagaaagttaatacagttaactgttgtcaataaaattaactgatgtggtcaggctttttttcagttttgtttttttaagtaagttaactaattcactttctgttttgttttaggtacatacctatgtcaacactacaggtgtgcaagaagagcggaaaaaccgcacaagtgtgcatgttccattggaggcgagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgtgagcctggaaagcattgtgttgtttgcacctttgtgaagtttttaaaaatgaagatgcaagtgcttcattttcatttctaaacactaactccttttatagactgataaaatttttttctgaatatttcatgtgcatctttaactaaagggaattaatgtagagcaggtactccttaaagaacactaatttcattatatactactcgttgtacagcagcattcccgttttcacagtgcctatttaaaatgagagttgaagtaaatgacatgctggttgatttttatcaatattctggacttaacgcatacctttcatgtctaagtcatggttggcttttaaaactttttataaagcctcttgacaatgtacattgctaacaggtaactataggctttgaaagtaatgctcgtagattcagtgttcacagtatgtggcctccagcatgtaacatgaggaatcctttatttcattaattaatggctttttgacttgagccaaaacatatgtaaaggaaacagaagtaccgcacctcctcttacaccagtcagctcctttgccttcagtgttactagaaagcggcctgtgtccatgagtgtgctttgctgttggtgcactgaaaggcaggaaggagacaagattttctatttactcatctcatgatgtcatttgaagggcatgtccagatatcttaaaattataataggctcaagaatcagtctcaggtcactttacccaaaaacatttgaaaatctgaaccacaatctcctgaaagtttttctcctatagattgttgacaacacattgttttctggaggcatttgtgccattaggtttccatttatcttcagtttttttctttggtgtttgggatgtcttattttgttgccttatgtccttttcaatttaaaatgtttgagtttgtatatagttttgaaattggattatgtgttcattgttgtttagtttgcatttttgtcaaattatggttttgaaggttcatttggaacttactgttagtctgtaacagggttgcccttgtccagtatttatttataagctgtttacttttcaagttgataaaaacattctccaattctaaatttgcttgtgtccataggtgatctctttagcaaactgagaaaaaaaggaagctacttttaacatgcaaagttccctcaaggtgtaccgtgttgtctctgtgggcactcttccccagcactttagcagtaattcccccagctacacgctgcagttgtactctgcccactctagtgttcctcagctctgctgtccttttacttgtagctggatctttgattatccttcgatttccatgaaatattaatattgttgccagcatagcaggtacagtggaagtcttgtagcagtgagattgtatcataatttaggatttaaaatgaattaaagtttatataaactgaagagtctccatatgtcaaactcttggaaaatcaaagatgttc

SEQ ID NO: 70401 - DNA, 1030 bp, Homo sapiens
ttccatttttaatatattgttccacttatcctttcttctgagtaaattgctaattgtgccaaatttatgtaatagtttttgtaatgtggaataagaattatgatggaaccattgcacatttttttctgaaacagccagtcaaggcagaacattaatctccaaatgcaagggctgatctatttattcattttggaggttgggtactttattctttctttccgtcatccttttcattgtttcccccggattctaattagtttttattttttttagataactccaatataatcattacagtttatgctttaaatactatgtgctttaaaaaggaaaatgggaccaatttgtctgctaagaatttgattttaggtactataagagtattaggaaaatatatacaactggtgttaatttctagatattttctagaaatcacttgtgttcctatttaataaaaggtaatttagaatactacttgtcctttgcagtagtttagtaatgggcattaagctgtgtcctcgaaggatgtacctattactaggtgcattttagaatgaaatattgatattttattagcatataattgtggccatatatctcagattttctgaggcagatctaattttagataattctgttggtagaccatgtgatccttctttttggttttggaaatataatcattgttaatgttttccctccaaatagaatactgttttatccatacaaatcataacagcatctatcccatgctagggttggaaactgatattggtattacttgtgttttttcttagtgtgttttatttcccagtttcatcttcttctaaaaatgaaaatatggtgccttccctccctccaggaagactggcaaatatttccttttatttactgctgctgtggagtgatgagatatgcactttactctttaagattcagcaaaaagcttttcacttctcagtatatccagaatacatcatatctgggacttaggaaaatttgccaagcaatctttgtttttatagatact

SEQ ID NO: 70402 - DNA, 1239 bp, Homo sapiens
tatattcttgaaatagacataccatcagagacatcattcacaagtaactgatgtattggcatctcattcatatttctgatgtgtgaggtatatggtactaattaccttttccttgatgtttgccaaatttgaataaaggcattggtacgaaattacagaatgtaaagaaaatgtttttggcttgaaaaattaacatattttatgacgtaccacagtatactctgcccaaaccagcaccctatctatctttcctgttctttacatccctgttccccatccctacttcctcatttttggtataacacagttcttttgtagcatcattataattgcagttctatggcaattggacagttatagcatggaaacagactggtataagtagtacagtagtcaccagtgtgccacatttgcattagtaatgcaaaatatacattttataaaggacaaactttgtgttatgttttattttcattacattgtataatattgtaagactattgtatgtcctaatttgcattataaatgtttttttcctacgtaaaggcataaatatagcaactttgtataaaggtagcttattagatttttaattttttcttttataaaaaattgtccaacagtgggactaccattgccaaattgtatatgaaatatgaattttacccccatggttaatttcttttataaacattccatatttctctaataaaaagacataagtgatactgtactatgcatacattgtatcttaatgctgtttcagatcagcattttaaattttggtttgcatttttaatattggcaaaacgtaaccactgttaattaaaataaaaccttgttgtatatgtaacaacataattttccctctatcccttcccaccctttgttctctatttctccctatcagtgccaacttcatacattttgtagcatggcaataaaatataacttttacactgaggccgagtgtggctttttggaggaagtggggatgggacgattgccctctagttgtcctttgcatatgactgttttttgccatataagccatgtcatcaggcatgaaaagttttctcatatatgatgtaaacttgcttttaaggacaagtgtgaatgtgctttttaagcttaatttttgtcatgacaactaattttttttatctttggagaagtcagagttctttacaatcaaacgtttattaactggagtacttagaataagctagtaattgaatt

SEQ ID NO: 70403 - DNA, 1060 bp, Homo sapiens
atcatttgcacgtacatcttctaatattctgtttatgtagaagtatgtgtacttcattatgtattttatactcatgtaacatactgttttataaaacagatactatttatcaatacttttttgtagcttgctcttttaaattcctttcagtgtaagtagataacactgcccctttaactgtcaaatattatcctgtaccttaattattttataatttaattatggctgtattgatagtttctttccattgtttttgcagttacggtgttgaaacaaaaactagtgtctacctgtgcttctagtgtttctaggggtagatacatggtttggttacgtggtgtatgtattgaaaacatttgatgaatggataccacaaaatagctatccagagtgtttatacactagcactgtgtgagaatactgattgatccatgcattcttcaagatgtgcttatgtcttaacttgaaccaattatgttccctttaggacaaaattcttctaagcagtggacgagatgcctctcttatggtaaccaatgatggtgccactattctaaaaaacattggtgttgacaatccagcagctaaagttttagttggtaagtctgaatatactttttcaccaacctaataatactgtttgttaacatttttgaaataactttataaataggctgtgttgaccaatcgtactgtcaattgatgtccactagttgttaattatcgttgttaaaatacaagcttcaggagtgcccgtatgttggtggtaaaactgttgcatttcagacctcagagttccaaataatttgttgaatgaggaaccctggtaagtttagattggtagtgaatatttttggagaatttagtaagcaaagaagcaattttgagttaataactaatttctttttctagatatgtcaagggttcaagatgatgaagttggtgatggcactacctctgttaccgttttagcagcagaattattaagggtaagagcaactaagcaactcttttttcctactgtgtttttgagtatcagaggtaatctagtccttacttc

SEQ ID NO: 70404 - DNA, 1050 bp, Homo sapiens
tatttttagtgtagatggggtttcaccatgttgctcaggctggtcttgaactgacctcaagtgatccatcctcctcagtctcccaaagtgctaggattacaggcgtgagccactgtgcccggccatttctcacattcttgccaacattagacttttgcatgcttgtgtggcccccacccctcttttttttttggcattttgccagtttggtggggaaaataacatctttaatttgtgtttcttgattactgctgaggtttaattcttttcatatagcttacagacttgatcagttagggtaaaattatctattgacatgaatatctagataaattttgaaaagtaaagtagggttaatatgtatatttggttggttttatttagttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggtatgtatgaatgtcagatacaagaagctttgattagatgctgagggctgaatactgagtgaattctgttttgagaccagtgaccctttacaaagccagtgaacttgaatttaaggacatatcatatgtgcaaccatttttgtcattttattgacagtgtactcctcttcccgcgctattccagcattgttgatgatctctagagtttacttaactaccatgaagttatttgcagtctctgataaagaggaaatgttttcttttactagaaatcatctattctcaaatggtacttttaccaggattatatgtattctccaggaagggtctgggtcagtcaaatcattgtgttagctggttgttgaggatgtacagttgaccattgaacaacatgggtttgaattatgtaggttcacaatgcaggttttttcaataaatatagtcagccctttgtgtccgtggt

SEQ ID NO: 70405 - DNA, 2007 bp, Homo sapiens
gcgtatatctgaaacaaaagtttcaaaatactgtttaattttattgtctgtactgtgctcttatattttctgtttcatattttttaagtaacccattaaattgattttgtaataactcttctagtgggatgctttataccagaagtgtccaaggaagagaatacagtcatgggttcctagtttctgtttctggttgggtcggtaaagccccttcctcctccctcttttctgcttatcactagagacagaaactaaaatccatggctttcaggcgctaaaagcctaaaagcaaaacaacaacagaataaggcaggttggacaagcttgcttttatgccttctaagagcttggtaaattggacttaaatagcttctttgaaacagtgatatgataaagcagacagctttttataagatttactaaggctgctttgaagtattaaatatgatactgttcttatatttattgtaggcttcctgttggataaaaaaattggagtaaatcaaccaaaacgaattgaaaatgctaaaattcttattgcaaatactggtatggatacagacaaaataaaggtatgtaactctactttttaaaaattaaaattactgcccaggcagagtggctcatgcctgtaatcctagcaatttgggaggccaaggtggtggatcatctgagatcagaagtttgagaccagcctgaccaacatggagaaaccctgtctctactaaaaaaaaaaaaatacaaaattagctgggcatggtggcgcatgcctgtaatcccagctattcgggaggctgaggcaggagaatcacttgaacccaggaggcggaggttgcactgagccgagattgtgctactgcactcgagcctgggcaacaagagtgaaactccgtctcaaaagtctcaaaaaaaaaaaaattgctggattctataaactcaggaatcaattgcactaaaaagcttggaataggtatgaatctattgtgtatatacacatatatatacgttggtaaaaatgttgaaatatgctatgggactctttaaaaagagtaatgaggcctggcgtggtggttcacgcctgtaatcccagtactttgggaggccaggcgggcggatcacaaggtcaggagttcaaggccagactgaccaatgtgagatggtgaaaccctgtctttactaaaaatacaaaaattagctgggtgtggtggcgcacacctgtaatcccagctgcttggaaggctgaggcaggagaatcacttgaacccagcgggtggaggttgcagtgagccgagattgccccactgcactccagcctgggcaacagagcgagactcaatctcaaaaaaaataatgaaactgatgctctctttatgcttcgtttgtcttagatatttggttcccgggtaagagttgactctacagcaaaggttgcagaaatagaacatgcggaaaaggaaaaaatgaaggagaaagttgaacgtattcttaagcatggaataaattgctttattaacaggtctgtgtttgcttttaagaaaggatttttttccatgaaagtttatggaatacttcatatttacttatattgaattagattttttacctaggaactgtcttagataacttcacttaaattatggatttttgtaatcagtaaattgtgatttatgcacacttacagtgaccagaattacgggattgatttatacagttactataataaagaacacttcttttcaatactagtaatggatgcattagtactatagttgataaactctaattatataggtaagaaatgcaatcttgttctaatttgcatttcttttacttgtggtaaaaatgtttacatgttttttagtctaatgtagtttatcttgtaacagttgtgagcataatgttttcatgtattttatttacaggcaattaatttataattatcctgaacagctctttggtgctgctggtgtcatggctattgagcatgcagattttgcaggtgtggaa

SEQ ID NO: 70406 - DNA, 1568 bp, Homo sapiens
aaatattttcatgtcttgtgctgggaattgtatcatgaggtcttagtcttataggttggattcagaagagaatctgaatttaaactcaaaagtaactgctttaagactcagtttaaccttgggaaggtagtattgtatagtgtgtgcttataggtctgaagccagactgcttgagtttgaaccccagctttttatattcatcctagttaggtctttggataggaaggtaaacctcttggcctcatttttatcatgtgtaaaatgggataataatggagcctatccaagaggattattttaaagattaaataattagtcgatatgaagtatttaaaaagagtgccaggaatataatcagcaatcaatttttaaaatgtgaaacacattacctatcattatctatccattactgcttattagaaaacaggaattttaagcctgctgtgcatttaactaatacatgtttatgtttataggtggtgaaattgcctctacctttgatcacccagaactggtgaagcttggaagttgcaaacttatcgaggaagtcatgattggagaagacaaactcattcacttttctggggttgcccttggtgagtgattatgtagatcctggttagggtgtctaaattcttgctaggctctgttgaagtaaaggttattgtagttactagaatagcatatcttacaagtcttaactcttcagaagcatgatacatactttgtttcagtctcttgagtcaacctcatatttaccgtgtctttgtgaacagtgcatgttcaacagttttttttccttgataacttagaaccattatgagccttgattgttggagaatgtataatacaggaagacaggtcagctttcagaacccagtaatataaccaacaccggcataaataatagaaggcaaactttttatccctaagtggtcactgtgtcttttaattttaggtgaggcttgtaccattgttttgcgtggtgccactcaacaaattttagatgaagcagaaagatcattgcatgatgctctttgtgttcttgcgcaaactgtaaaggactctagaacagtttatggaggaggtaagcatttagaaaatgttgaatatatttttaatttcttaaagtacaatataagtcataagtggttttaatggttcttacagaaatcttatattgcttttgcactaaattttaaaatgcttggcatatcttaaagtcagtaattcagtatcttggagacaactaagcattgcaatattttattggaattttaatctttaggctgttctgagatgttgatggctcatgctgtgacacagcttgccaatagaacaccaggcaaagaagctgttgcaatggagtcttatgctaaagcactgagaatggtaagttaatcaaaatgagagatccgaacttaagttttgtggttattgatagttttaaaatgagtagaaaatgaactggttaatactgcttttaaatttgattctggagtttctcctcttcgtgagcagtaactgaagcagattttacattgttcctaaatgtataattttaaaaa

SEQ ID NO: 70407 - DNA, 1028 bp, Homo sapiens
gggtttcaccatgtttgccaggctggtctccaactcctgaccttaggtgatctacctgcctcagcctcccaaagtgctgggagtacagatgtgagccgctgcacccggccccttttaatttttttaaaggctttctttgagctcatttgtaggcttatctacctactgagtaaagtagttgggtgtcctaattttattaataggattaatttttattataaatcattagagatgttttgatactttagttaaaactgctttttagtaaatttgtttttctttgcagatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggtaccctaacacttttctcagaaaaaattactaacagcaaaacaaaatagggagctgtatttattttataattagagttaatgaaaagcagagacagttttgcctggataaaagtatgtaagttatttaaaatatcacaactcttaacacttaagccagaaaaacttaaggggaaagagggatgggcagctgaggtagctcttaggattgaaaaggcacagaaagagccatgcttggaaaggtcaagtactgaggacagtagatgctgtgatgctttctattgtctttaaacagaatgatagcaaaaggaaactgagttctgtaactaaagtgttctagggcaaggtcatatagccacacctactcccagaaatcttcacaagaagtcagtgccctcacccacagttgaaataacgcttaaaaaatgtataataccttgtttggtctgatactgttttagagatcaggtatcttttattagcaaattctgagtaatttgcaataaagaaactgaattttaactcagccttccagacctaccagaccatgggcttctttttcatattccttattaatctccagaagactttttttttcaga

SEQ ID NO: 70408 - DNA, 1297 bp, Homo sapiens
agtacaaatttactagtacccttatcccatctttccaaaagattgttctatgcccccttattgtatggtcatcaaagaataaaagatgagaatagaaggtgcttcttgttggtgggggtgtctgcagagtcccaaggcagaacagtcctgatgtggtgcagggcatcacacagaggagggggctgagtggctagctcaggtctgtcttcctcctcacctaaagccagcagtcccatcctatataacccattagtccatgacataacttggtcacctcttaaaagcccaacttccaatactgccacattggggattcagtttcaatgtgagtgttataggggacacacatgcaaaccattgcagagttataacagttttaatacaggattctagttgtgtttgtatttagtataatactttggataaaatcatgctcttcatttttcactattgacttttttcttactctcataggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattacttggttcttatgtcttatatgtgtgtattctgtttgaactctacttaatggaaattaatgattattttcaatatggcattttccagcttaatgattggccatctacatttttgaaataattatcttgattaatataagtccaagtcaaatgtgataaacacgccatatattaatcttttggttttgttgctgggccataagaacactcaatcatggctgggtgcggtggctcatgcctgtaatcctaatattgggaggccaaggcaggtggatcacttgaggtcaggagttcaagaccagcctgggcaacatggtgaaaccccatctctactaaaaatacaaaaattagctgggcatagtggtgggcgcctataatcccagttgcttgggatttaatttacccatttaattttgtttagtgaaaatgccataaactagtactcatttaatttggtgtagtctaagtgctgtctcttgcattgaaaaaaattacgatgctttctgtgatgtgttttttttttttttgagatggagcctcactctgtc

SEQ ID NO: 70409 - DNA, 1001 bp, Homo sapiens
tgggtgacaacatccagccagtagatggggaaggagagtgtggagaagggcaaaaggtttgttttacaatgaaccaagtctagaggtgacatctaacacttctgcccacattactttggccagaacttgaagagtttcccctgtagaccagcactaggaaattgtcctggctggacagctgcttgtctggaacaactggacactgtggaagggaaacacaaacctttaatgggtggtcaaacatacctgacaaaggtgcactgtaggaatacatccgaatttatttaacatgcagaaggctagcttgcttctctttcttctgcttttctacttatcttttgtcaaaggcaagtttttaaactgtggaaagatatcatctgataagaatgaagacatgagaaattagaaacctgtaaccattgctggtgggtgtgtgtactggctcagatttggtggggtacagaggagccatcaatgaaaaacctgtaaatgatgcatatctatgatccagcaacactttttttttttttttttttgagatggagtcttgctctgtcgcccaggctggagtgcagtagcgcaatctcggctcactgcaagctccgcctcctgggttcacgccattctcctgcctcagcctcccaagtacttgggattataggtgtgtgccaccacacccagctaatttttgttttttttagtagagatggggttttaccatgtagcctaagctgacctcaaactcctgggcttaagtgattggctcaccttggcctcccaaagtgctgggattacaggcgtgagccaccacacctggcctgctccagcaacacttctaaggacggtttctaaagaaatgagtggattgctgctcacatctgtatgcacatggatgtttataatagtcatgctttgtaaacaacctagatgcctaaccacagaaaactgtttaaattactgcacatccatgtaatggaatactatgcaggggtttaaaataa

SEQ ID NO: 70410 - DNA, 1091 bp, Homo sapiens
ggccaaggtctttgcctggccagacaccgtggctcaagtctgtaatcccagcactttggaaggctgaggcaggtggatcacttgagcccaggagttcaaaacctgccatgggcaacatggcaaaaccctgtctctacaaagaatacaaaaattgcctggacatggtggtgcatgcctgtagtcccagctactcaggaggctgaggcaggagggttgcttgagcctggaaagctaagactgcagtatgctgagatcacaccactgcactccagcctgggcgatagagtgaaaccctgtctaaaaaaacaaaaagaaaggtctttgccaattttagttttgtggcccagcatttaactaaaattaaaacaatgtttttctcaagcatgatcccacctcacttgccccaccgttaacctacatttgcagcagagcgatacacatgttcagtgacatcagagtcacccagtgggaagtccgtgctgccaagcctgttatgatcctttggggtgatctggtctgactctcttgtttccagatgatgggaggagatcatgagaagttaaactacttgctcaaggttacgcagcaatttaaaaaattcaaatgcagatcttcagagcgcaagtccaggaccctccccgcaataccactcccagtcccatcagtaggactccaacagggcaggattcagcaaagctccacactgaaccctactgtctgaaagtcacctgagacagaccatattgaaccaatgccacttctccctccacatgcaaataggaaaaactctccaacaaaagaaaagcacagctcaccctgagccccttggggagtccaggttggtttgtggcgtttcagagccagatgtccacagatctccagtcaactcacagaatccactcacataattatgtaagtgctcttatatcatctgggcacataaatacactttcagaggaaacagtctcagatagctagctcaaagagaaacgtccagctggtggtctgtcctgaactcctccagggtccctgcttctcagacatgatgcctgctggacatgagttggatcaaagaaatcctaaaaggagag

SEQ ID NO: 70411 - DNA, 1080 bp, Homo sapiens
gtggaagtcgcagcatgtgaagagttgccggttgttatgggattaaaaaagatgaaagggtaaggtcttgaaagacacgagcgctgagttagttagtactgattactgagaggcaatttagtttcatggaaatgttgcctgttcggaggctacctgttatacactctcctgtttcaccccaactccttccgttcagtgtcgggttaaaagccttgtaatctcttgcagtggaatgattgcataattggaggaggggcccataagaggattacaacaaaactgttccattgtaaatcagttgaaagacccagttcttgttcattatcctttttctcattttgttgttcatgaaggtttttttttcttccagtgctgaatgacaaatcaaggagaaaagaggcagaatagggttgtagaccaatcgtagtaaatatttgatactgttaaatatttcaccagttttatggggccttgttctgttatcatttgttatttatttactagtactgtgcattttgataggacttttcatgtttggacagacagtgtattccagatgcggcttatgtgatctaatcctaaagcccttgtggaatttatagaaataaacagttatacaattaagtagtccattttttaactattaaatgaaaagccattgcatttttttccattacagtaatgttacatattaatgtatacctttgtgaaccaaagtgtttgatacaactcttccttctgtgtttggtaaacaactcatctgtggtactgaatacttgtaatctttcaccaggatggccatttaatgtttagctgctttgtgggatttctgaatagatcctattgtactttttgaattagtgcagttatccatatgtttcctttaatattctttacctttgattttgtctaaactctcatcctcccccaacacacacatcctctacaaataatttttaaaatggaaaggttcttagaaatgtttcaccccctcattttttaaatatggcacgaaaaaatactttgtagattacagtagttttatatgcattatagtagttactatacttttttcctcct

SEQ ID NO: 70412 - DNA, 1992 bp, Homo sapiens
tttagcaactgatcctgccccagtctagtgctcatctttccttttggggctccaattatatgtatgttataccttttcactgtaacccttatgtctgtagtggaaaagtcacctaaaatttcacattactctaagtttacttcactattttgttctcagataccttcaaacatattttaaaaacaaacaaaaaacttttctagcttttctaatcgttctccgttggaggtttggtacaaattgcataatccactattaatgaaaacagagtccatttccaaaaatttagtcaactattctctccatagtatgaattactttttcatttaaagttaaaatgttacttatcttgaagggtcagattagctgtgtttattatttttaaaacattgccagatagttttgtgttgacagccacttgtcccagaaaaattcagcaaatctgaaacatttgttatttttaaaaggagaatatttaactcattaaatttgacagctcttaaggactttgccaagatagccagaataatagtgcatggaatatcttcatggttaatatcattttgctataaatcattgatagtaaagattctcctatttaaactagtataagctgcaaattcacattcatgggcacacacaaactgcagtgttacaatactgtaaaagctaatgaacaaacgggaaacaaacagtcaaactctgatgtaaagaacttccacctttccattctaccactgtgcattttgacagatctagtgagggtgccattgtcaaactattcattaaatatctttgaagctcatttccttccttcctctgataaattgtaaactaaagttctaaaatgtaagttcttaaatctcggggcactatctcaagcaccctatatatgcttccagtccattcttaatcccttacagggattattctatacaagggcataatcttttaaaaataaaatgatcatgtcttccttaaaaaaactgtaaggcttcatattgcatttagaataaaacccacaattcttattccgatgttttatttggttaatacatataaacagaatgtaagctccttaagagcagggactttgtcctttcccagtacgtaatcagcatctggagcagtacctcacaaggagatgacatgagtaaatgtctcatgaataaacattatatgaataaaaaggaattaaatacctagagtttcatatttgtggtactagaagattaaaactctattaaagggtaaactgatttgcctttttaggttgctcttcacaaaattgtcacataataaaattttgggaatgtttttattgaaagctctaaggcttcttagctgtcattactataaactgcaacattattggtgtgttaatgtttttacttgtccctcctgtatgtctttgctttgactaataagaacatatatagtgaccacattataaaaagctgactgcaaaggagttggctttgacacattggtcattgtttgccttcgtcacattcacagtccttacgcaagtatctatccggatgattgatctcaacttggctgcctcagtggtaataggtcctaaaagaaggcacctattcctaatgtctcatagtttgtctctgttgtcaactgctgcttccatagttgacattgaatacttaacttcaggctaacttttggtagtatatctttgcttcaattgtaaacatttggcaagaactttttgaaaacaaatgctactttgtttctaaaatttgagatgttaactttttcaggaagctcataaaatggtgagagaagcaaatatcaagcaggcaacagcagaaaaacagctaaaagaagcacaaggaaaagtgagtttttgcagctcttaatagtataaaataaatttgtgataactgttttaaagataccttaacatctgttggattttgttctgatcgtaaagtagtgcttgttttcaatttggaaactacagaaaaatagaag

SEQ ID NO: 70413 - DNA, 1317 bp, Homo sapiens
atatgtgtagccatgtgtcctgggtttctgtataaaatacttctctctgagggtgaccatcaaaaatagtttgggaaggtactgagttagactaagtcttatcgatcatgaaaactgtgtaccaaaaagacttgatgagatctctcttttcatattgtgtttataaaggattctcacttaaataaataatcagttttgtctttcatatgtgagtcttacttgagaattacaaatcttcagagataagactcccacatttcatagcagggcagacttgttttccatccagtcctataaggaggaatgactgaaaccaacagtgcttaaaacatctagcaaagacgaaaggttttgcctaaaaccgtggcataattgtgtcttggcttctgtttaaaaaatgacttggaaagcttttgagaaagatgcttattaagtgcttagagccagatcaatataggggactggaaagactgagagagctcatagaaagcataactgactgctgtcagggttattttgaagccagaagaggaaaagactggttgagatgaactaataggtctgtgttaaagctgttgtaggaattgtgtgcttgtttctattccctgttacgcacgttacggtctcagcaagattacagaatgttgttgtttaggtgaccatttgttggagggttcctagtcatatgtttgctctgtgagccacacgtccacctcgctccctcaagccacacgtgtagcacggtggcctctgaattttagggaaagaatttacattcttaaattctacaaatacccaagtatttttgttctgatccttccaccccaaatatggagagttaaatttaatcatagcagttttcttatttttaaggtctgtgtcatgcctcattttaaatatagcatataactgtttttattgtagaatttaaaatttgtgcttgcattatatatcacatatatatgtgcagatatcatcaaatgataacaaatggggatatcaaattaaagtggatttatagtatctttagtaaaataattatagtttagatttagagaacagtttacaaagtttaaggatattgtgcttgtgggaatggggccagaaaccaaggtgatgcatatcgtggaaaaaactaaaggaagatactgtcttcctttatgaaatgtgaagtgtggctttggccgtggttcttgtgagctagagtgtgaagataatgactaagtgagtggcacagcactgtaggaattttgaggaagacaagatcattcaaactatgattaggtactcttcttgaaggaagagagatttggttta

SEQ ID NO: 70414 - DNA, 1727 bp, Homo sapiens
ttttataaggtggcttattcctttgtacttctccctaggtcccacattaaatgcatatagagcaaccaaccaaccaaataaacaaataccccatctggaaactattaccctgcaagctatcaataacatgctttgagacttgaacagtcatcatgaggatattttcagctgagaagctgaaatcctgatggaaagctgagagctgtcctgcagctgattactgatttgtaaatttgttccaagatgggacatacatggaaaacacctagtttctgtttctagaatcatggttaatgttatggcattaaacttatactactaatagaatgtaagtctcacaagggcagagactttgtccttttcatcactttagcccagcatctagaacggtgcctggtacacagtaggttctcaaatatttgttatctaactgaatgaataggcaacttgtacagaaggtaggggcaaatgcttttcatttcaaaaaactgaaatttatcattatttcacagaaaatgtgctctcactggccagagtaagtcctgtaaacacagaattaaattaggggactcaagcaactattattatatttctcctttttgcagatacagggtaagtgacttaaccatgaattttaataaagcttgctttgatatgggacatttgaccattcatgacattttctccatttggcctagatcacttctgtatgtaacttttttacatacattcgatacattcagcagggactcgtgaaacagcaggatggtgagtgttcttgattcaatataagtctttacataaaagttcagcaaaaagtataagtaaagttcaacaaaaagtatagaatagtagtaatgctcatatcagctttattgttggtacatttatattgaatcccttctatagttctaataaaatttgtggagaatttgggaacaaatgtcttttagaaaaatattgtgtttaattattttatttgcctcattttactcttaattttgaattttaagcagggtcagttttaactcataaggggtatatgataaaccagatggtaaatgagaagagagttctaagctcattgaattgactctttaagagatgaaaatgagtaggccagcaaagtggtcagatttattttaattgatggaaaccatcatggagctcaaaattaagttttccctgtattttctactttttgcgtgtgaattaataaagcagtcatgaggataattctgaatggaataaagattgccatattctaaatcagcagaaatgtgcaggtgatatatccaggagaaccaacctcatgaaagtgtgttaatatttttaatacaattttatagctaaatatcttaaatatcaggcatgaaaactaatatggcctgacagctccaaagcagtatctctcgagcacaaatgatagtttaaaaaaaaaaatagcagatactaggctagggacaagtctgtgccagttagtatttaaagttttacaaaatttccctgtttatattttttaggcactgaaaatattatcttgcttaaacactggtagaagcctaccatctttcaatcatgtaaagcagtgaatcttaattctatggagaagttagtcacgctgataaaaacttagtttagcctttctcaaggtctggtatgttgaaaaatgtcatatttctttaaaatcccatatagttggattttaatgcctaaaacattagaga

SEQ ID NO: 70415 - DNA, 1053 bp, Homo sapiens
tgttgcttaatttagctttataaatagactttaaaatcactgttgtacaaattttctttttgaaacttaaatttggcattttacatttgcccttccaaacccattctctttaacctactctattgcaccaatctctgctcaccttcaagtgcaagcccaaagccctcccaaccacacaaatccatagcacacattaagataggaagagacagtcaataataattgaacacttaccatgtggcaggcagtacaccaaagtctttatttatatatatgtgtgtgtgtatacacacacacacacacacacacacactaggttgatcttcaaatccaaaggctttttatgtgccatcttgtttaatccttacaaaaccttatgaaatagatattattcacatgcttacattactgatgaagaaactacatttcaaaaatattaagtgacttgcttaagatggtcataaactagttactggtaaagctgacacttcagctcaggtctacctgattccaaagccactatgctactgcaacatataaggacaaagaaaaggcagtggccatgcctagacaaaattatgaagaagacaaaagtctgtgttttgtgctctcaattcccagccaatagaaacccattttaaaagtatagtgtttgatgagaaggagaatattcaccaaaggctttaagtattaagtattcaggtgggtgggatgctcttaacattatgatgttcattaggaacattgacgtctaggacattagagctcacaggatacttagtacaatctaatttaattccttcaatttacatattaaaaaactgaggcctggagatataaggttacaattcttgtcaataacagagcatcgtaattgtgattctacagcctagaatctgggtccctttttctttcaatctacagattcctgaaaacaccaaggccttgttgtttcataatgtagatgaatctgatgaagcaaaatgactttgaatgaactttagagggtattgcttgtatatctgctagctgatttttttctaggttcagtta

SEQ ID NO: 70416 - DNA, 1505 bp, Homo sapiens
ggcggaggaaccacagacgcttctgtctgtgaagttgcaagtcctgggtttctacttccgcaggggcctctccaccttttgctgtcgtaggtctcgcttaaaagtttaacagaagaaaagagtagggttaaaagaggcctttgtagttcttcattgaagcactgttgtctgtccgggtgaaagctgataactcttggtaactgtggtccttagcaaaagagaattggagttttcttttatacaaagtatttccaaggttttagaccttatatttattccaggcctgtaggtacggtattactaccacaaaagtcttacattaagggtaccaccctctcagagggaacctaaacatcaacttccttcgaatccttggagacatcttcacttttcaacatccggaagactgagtgcaacatattttgtttcattttcataaaagtcttggtcagagaatcccactccttttaaaatcgtttgggcaattcctcataattaagtacactgctttgaacccttagttcttggcgaaatggtaaaaagtactcagttaaaatcagttcacgagggaggccaacttgaatttaaggttcaaagttgaacatatttagtgtcatgcttaatattaggaatttttagagctcggaatcataagtgtgactgttgatttcccttttgaagcaatataaatggaaagaataaagtatggggtgagggatgagatagaaattttaaagtatccatttacatgcaaggttgatgttgagtttgggaatgcttggcataattgacaacagttctttccaaacgtcaatgaataaatctcacaattttgtaaggtaactattgcagattgaaagggttaagaatcatagttggctgaaatggttaagtgtctatattcacatcccagttcattgaaatgttttataatggaccaagataattagtaagctctgtatgttgaatttgtttagtttgtagttctattataatgttaaatctaaagaaaaaaatacaaaatacacttaaagacaaaacatgttccactctactcacttatttcttgactttgtaagatccttactgtaaaaaaggtacttttctctcatattttctgagagcttgaattgtaataatttttgtgaatactttgtattttagagaggaagtgagaaactgctgaagttttttttgcatcttgattagtgctttatcaatacaaataagttaatgtaaacatttgttggcaggaatctttttctaagtatacaatgtagagatatctgtaacctaatctgatctcagggaatgagaattgcctgtttaaccaagcaacaaatacagcctatacaatttttcaatttctataatactttaatttacatggtggaaaaatgagggcaaaatgcttgtgtatgagtgatttatatccccaagtacctgctcttgaagataaaactcagattgtggcttatcttctgatgctgggcaaaaaacaaaaa

SEQ ID NO: 70417 - DNA, 3633 bp, Homo sapiens
aaagtacctgtattttgaaagaccattacagaattttttacaacctgtataagttatagttttatcttttctagtgacagacttacttcataagattttctgataatatgaataaaatgtatgcttcacatgtatatatgaaataatgagtaagcattaatagaccaatgaaaagaacttagcttacaatttattttcttgctctttaaaagcagtggtaaataatagcttttttttgttgttaaaatttgtaactgtagaaagttcattctgttgggatcacatatttgaaggcaaactaacaatgccatgtgcttgcttgaataggcatttgaggacaggttattttcctgagatttcaggaaaatataccaccaaacatttatgatgttatttgttacctggatctgtagtggattttgtaacacaaagaggcagaatatccagggtaccaggtagggcagtttaggggcagagttaatatgaggtgtactgtaatgtttgagtggaattacatacagtgttaatcaagagatctagtgctatggtagaacttattctgcttgatgatacaggtgactgttcttccttactaagagcagtttctacctgtgatacttaaagggattgaatttcactgtgacttatatcagatattttgaaaagagctgtgctaaagttgatgtcattgtagaaagtttgccttgaagtggaatgaaagttaggtttttatttctttggtttttctgtttgacatcctttgatttctattttagaattcaactcttatgactaatcatgctgatgtggtttgttcatttattttctttgtctatactattaggaatgtcctggaaatagaatttgtactgtgttttctgagagcttgttctctgaaatacagatgcaaatctgttggtatctgttggtatatcccttgggggtgtgctgcattataaagtaataaaacagtttacaatgtttgctttttgtcaagagcttatgacatataatatggaaatacaaaaaagtgaattatttaggaaaaaatgggaaatttttccttttctgggcacttcagggttttgtatatgcgtagactcaggatctaagtccacttagatatatagttagatattttggactatttgccacttaaccctgcacattttcttttccttattcttttttttttttctttgagacgaagttttgctcgtcgctgaggctggagtgcaatggcgtgatcttggctcgctaccacctccgcctcccgggttcaagcggttctcctgcctcagcctcctgagtagctgggattacaggcatgcacccagctaattttgtattttcagtagagacagggtttcaccatgttggtcaggcatgtctcaaactcctgacctcagacgatccgcctgcctcaccctcccaaagtgctgggattacaggcatgagccaccacgcccgtcctattctttttattcatgtgtatgttattgcatgtatgtgtgtggggggcaggtggtagtgcatattttatgtatctttcacttctctgttgtttgatgaacttcttccatactcctctttggtatcactttcttcataaatctttcctgactccccaaatcctttgctgtattgctttttactcttcaaacttctattatagaatgtcacactgtattgtaatttactgtccatctggactgggagcacctgagaggtatggccttgacttgtttatgtttatgttttgaatgcctctatagtgcataatacttaataggttctcaatacgtatctattaaactgaactgttgctagattgtcatttgacagtgctgtttcacaatccacagatctgaagcaacagattggaaaagtggtggggagaatagcttcctgtattccttcacttccttgaatcctttcttacagttttgcttcttaattacatatggaaaaatagataactagcttcttagggaagtgtgtgtaaagttagtatggaattagggaaggatgttagtaatagagtgattaataccctgttttgcttctggcaggatgtttagatctgtatttcttgcatttctcgctgtattttgtatggttatggctattatgtgaaggagatattttgtatttgtctttacaaggtatcatgtttaccagtacttacccatgagctcatattagatttggggcttctgaagatagattctgtttttctcacctttttcctcctaatgcctggcccattggttagtagaaagcaggatttctctagtttgaataaaattgcccttatggaaataaggtgagatgtgtcttattggaggtccaaaatttaaaaagctctgaaagttgatcatttcttttgttttgttttgaataagcaaggtgagaaaatatcaactggaattatacctgtgaatttgattattattatctttcttaatctgattttcctacattttcatatggaaatgttcacgtgtttgactgcaggtgttgccattggcagatgttacatcatatatgatacatacaacattttacctttctcaaatctgaaactgtgttttgagaaacatctggcctttataggtttgtttaagagattgtgagccaattttctgcccattttagagatgtagaaatcaaaacaggatagatgactctcagaattgcattttagtagatatgctaatattgataatgattttaggaatattatgtcttaattgcctgtatatgttccagagaccttttagtgactaagagctgccaaagatacagagtgtatatttttaaaaagggagtatgatccagtactcaggacaccagtcctttctctgccttttctgaatggaaatgtctttccttatacgtgagtagatgaaaatgcacatttagtaagtttttactaaaacttagtaaaaactaatgataaaatgagtgagggaaaattatgtatcctggcaatttaggtaacagtgagtagacttgcttgtttttcaaacatattgatatactatttttccatttgtgtattcagatgttgaaacagctccagtttgtattagcatctggacaaaatgtaatgactgattatgtaatacaatgtgtttgagagaggagcatttggttttgtgtcatatctggcaagaatgtgcttttgtattactttctacattgtaaattataatgcctatcctgcatacaaattttgtatttagttttctgcttgtaagaatctttcataggtcagtaaaataaaatattaagtttactatgccattccaagcacctgactacttttggctttgctacttaatatttttaaaatgttttacagcttgcagagaggacttttatatacattatcttaattttatatatattaaaataagtttaaaacttagcatttatgtttataaacaagctattttggtcaataagaaaattagaagttgggaattatgaaggccgttttcatcttcagactggactcagagtctaatttctttctcatttattttagcgctactttatagagaaaatcgtgatttattaaatcaaatagatgttaatggaagacttgtttttgtttgcatctgatca

SEQ ID NO: 70418 - DNA, 1016 bp, Homo sapiens
gattattttttattaaggtgccttgaaattgttttctacatcagatgaattgcaggggttgaggggtggtctgtctggagtactggaaaatgacataggaaagcaaactgaaaactttccttaattcatgtgtttatgtagaataataaaacctatacttttcttagaaattagtaataagtttcatatttaattagattttcttgtacagtccaataaatgttactttgtgctgtgcactattatagttgcactgcgtaattcctcaagttaaatttttgtcatactgtagaaacatcctagagtagagtaactttgtttcagggagttaatgagttggcttcaaggaggtgataagtgagctctgggttctgaagggtgatttgtagttaactaggtgggggagggtagggaatcagcattgtaaatgcacaaatcctaggaaaatgttctagatttggagaatggtgaggtaatcctccatagcccttgatggaattctgggacctcataggagaagttagttgaaggaatgaagtagccacagtatgaggtcttatcttttatgtgatgagggaaccattaaccattaggaggggaaaaaaaagccagtgagattgataagcagattcgtgtttcaggggaaagtttagattccacagtcgatttacaattaaaattataagcttaatggtgtatgtttatgacatttttgaaagattattttctctccattaaacaaattgagtactttgcattcatataagcaggatttttatttgttaagaactgtatgactttgaaactctgtagtctatcttttagagaacttgttatatatgtaaatgaatgccaactgttcaagatttttccgttactggggtggaatttttgtatacgttttggggcaggcaaagtttgagtattatcatctgatgtaatgtgttaggcatgagatttaacattcttggataaattgaaataataccaagaaaatctaaatcagtgataaaatc

SEQ ID NO: 70419 - DNA, 1101 bp, Homo sapiens
aggtcctgatgctttctctatgtatctatagcaggaaatttacttcatcttaactcctgcttcattagggtaaaatatcatgataatctttggggtattcccatttttgtaactgtatttgtgtcctttctctttatcattgttagccaagtgtattttttgtgaacatcgtgtctgtttttttgaaattcatttttaatttatagttagagcattgagaatgtcagtgcagtagtttgaaactcttgtgtattcttgtgcatatgtgtatgaataacttacgctgttctttgtcccttaaatctgtaagatctcttgggtactgagccttttgaagcattaaaagtaaataccatataaggcaagcagaatagtactaaatagctgcagtagcaaagcaaggaaagtgaatcacagagtaatgaatttggaaaatgactgtcgtgcattgtaggaaaaggcattgcttttactatcatccttgtaaaatctagttgctgacattaagtatttgttgtatgtgctgattatttaatcgtgtactgtaacaaaggcacttacaagcaaaatactttttcttctaaaaacatatactgaaactctagaaattggagtacagctaccctaaatcctcagttagtttgctattcaattctttcatattaactaaggcaaataatttaaaattgagcaaataactcatatctaaaacttatttataaaacatatttgtaatataaaacatgaacttctagaagatctacagattctggtcaagatatgcccctttataatttcaatagtttaaataatgattgtcaggcacagcaaaatactcaggcatcagatactcagttaactctgttatgtttgctattcttagaagattattaccacactttagaacagttttcaatatccaaggctgtttgcttatttcactggaattaactaaaagtaattagggaattcattcctcagaataatttatatcctaagctttatgatgaagaaggcttttatttctaattgtatattccagccttggaccaaaaatgtacatgctaaaatatcaagacaaggcaaagatatatttttgct

SEQ ID NO: 70420 - DNA, 1475 bp, Homo sapiens
agctagccagtaagatccagagtcaggtctttgacttcaaaacctcctgaatttttgtttgtactgttcttgttcaagcatacttacagagcctttcacttttacagtgaaattcagaccgggcttagtttttagtgttgatctagggtgagttttcatgcagggcttatttttttttaatatccataggaactaataccattcttatttttaaatcaactttgtcaaggaagtttacatataatacaaggtacccgtttaagtgtccttttttaaattagttttcacaaatttatacacccgtttaaccatcaccatcattcagatacagaatattcccatcaaccctcaagttcactgattccatggagaccccaatcatggccctggcaaccacagatctgctttctgtcagtatatttgagattttttctagagattcgaacaaacgggtttgtaggtactgcattgttttgtgccttcttttgctcaacataatttcatgacttatttatgttgcatgtatcagttgttcacttctgttggatattgttttgttggctagtactcttctaactggtgcctgaaacgtttgttgaatgaatgcatataataaatatcctcttcccccagttttgccgctttcctttatcatgagactgctaaaacctcttctagattttgtatgttgctagacttaaatttgtgtatagagtatttgaagagataatagtgaaaaatgtgcatgatttggagctcagtatttgttaaaaagactgttttctctatttatttatcttagtacccttctctaaaatgagctgactgtatatgtgaagctttatttctggactctcaattctgtttcattgattggtatgcctatccttatgccagtatcccttgattacgatctgcaattttgaaaacaggaatttttgagaatcctccaactctgttctttttcgagattgttttattagtatctgctccatgaatttccatatgaattttagaactagcttgctaatttctccaaagaaaccaggtggaattttgatagaattgtgttgaaactgaacatgggatgtctttctatttatatagttatttaatttctttttttttaatcaattgagtaccaaaatagactttaatttcttttaagaatgttttgtagtttttatggtatgttttgtattacttttgttaaacttacacctaagtgttttattctcttggatgcttcagaaatggagttattttcttaatttcatttttggattgttcattgttattgtatagaaatgcaattaattttggcgtattgattttgtaccctgcaaccttgttgcacttgtttacttaattattataaaacattactattaataaaatcttaagtattaaactgctatgtaaactgttgtatattttcaagtctcctgttgacttatcttgtatctagttgttgt

SEQ ID NO: 70421 - DNA, 1037 bp, Homo sapiens
tatttgttaaatttcagaaagattctgctatttatttgcctttaaggtcttgttcaactttaaacaaaattgaaactggacatcttaaaagatgcattatagatgtgcattatacaaaaaatgatgtgaaaagttaattactaatcctacactcaaaagcttgtcctacgtcagactatcaagggggaataaatgtccatttgtattttaaaagtatttgatttggcaggaactaacttttaaaattaaccttccggttgctggtctttttcttactagacaaggtgcttctgctgcagtccttgtaaggaaaatgatgtttccataaaattaaagttagtaaaggatttagtatatttcttgtgcttcatttattcagtaaaatgtatctgttatgtatcacttattgtaggtacttgtgataacagtgataagcttaatagacaaggttcttctgcttaaggaacttcagggatacagacagaaaacaaatgagaacaaaattcagactgttgggtgttcagtgaaggcctttctgaaaagagatagtcaagcagacatgttaacgtcaagaagcagtttggcatttggagatttggggtaagatcgttgaaaaggagcagcaaatataaaggccctaaattgagaactgactggatgtgtttgagaaacacaaagaaaggcaatatggctagtacttactgagatattctcacttcttttcttactctttgttttcttacctatcattagtaatcactatattgcttataccgttaagtctgttgcttctctcatgcttcttaatactcacaacttttggttaagtctgcttctacctatactgttcctgcatccctgcagttgtgtgtggctagagaacaccagcctcccatgggtccttagtactacttggcaattctacctactgtcgttcctctaatcccttcactctccctttcttagaagaccttttcctccctcctcagacctgtaacacttcctcccatattcttatgctcacccgataacttcat

SEQ ID NO: 70422 - DNA, 1057 bp, Homo sapiens
acttgtgtaaacagatgtacttttcgggcagcaggaagactagaaacagcccctgttgtctgaatttcagaccccagttttatttaagcccatatcaaatgaagagcttttaattttcaagcctgtggttcagaaattattgaacttttgtcgtttaagatcagtaggattccctttataagtattcacttcatttgaaacttttaagccacagtagaagaaaatttctgtctcgagatggtgggccttttagatagacctgactctctacttatagtaaattttgtgtatcagatgtgtagaatcctccttggagtatggatgtgagacaactgtacagttgagttaaaagtagtaccactgtggaaaatggaagacacatacaacattgttataaaacattatgacaaccagagagcaaattcatttcaatagattattgttaagttgtatttgtttttctttgtagatataggcaacttttcattttacatgctaattataggtctgtgaaacccatattactaaaatactcagagaaactgttcttagttaatatggcaattttcccagaccaggtatggtattcttgagttttatttatttttatttcactgaaattcttgagttttatttatatttatttcatctgtccatcaactcagaatttttaaaacatccatgtgatcaagcaaaaaattagttcataagggcaaggaaatatttatgtgactgcagtctacctattaagaaaacattgcttgatgtagttctagaatttgaggaacccttattttaaagataatggctaaatgcatttactgcatgttttattgagctccagtgaaatcggtcacatcttgtagtttgtcctaattaatagccaccccagaatgtaatgtcttctgttaaaaaaagagaaaacctgttcagctggttcagctgtcttaacctaaccaaattcatattttaactttgagtatggtaatgactaccaaattacagatattttagatactattttcagcttctaaaaggtttgggcattgtttaaata

SEQ ID NO: 70423 - DNA, 2604 bp, Homo sapiens
ccataattcttcaaagtgaacttgtatctggtaaattcttacagattaaatattaatacgtattgttgtggtgttagcctataaatttcagtcattattttttgtatataattaggttgtattaaagatgtatacagcattagggtattgaaaattatcttacctgattatagatttccaacattcttttgctgacattaatataattggaggtaattcgtagaccctaaatattatataagaaggaaaacattttattctataagtactgactgaaattttgcatttattatccactgaattcagagtcaccatgtatgtattaatggtaaggcatgtactactttacaatttaatattatacaacactaatattaaaacggttaatatttaggggatgcataataaaataatcttgctttctttttgtgacaatcgtgaaaatttgagttggagccaaatgtgcgtcatttaacaattcctgaatatccaattcatttgtaactttccttatgaataacctcattgcttgctaaatgataaagattacatttataatagtaaatatgctttaaaactttactcctttgttatttttgaaagagatatttaattccaaaggtatttataaatttggtaatcaataattacaattttgtcatacagcctgactgaagtattttggctaaacgtacactgtaagatagtcagacttaagtaaaaatacaactcccactacctttgtgatgaaacataaaagaggagccagaagataggtttttgtcacctgggttctttttaaaacttaaatttagtaatattcatttttaatttttttttaaatgttctgcccgtatagattgctttttagaggtactccatatatatgtgtacatgtgtgtttgttggttttaataattctaattcactctccttataaattatagattagatgttatctcctcacaaaatgtttgttgatattaaataatagctctgaatttgaataccaatgtttagtggctagcaagattattagttcagtaggtatgcatactacttccttagggagaatgcttaacaaaacttaggtaagagatatctgtcttgaaaatgcatatttacaaattctttgtagacccacctttgaatatttgaactctcattttcaatattcattttaaagacagcatttcttgtgactgtcacctcagcttcagtgctttttttatttttattttttattttttggtgggaggtggtacctggagtgcaagtcattttgacttatttatatctctgcagtttaagaaatcatccccattattttttcgcccaatgtaaaaaagtgaattccctattggagtatgcatgaaattggatgactgaaagacaaaagcatcaaaggaagttgacattttttgctcttctttttggagtaaagtttaatagattattgagttatgtttgtatctcttaatcgtgttaagaatatatgttgcattctcattttgttgcatgggaataaacctacacagaatgaatcggtagctgtgtgaataacttgtatttctatctatcatatataatcatttggaggggaaggatttatagttaaatgattgaatgtgaattgtatatttttgagataactggagaagattcatgtaaaagaaaaaaatatgtcagttgtgggaggggtaaacttttttgtccacttcattttttattcactgtaaatttctcccttgtgtgtgatgtctggcagacagtcttaattgaagaaagtagaagtgggtaggaagaatgtttcatatttaataatttctgttgcaaataaagtatgccagtctagcccgcgaaaatggttacgaggaagactagagtatagaacaattactttttgttttttgttttctgtgtatcatattgaatatttttgctgctgttgatatatttacatgttagtaattttgatggcttttggataattccactctagagggagacgtggtgggcggtccttcctgtgacacgacccttgagtgacagttctatttgattgcctccggtactgtgaggaaaggacacgactctatggtgaggactgatggacatacattatctgagaaaagaaactaccaggtaagaccagtctttcttcttttttctctattggtcttatagctacattgaaactgttcaaatgtgttatatgtaattggaaccagcaaattggttacacctcaatttgaaaatttgggtttataattttaaattaagtactggatttgatagttgaaatagttgggaacacttttcaaaataaagcatattcataatgtatattttttagtgtcaaatcaggttttctgagatatttgtcaaaacttagattatttgatatacaagttatgacttcatgactgaattcaaaatggtaaaaacaaaagtgttgattgcttttacgtatattattcctggaagactaaacccgaagtcttgtgctatattttggataacaaagtatatatcacagaaatgtagacaaaattgagtagagtatagaagaaatagaaatgagaaacccagggtgcttagaga

SEQ ID NO: 70424 - DNA, 1037 bp, Homo sapiens
tctaaaacattgtatttttgtggaatatagtatgtcagagaactgtaaaaatgattgtattgccattttcttccccaacattaaatatcttacttccttttaattaactttaaaaatcacagatgcctattaccaaaacgttgaagaaaaatacggaatataaaatacagtgtgaaagtttgccttgacaactttactcttaacagtttggtgtgtacctcttcagatctttactagtgactatatagtgtagatgtgattcattgtctttgtctctaacaaatgtgtatttttctgcattgtacttaatggagctatttccgtttcccattctttcctctgccctcttccccagaagtaatcaatagttttaattttgtgtttcattctttatatttttataacttattacatatatgtttttcagtatattgaggtacatcttttttatgtattgtgtggcaattttttggaaagtggtgccccatattttattattttgagtaggaaaaatcataatttccagcccacttaagaccctaaacaatttcctagatatagctaaagtactcaacacctacttgataattcaccaaggatttctgcataatacagagtatttaaaatacaaactacttaatataaacagaaacaaatgaatcactaagtatatttccatttagtatgtactgtattcagataatactttttcttttatactgcaataaaattgtaattgtaaataaacagttaagtgtatttcctttcttttattgttaagtggcacattattgaacatgtttctctctctgaagtcaggatgcatcttacagctgatggtgacttcaagtcatagttgtgacaaacagtaccagcaccaaagcatcttagaatctatgatatatagtatgttaaagatatataatgaatataaagaacacttaataaaataaaatcatagctgagtgtagtgctgtgcacctgtagtcctagctactggagaggctgaggcgggagattagcttgagccccagagt

SEQ ID NO: 70425 - DNA, 1037 bp, Homo sapiens
taatttcagaattaaaatttttttccatctattgaggttgtgtttgagatatattgagatattcttcatagtcttttaaaaaagattttttgttttgtcttccatatttaatctacctgaaattgatttttgtacatggtgttagaagtacagtttcctttcccctgcacctaaattatcatattagcattgtgtaccaatttattctaacctccttaactattcagtagtgctagctctattgtaaatcaagtttctctttatatgcatggatttcttatgtctctgttaccttgatgtgtttgtctgtgcctataccaatatcatgttttcttaaatactaaagctttgtgttaaatcttcatgtctgtctgtcaacctttttcttcataagagtcttgacttggccttttgctctgtgacaaatttagaatattcatgagaatgctcccctccaacacaaaaagaagtattgagtttgtaagtggaattgcattgactttagttttctttgtggaagaatcgataagtttatgtattctttcatgttttctctcaaagttttatatttttttcataagggacttagaaatctttagtccaatttatgactacttttgttgcttttcttggttgtaaattaaaaaaaaatttttagttataggtgttattgaaatatagttgacttttaaaattgatttttgtatctcaatgttgctaaactttttaatttttataatttatctgtaggctttttggggggttcatataagtaaacacatcctttggaaatgacagttttgaaattgtcaccagttttgaagttgtcatcattaaataatatttgatacaggattttttttatagatatactttatcagggtaaagaaattgttcataatgctaccttatatatttttttcctctgtagcatctttttcttcttaaggttgtttactatgtgcgttttccccttatttggtcagacttactagtgattcgtcagttttactaggggtcaaattttagcctttatt

SEQ ID NO: 70426 - DNA, 2486 bp, Homo sapiens
ttacacgtgggatttgttgagcttcttgaatttgtatgtttatacaaatttaggaatttttttcatccattatttatttgaatatattctctgtcttcactgtcctttgaggactccaattacgcatatacctaattgcctggagttgtcccatagcttactgatgctttgttcatttttttctttctttttttctcaccatgctttagttaggatagtttttattactgtttttttaagtttgctaatcttttcttcagcatgccaattattctgccttcttttacatacaaaatgtaattataactccttgcatatcattgtctactaattctgttactcatgtttactaatagaaactatgtctgtttctattgagtgttggtttttttttcctcctcattatctgttctcttttagggcttctttgcatggctggtgatttttgcttggatgccagtctttggaaactttatcttgttgagtgctatataatgtttgtatttctgttaatattctttagatttcttgtggttgcagttaagttacttataatagaagccatttgatctttgagacatccttttcttttttttcttttttttaggtcttgtttaacagaaccagagtaatctttagggttaattttcttccaactacttaagcaattcttttctgaattatgtaaattatgtttttctactctggctcataggaaaataaatgattcccagccctgtctgggccctggggattgttttctctgtttctttcaggtggccttttttttttgttttttttagcttctggtagtttccttccatgcatgtgctaatcagtacttagctgaaatctcagaggaaccctctgcatattttcagagatctttctctgtgccagtcattcttgtttagtatcccagcctattctggctgcctttaattgccctcttctccacttcctcaattcacaaagattgctgggctccaccaatctggaatccctctccctcactgcacactgaaaattctttcagtcttataagcaagggtagttgttgagccctcaatgattctttctctggtctcaaggattattgtcctgcacggcctgatatcctgtgtctgaaatcaattgtttaatatattttgtccattttcaagttgttttaggtgggctgctgctacaactaatactaccacactactctctcggttggaagtgaaagtcttaatgtttcattttttaaaattattttttcttattaaaattttttttatagagacagggtctcactatgttgcccaggcttgtcaagtgatcctcccacctcagcctctcaagatgctgggattacaggtgtgagccactgcacccttatttcatttttaaaaactatattttggttgagaagatgaatgaaaaccatccctgataaagagaataagcttttgtgtcaatattcagataaggcttggatgctttctcttgtataaaatactatacagtgtgcaatatacacaaatttcagaccatttctcagcatttaaggtcatttagaatgaaaaataaaacagtacaggtcagtaaatgaattccagttcttatgtagaattgtcatagtcctgattcaatttaacttaaaaattggactgtttcctctgaatttcctgattcccttaagattccctagaatccagtaggcccatagatacagtggtcattcattttctcagctgtcaggtaaaaattttaccaataagcatttcttactttaaaaaaatctgtgttgtatagcataaaatagtatattatctctgtattgttttatctggatcagtaaattaaagacattataataaatgtgctaatgaaaatataagatgttttcaaggaaaaaggaaagacccttattagggccaaaaatgctaccggcacatgaaattttacacctattcttttctaccaaggcacttttctaaaggcactgtgataaaactaaaacaaatgtgcttggtagagtgaagagcctttagtttgagccactagtcttcacattctacctgaatcacttgggtccatttatgtaaagtctttgacaccgtgttcatagttaacagtgaaacctttaaaagatttggtttgctttgttaaagcatttccattaaatagagaaggaaagtagaaaattaccattaaaacaccatggtaggccaggcgtggtggctcacgcctctaatcccagcactttgggaggctgaggcgggcagatcaccaggtcaggagatcgagaccagcctggctaacacggtgaaaccccatctctactaaaaatacaaaaaattagccaggcgtggtggcgggcacctgtagtcccagctacttgggaggctgaggcaggagaatggcgtgaaccagggaggcggagtttgcagtgagccgagatcgtgccactgcactccagtctgggcgacagagtgagactc

SEQ ID NO: 70427 - DNA, 2591 bp, Homo sapiens
gtggctttcagaatgcataacttcagtctaatgagaaaacatctgacaaaccccaactgtgggacattctgcagtgtgtatgatataacatcaatattatgaaagaagaaagactaggataagtctcggattggagaagactaaggaaatgtaaaactaaatgtaaggggtgggggacaaagtgttgtaattttaaatacacaaggaattccttactgagatgacttcacacctgaagtaggtgaagtaggaagccatctggatgtctagaggaagagcattcctggaggataacaaaggcaagggcttggagacaggagtatgtccgatgtgtttgaggaatagcaaggaggccagtatggcaggagcacatgaagagaaggggagaatgctaacaggggagattagagataacaaagagtaaggtcatgaaggccttggaggccttggtaatggtgcaggagtccattgtaaatgtgtttcacctctattccgtttgatttctgatgttcttttattctgagcctgaaggggataaagtgtataagtataaaatgtaatacctaacatctagcactgtgtgtagtagatgctaactcagtgattattgaattagtgtacatggtgagatgtttagaaacattttaaagatcatgtcttcccttgctaaaggaatacttttcatttttaattacttcctgtaacataaattaggattctgatacctctgtatatttttaaaatgtaaaggttttaaaataatttgtcaccttcaataatatctatttatgctattgaacagatgtcttaaataagcttctatttttattagttttagtatttgtaatagagtttatttttctttgaaaataactcactttttatattttcaaggattcaacatttttgtaaaagtgaattgatttcatatcttttttttttttttttgagatagagttttgctcttatcacccaggctggagtgcagtggcacgatctaaactcaatgcaccctctacctcctgggttcaagagattctcctgcctccgcctcccgagtagctggggttacaggcatgtgccaccatgcccggctaattttgtatttttaatagagaagggtttctccatgttggtcaggctggtctcaaactcccgacctcaggtgatctgcccgcctcagcctcccaaagtgctgggattacaggcatgagccactgtgtctggcctggatttcatatcttatttaaatcctatattcagattgttttgttttaaaatcttaaaatttttctctttattatcttgtttggttaaagtgccaggttttttttgatggaggggtccttatttgtttttatcagcatggagcagttaagaaattcactttttcccaaggattgtacttatatcagagttatgtgtaggttttaaaagttcactggtccacctttacgaattttaagtacatccatatagtacaactttaattctgcttgttgatggtgttaatgtgtatgagagccttagatttaatgttgagtactcaagagagcaagagagtgtacaaggagtggataggcacaaagtatttgaacacactgtcttacatgttttcataatggccaggtaagctctgtctttgcattttctggaaaagtgtgcaagtttgtggtgagcactgcttttttttttttttttttttttttttaaacttagtactttgaattagtctgaaagatgaatctgggtttggccagtaatgaagaggtgaacagggagtcataatgttgaaactggacattcagatctttatagcatgatttccttatttttcaaagagcggaagaatcccatcgtttatcatgttctggttggactttcttactgtttgctggagttgaacttcagagctatggcgtcaaccctgctgtaatatctcaggggagctcctagggtggggctggtgccatggctcaccctccaacctttccttcttcacttcagcctccagctctgagctttccaatccccagagtagcaaatgttgaaagaagttgcacaggtaagtatgtggtggggaaagccgggggaaaaatggtactgtcatcagtattttgagggtggatgttgggccattttatcaatgagtcattttgttagtttagaaatataatgtttgttatcaattatttttctcataaaactcataaattatttaaaaaatagtgaagaaataattttaattcttgttagatgtgaaataagaaaaaaaccttaataaactattaatattataatgcaaaggaaggttcttacatttttttaaactttatattctccacagtgtatatagcaggtccagaaaacccatgttcaaaaaagaagctaaaaaaaaagttggggaaggcctaagtccatagactataattttgccatatgtaacttggtctcaggaggaggcaagttttagttttcttccactagctttagatgtgctattttttcctgaggtattaggcaggtagctatgttttaatctttacagaaatagaaatttcaaacatctttttccttgaagtcttgacagg

SEQ ID NO: 70428 - DNA, 2447 bp, Homo sapiens
aagtatgtgagggttaaaagagattggggttctagtgtatttggtatttcaggtctcaaaacaagtcatcaaaatacagacttcccagcagtttgtctccctttttttcttgagttttttagataactggacgctctatataaacacatctccctcagcaaagtacatcccgtttttttctcaatatgtattcatattcccttccttcctccctctttatcagacccatctttgcctaccgtcttttaaggatttaaaatattctcattagaagattttccttctgtatgcatagaggatttgtttttattctaaatgtagagattttctactgttatatgtccttccatttgtattttatagttttacatcctaatatttaaagataaagtactactttaattttaggctctattatgtgagttctcaactccaacttcttactgctcataagaggtactaattatatttagttctttagtatatgtgtacttttttcctatggattagcactttttgaataattagaattttggttttaggatgatgcacttagcttttaaagcttatatattaattgttcaaatgtgaatctatataaagcatattggtgcagcacattttaagattctagaaaaccacaaaatctgtttattcatgttgaaacatacagaacatattctccctagatcagagtcaaacttgtggaggtatttgtagcattttggtaacactccctagagaatttgtagactttgggggtgcatattaagggataacatacatggcttttcagaatattttctgaataaagcagcttcagacaccagattttagtttttggattaggaaagagtgatgtgtttttccaccctcccctcccccaccaacacacacacacataccctccccatctttcagatataggccatcttgttttattggatgagccccccaaaaatacacagaaatatgctaaatatttctgtaaaccttggaaaggactctgccaggatatttatctactctccaaaatagtgattgtggaagtgtttgtataggtccctagctttctactaaagcctatttccaaccagtcatagatttttgtgtgtgtgtgtatctacatgttaactatctttggtattcattgaggccttttttgcttatttatggttattctgcattggctaaaacaatgagttgctcttatttgtttccatgctatcgatttgatgatttgtaattctagactttaaaatttatctatatcttcacttttcttagatccatcctaagcagattcatgaacttttcattatacctatatcatattaaaaatatgaaaccatagtattctagaactcggaggacttgaatttgtttctcacatgaagagtttttttttttttggtaaagatttccaggtattaatatctttgttctttaagaagctagaatttttttgtgcagtgtaggtgcctttctgtcctttatttaagcccccccccctttttaaattgtttttcaagaattaaataaaattagaattatttatagtagttgcgaagcaggataagcagtttaaaatcctatcacaaaaaatactactgaaacaaaaatatctttgttaacaaatatttccaggttgtaacaatataatatttgatatacgaatattctacttccatagaatttgggcagtctgtgagatttttacctatcatgttttccctctaaagggcaattataaaaacgctagattatcttcaggtattaggactcctcatcattggtttcagatgttaattggctacaccttgataaaaggcagataagtgttaatggcagttggctgtgattttatattaagtttctgcctattttatagccaagaacttgtgcatatttgtatattgtttgttgatattgaatatggaattcagagagaaaataagaactcaaattctaaattactcagatctccattaggaaaacagtgcctgagaaacactttttcccccttctcaggtactgtatatcttgcagttagcagtcttcatcttgtataatgcaagcagactacaaactctgtagctgggagtgaaaatttgttactcagtatgaagcagtgaatgagacaattgattttatcgtgtgacacctgtaccaacatgttagcagtaaaactcctccctacattagagaatctacaataaaaagttgctactagggaattgtttttgttttaacacaagttctagatgtgccctacatatgtaatgctataatgtctacattagagctattataatgaaattaagagtttggttataattatcctaattccttgaaaggttaaattgtgttcactatacttaagtacctaaaaatgttagttctttgggaacatggaaaccaggtatatatagcttttagtagttatt

SEQ ID NO: 70429 - DNA, 7633 bp, Homo sapiens
ggttcaaaacccatctccgcatttatcagatatataaccttaggaagttaacctaacttctctggtccttagctacaaaatagggatagttaattgttcttactttctagcgttatcttgataattacataaataaattttaaagcatttagaatattccctggcacaataatttattattattttatagttatgataaagtgttttcagagactgtataaaacaagagtcctaatttagtgtgaaagtttcaaagaatgggagaaagggcattttaagtagccgtatcagcatatgcaaagaccgggacatggaaactaacttctgttctgagtaactgaaggtatggcaagggtttggtggtgtcaggggacttaggagagaagttagaggttacaaaacatcttataagccttattgatttgggagtgctgttgaggaatttttatcagaaagtccatgaagataaataatttttactttaaaaaatcactttgatgtgggagagtagaattgaggggaagaagaatagattaataaagacctgtttggaggctattggagtggcttgttctagtgtattattagtccgttctcatgctaacaaagacgtacccgagactgggtagtttataagggaaagaggtttaattgactcacatggctggggaggtctcacaatcgtggcagaaggcaaatgaggagcagtcacgtctcacatggcggcaggcaagagtgaatgtgtgcaggggaacccccctgtataaaccaccagatctcatgagacttattttttttttaattttattattattatactttaagttttaaggtacatgtgcacaacgtgcaggtttgttacatatgtatacatgggccatgttggtgtgctgcacccattaacttgtcatttagcattaggtatagctgctaatgctgtccctcccccctccccccaccccccaacagtccccggtgtgtgatgttccccttcctgtgtccatgtgttctcattgttcaattcccacctatgagtgagaacatgcggtgtttggttttttgtccttgcgatagtttgctgagaataatggtttccagcttcatccacgtccctacaaaggacatgaactcatccttttttatgactgcatagtattccatggtgtatatgtgccacattttcttaatccagtctatcattgttggacctttcggttggttccaagtctttgctattgtgaatagtgctgcagtaaacataagtgtgcatgtgtctttatagtagcatgatttataatcctttgggtatatacccagtaatgggatggctgggtcaaatggtatttctagttctagatccctgaggaatcgccacactgacttccacaatggttgaactagtttacagtcccaccagcagtgtaaaagtgttcctatttctccacatcctctctagcacctgttgtttcctgactttttaatgattgccattctaactgttgtgagatggtatctcattgtggttttgatttgcatttctctaatggccagtgatgatgagcattttttcatgtgtttttttggctgcataaatgtcttcttttgagaagtgtctgttcatgtcctttgcccactttttgatggggttgttttttcttgtaaatttgttggagttcattgtagattctggatattagccctttgtcagatgagtagattgcagaaattttctcccattctgtagaagcctgttcactctgatggtcgtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagagtttttatggttttaggtctaacatttaagtctttaatctatcttgaattaatttttgtataaggtgtaaggaagtgatccagtttcagctttctacatatggctagccagttttcccagcaccatttattaaataggcaatcctttccccattgcttgtttttgtcaggtttgtcaaagatcagatggttgtagatatgtggcgttatttctgagggctctgttctgttccattggtctgtatctctgttttgataccagtaccatgctgttttggttactgtagccttgtagtatagtttgaagtcaggtagcgtgatgcctccagctttgttcttttggcttaggattgacttggcaatgagggcccttttttggtgccatatgaactttaaagtagttttttccaattctgtgaagaaagtcgttggtagcttgatggggatggcattgaatctataaattaccttgggcagtatggccattttcacgatattgattcttcctacgtatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttctttcatgatttggctctctgtttgtctgttattggtgtataagaatgcttgtgatttttgcacattgatcttgtatcccgagactttgctgaagttgattatcagcttaaggagattttgggctgagatgctggagttttctagatatacagtcatgtcacctgcaaacagggtcaatttgacttcctcttttcctaattgaatgccctttatttccttctcctgcctgattgccctggccagaacttccaacactgtgttgaataggagtggtgagagagggcatccttctcttgtgccagttttcaaagggaatgcttccagtttttgtacattcactgtgatactggctgtgggtttgtcatagatagctcttattattttgagatatgtcccatcaatacctaatttattgagagtttttagcatgaagagctgttgaattttgtcaaaggccttttctgcatctattgagataatcatgccgttttttttctttggttctgtttatatgctggactacgtttattgattttcttatgttgaaccagccttgcatcccagggatgaagcccacttgatcatggtggataagctttttgatgtgctgctggattcggtttgcctgtattttattgaggatttttgcatcaatgtttatcaaggatattggtctaaaattctttttttgttgtgtctctgccaggctttggtatcaggatgatgctggcctcataaaatgaattagggaggattccctctttttctatttattggaatagtttcagaaggaatggtaccagctcctccttgtacctctggtagaattcggctgtgaatccatctggtcctggatttttttggttggtaagctattaattattgcctccatttcagagcctgttattggtctattcagagattcaatttcttcctggtttagtcttgggagggtgtatgtgtcaaggaatttatccatttcctctagattttctagtttatttgtgtagaggtgtttatagtattctctgatggtggtatgtatttctgtgggatcagtggtgatatcccctttggcattttttattgcatctatttgattcttctctcttctttattaatcttgctagcggtctatcaattttgttgatcctttcaaaaaaccagctcctggattcattaatttttttgaagggttttttgtgtctctatttccttcagttctgctctgattttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagaggttttgagtgagtttcttaatcccgagttctagtttgattgcactgtggtctgagagacagtttgttataatttctgatcttttacatttgctgaggagtgctttacttccaactatgtggtcaactttggaataggtgtggtgtggtgctgaaaagaatgtatattctgttgatttggggtggagagttctgtagatgtctattaggtccacttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatttgggtgctcctgtattgggtgtatatatatttaggatagttagttcttcttgttgaattgatccctttaccattgtgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgccttttaattggagcatatagcccgttcacatttaaggttagtattgttatgtgtgaatttgatcctgtcattatgatgttagctggtgattttgctcgttagttgatgcagtttcttcctagccttgatggtctttacaatttggcatgtttttgcagtggctggtaccggttgttcctttccgtgtttagtgcttccttcatgagctattttagggcaggcctggtggtgacaaaatgtctcagcatttgcttgtctgtaaagtattttatttctccttcacttacgaagcttagtttggctggatatgaaattctgggttgaaaattcttttctttaagaatgttgaatattggtccccactctcttctggcttgtagagtttctgccgagagatcagcttttagtccgatgggcttccctttgtgggtaacccgacctttctctctggatgcccttaacattttttccttcatttcaactttggtgaatctgacaattatgtgtcttggcgttgctcttctcgaggagtatctttgtggagtcctctctatttcctgaatgtgaatgttggcctgccttgccagactggggaagttctcctggataatatcctccagagtgttttccaacttggttccattctccccgtcactttcaggtacaccaagtagatttggtcttttcacatagtcccatatttcttggagactttgtttatttctttttattcttttttctctaaacttctcgctgcatttcattcatttcgtcttccatcgctgataccctttcttccagctgatctcattggctactgaggcttgtgcattcgtcacgttctcgtgccgtggttttcagctccatcaggtcctttaaggacttctctgcattggttattctagttatccattcgtctaattttttttcaaggtttttaacttctttgccattggttcgaacttcctccttagttcggagtagtttgatcttctgaagccttcttgtctcaactcatcaaagtcattctcggtccagctttgttccgttgctggtgaggagctacattcctttggaggaggagaggcgctctgctttttagagtttccagtttttctgctctgttttttccccatctttgtggttttatctacctttggtctttgatgatggtgacgtacaggtgggtttttggtgtggatgtcctttctgtttgttagttttccttctaacagccaggaccctcagctgcaggtctgttggagtttgctggaggtccactccagaccctgtttgcctgggtatcagcagcggtggctgcagaagagcagatattggtgaaccacaaatgctgctgcctgatcattcctctggaagttttgtctcaggagtatctggccgtgtggggtgtcagtccgcccctactggggggtcagggacccacttgtggaggcagtctgcccgttctcacatctcaagctgtgtgctggtagaaccactactctcttcatagcagtcagacagggacatttaagtctgcagaggttactgctgccttttgtttgtctgtgccctgcccccagaggtggagcctacagaggcaggcaggcctccttgagctgtggtgggctccacccagttcgagcttcctggctgctttgtttacctactcaagccttggcaatggcgggcacccctcccccagcctggctgctgccttgcagtttgatctcagactgctgtgctagcaatgagccgggctccgtgggcgtaggaccctctgagccaggtgcgggatataatctggtgtgccttttgttaaacctgttggaaaagtgcagtattagggtgggagtgacccgattttccaggtgccattcgtcacccctttctttgactaggaaagggaattccctgaccccttgggcttcccgggtgaggcgatgccccgccctgtttcggctcacgcatggtgcgccgcacccactgtcccgcacccactgtccggcactgcccagtgagatgaacccggtacctcagttggaaatgcagaaatcacccatcttctgcgacactcatgctgggagctatagactggagctgttcctattcggccatcttggctccaccctcatgagacttattcacaatcatgagaacagcacaggaaatacccgccttcatgattcagtcacctcccacggggttccttctgcgacacgtggggattattacagttcaaggtgatatttgggttcagacacagagccaaaccatatcagctaggaaatgaccgtagagatgaaaagatattgatgatataaataatttcaataaatatatagggttggtttgatcagcttgaattttaattgttgaagatcacaaaggttacagacagcatttttgagagttaaagtgacatttttcagagattaccatgaacagtaacaactgtgaatagccaaaattaagctgaaacataagatttgtgttgggttctaagatagttagtgctgcaaagtcatgttgaggtgatgatctcagggatttttaggtgtatcctctgtgtatcttcaggcctgcctcttacttcgttggttccctaattgccattcatcctgcctgtatcagggaccactttacccgtcttctctgaagttcttggttattttatctgaagtttgtttttttttttttttttttttggtaaatttctgtgattattctgatttaccacatttggctttgaaatactgtatttaaatgttgagaatgtcatgccttaggaattcatagctagtctaaactaaataatgaaggaggaatatactgggaaaatccagccaacttaagtggctccattacgt

SEQ ID NO: 70430 - DNA, 1026 bp, Homo sapiens
gggcttttttcaactaatgtgtgttgtggctttgttgataattagtgtgtagtttaatagcttatggaataatgtcatctaattttctgttatcttattgcgcttttagctatgtgctatgtaacttataattgaattattatttacacaggtttctatttaagtattgaccttgtaaataaagaatttgggatatatttttggtagtatcgccgcagaaacgaaaacctacaatttgtgtgtattgctgtgattatataatgaaagttaagtttgcttggaaaatgttaatgaaatatttattactgatgaaatgcatttattctaattaggaagataggaagctttcagactgaaatctaaaagtatataaagagaatgaatgacaaagagatatatgtcttctcaaaagcagaaatactatatgtctacattttaaaatcagaattagtatatatacttacacacatactcacaaatgttggccaccattctgatccagctggttggcacagaagtaacagaatggtttgattcacaaaaccttttttaaaaaaacattaattaagaacatagtatggcataggaattaagaacttggactctaaagcaatacaaatatgtgtgtttggatcctgactttgcctgttagcaagaacttctccaagtctcagtttccttttctgtaaaaataggagtaataatatattggctaccttatacattggctgctgttgctgttacttttttaaaattacaaaatagcacaggtaaattatacaaatttttaaaaatacacttgaagaaaaattacctataatgctatcagaaataattgctaaaattctaattttatgctttaaatatttttattgaaaaatacacaattatttaaatcttctaggtcatacagacatattttccatcaaaaagtttgtaccagtttttactgtaatcaccactctccatgccaacaagaataccagcaattacatttaagtctttgctaatagacaagcttattgt

SEQ ID NO: 70431 - DNA, 1056 bp, Homo sapiens
ccctggaaatcctactatgtaagtttttatgtcagctacctgatttgctagctgtgtgtcttaggacatcagtctctgtgtgtctcagttttctcatctgtaaaataggaacaatagtacctagctcatgaaggattttttttttttaagtgggagaatagttagtgtttgtgaggggggcactgaagtgactgctgtaattaagacagactgtagaaaataggttagcaatgaatattgaaaacctttaaaatgtaaacattccttgagtcagtcatatgtctttccgtaaatttgtacttcagctgtaacctgacattcagacaatataatataatgccatacttgtttttaacaaaaaatttgaggctcaagtgtttaaggaattaagtacattgagtattacactatttttcaaatgttccttatgtaagcttaagaatattttaatgaaaattatttgaaatacctagtagatgcatatcatcagttacctgatttgtaagctaccctgttctgtgacttaatgactattttattttactgtctgcctcctcccttgccccttttctcttttgttcttgtttgtttgtttgtttgtttgtttgttttgggggatattttgagacagaatttcgctcttgttgcccaggctggagtgtaatggcacgatcttggctcacagcaacctccgcctcctgggttcaagtgattctcctgcttcagccttctgagtagctgggattacaggcatgcatcaccacgcccggctaatttttgtatttttagtagaaacggggtttctccttgttggtcaggccggtcacgaactcctgacctcaggggatctgccctcctcagcctcccaaagtgctgggattacaggtgtgagccaccgtgcctggccttgttctttttaatgtattaccttctcatagttttctttttttgtgcctgtttgctagatttcattagtttcatgttttaagttatccgttttccaattttaaaggttctttagcttctgtctagatctggaactcttatgtgtgtgca

SEQ ID NO: 70432 - DNA, 3035 bp, Homo sapiens
gtataatgaaaagcaaagttttgacaggtatcagaatagtttgtcataacactttaccttccaaattgattcgaagtgggaggatgaaactaattttgtatacaagcatggtttccatttacttttttctgtctatcttttgtggcttttctcttttttgctatggaacacaattttgttaatatagaattagtagataaaagttattctgtattaacagtttctccaattaaaccaagaaacgtatttccaaagcttattacataaaaaaattgtttatctacaaatatttatcctagttgttgaaggactattattagctagtaatttattctgcttaccctgtgttttagtgtggctttcacccttctggtaacccttactatagaaatatctagctattttaaagctaccttttatttcttcagagcaactgcaaagaacttactttaccttttggaagaccaccgtttatcacagcagaaagtagatatggattggagaaaaattgtatttgagaaactaaggttattttgtaaaggataatggcaattactatacttataatcagctatctggattttttaaaattctggtctaatttttttagcctacaaatctgaaattctaactgggctaagatatggaatgggttatgtttaaaatgcagttatatcattggtatgacagacatttatgtttttgtttttaaggacatacaaagattaatacatgagaaaatttattttcattagaaaaagaatttttaaggtacttactagtttaaaaagaagccatgtatggcaaacattttccattggagttcagtatattaaataactatattcctgtaacattggtgaagcaacattttgaatgtatggcttactcttttaaaatgacattttaagtgttagatagagtacagaaaaattgaatcttagatcaactggaactgtaatgtttcaggtcagggtgtaattatgtttttccaagatatcgatctagaagctataactagtggaaaaagaaagagtctaggttgccaatttctatctgttaggacagacccgagaaggccaaataggtcattcagctggtaggtaatctgaacaaacaccttgtcagacagcagaacacaagctaccatgtgggtcttgagggttaaggttttaataatttaagtcagaatgacaaaacttaaggaactgagttaaatgaaggatggagagataaggaattagtaggtgagtgtagattagagatattattcttatggcaacttactgtaattgcacattgagattggtgtaactaaaagttcgtttcccaagtgcattgagtaccactattaattctgttcagttggcaaacttttattgtaatttgtgccattaaaaatgtgagatctactatctattgtatgttcttgatggttagaaaggttagaggtggaagagatatagaaggaagagtgccctctctagaagtaagagtcactgagattaaacaagaaagggagtttgtcttggaatagatacagaagtgcttaaacttagatttggctagatttgggtggaagtgattatgcagtgccatgaggtagccagaaaatgctggaacagagacctgtatggtcttcagttctagtatagtatgattgtatccaaatatgtaaataattggacttttcatccaataattcacgtgaatactgtacatggaatgataactatagaaaccaatgaacatactcttgtattcaagttgcataatgtttcctatttgttatatttgagtgtgtgataagctttcaggtgaattaagtcctcacttaacataagttttttgaaactgcgacttgaagcaaaactacatataacaaaaccaattttttgttctcatcaacattacaatggaatgaagttgaatgaaacaacactattcaaggacctgctgtatgtatttttgcctgaaatcacagtttccaagaatgatcagtggcattaagtgaagacttactgtacaccttataagcttcaagacccatgagctcccttaagctgtctcctagattagaatcaacagggaaccaggaattaatttctcctggatagtcaaagcattggaattaagtggttgatagttgcatttaccttttcttagttaccaacaggatctaggaccttgtaagattggagaaaaaggaaactgtcatttactgagtgctttctgtgtgcatattatcttataggcacctagcttagcaaaatatctgggtgaattcattatacaaatttgtgtctgaattctcagaggacccaggcatctagatggaagaagagctaaatctgtcagaatttctaagttctggactcctagcttgagaacaatgacatagtctcatgcttccagcagacatttctttggcctcctgctttaagaacacctatgtgaaagctacttgtttcatagagaacccagagcacaggtggggtggttcagaagtgatgctatcagctatgtaaataggtgcatgacatattttggttgctttcggaaattgtaggaccattgaacagatactaaatgcttagtaataagtacagagtgctctaggatttcttgctcttttgaacacatgttttatagttggggaagataggacatatttatatgtaaaatattaaataacagcctgtgatgctaacacatagattaaaagataccatgtgcagaatggtgtagacagacttttagggagcaaattctgtctataccattctccttgaggagaaccaaaaaaaaagggaagctatagtggtatggaaaaacttcaaaaagcaggtaggaattaaagttgacaaatacttatgggtccctaccatacatgttgtgccattctagatactgcagatgtgtggtagaagagatcatcctcatttatgccatctctgcatagtgtacctactgctatggtgttgctgcattatttattgcatgtcctcattgcctttgtatcctctgtacctcgc

SEQ ID NO: 70433 - DNA, 1384 bp, Homo sapiens
agctggctgctttgcaaatggaaaaggggacactttaaggcatcagttaaggactactctctcctgcccctataaagattttaggggactttatttaagtatgaatattcagggatttggttgctatgattttattttttcatgtaacttaatattttttatttctagcaaaaaattgaataaagaatgacgtattttgccataagtgtttaagtgatgtgctgttaatcagtttgtgcagtggaaataattaatggaataatttcttagatcatattctttaagggtttctgaaaaatgatcaataaggaatttgactaacaccctgccagataagaggtaggaatctatttagaatgtgttcgtatagtcctcctaatattgtgttgttattatcaattgttagattgaaagaaaaatttgactcaaaattataaccttttaaactttttttaaaatttgtttttattctttgtaaaaaggtgataaccttttttataagatgattataagaaggaattgagaggaagtagtatagtgctttgttgataagtgcccaataaattttaattttactgtccttccagtcacctgctcatatacaagctcatttatacatatttatatttttgcctgttttagtttttttatgccaagaaaaactccttgagttcttcccatttttctttttttttctttttttcagctgtatgtcctattcttggcataatattttagagatgatttttctgtgattgtttctaattatactagtgagagattagatttttttccccttgaccctattcagttgtgttagtttgactcaagcaactcaaagttaatgacttagtatatttagtttccaaaaaacaaatctttatatatacctttccagtgccattctttatgttttaaagaaattcagtttttaaaataaatttaaagtaacaattattaagtattcaggggttgatgatccaatttgaagtgatatattcttttttgatctttttatactacttcaacaaaattaaacttagactttttgaatttattagctgtttttgtgaagattaattttagaaagctaaaattaaacactgaaagtaagttactttattccatacggtctctgtccagttttagcactaaaatcagttcaaggatgccaatccctaattggccaaatagccttaccattcttgttttcttctccaaatttgtttttttgctggtcagataacttccaatttctaaaatattcctgaaatgataaatttttatgatacagcatagaataatatgtatgtggagacttgaaggagtcaaatctcaatgagccttttgtagggcttaacgattgttaaaagggggccaaaag

SEQ ID NO: 70434 - DNA, 1106 bp, Homo sapiens
ttgattttggaaagcacattaaaacattttgttgttgtggttgttagaaaaggattgttcttggattcgccaccaggcaaattttggttgatatgtcctctctttataaaataagttgattacctgtgtggtaagagttctaggtttatgaatagaactggagacatgtttgactattactactttgctttagttatactttgagtaccttctcaagtaagatttggttttgtgcattggagacttaccaacaaaagactttttaagatcacatctatagtatttgaaaaccgtatcatgtttagggattcaaaacaaaaaaacgggtttttgtactttttcacttctctttgtactgtctgttgcatatactttgcgaataagaggagttactcattttgttaggattttcaagctgtttgggtaatttgtatgagaattatgtctgaaatataacactttcttgcaaaagtagtatttaagcttgattgcctacatgtatatatatgtattttttaaatggagaaatgtaggggcaaaactaccttgatctagttgttatcatcatacctgtttgattcactttattctgtctagtaaaatctgaattaaaataggtttagcacatttactgtttaatcctcattccataaactccaggttttgcttttatttagatatctataattttactgctcttttaaattttaaaaaacttatttgtgaagggttatcaaaattctcatctccttgatacctttctaaccttatatctttatcataactttatcatatctttgtgcgttctcatagtattgggcattgaatgtataaatttttacctttccatagtttttcacattttgtttttaaaatacactttgcttaaattgtcaatgtaacatggatctctaaaaccctgcttatttctactattgacagattgtatttattataaattgttttcatctctgagcacttattccatgtttgatggtacctgtaatagcatcagcaattctaatatgctattaaacaaaaatttccattgactttctggctcttctctagagtgtttgttgttttgtcagctgcatgttttatca

SEQ ID NO: 70435 - DNA, 1369 bp, Homo sapiens
ttacgaaataccagttgtgtattaatttaaaattggggacaccatagactgtgttttcttttaagtatatgaaaggtaaactatatttagataagaatgatgtatttttgagcactgaattcaattttaaaacgcaccattcaattcaggtcactacatatttattgaatgtctattatgtcttcctgaacactaaagggcagaagacacagagaggagtttaacatgggaggagtatgacataaactcctgtgtccatgaggagtttatattctagttgggaagatgaatactgtaagagagaagatctattatgaaaagtaatatttgcaagctttaccagtaaagaagaaaaacaactatttagcaagaataatcttaacactaacctgcatatttttgaggttaggtaattcaggtatccaggaagttggctcttcaagtacacaaaatggtgccctgaatctgttttcctcaaggttcatatataaatttttgagtttttgttttttaactaatctgcctaaaatgttctggttctcatttgttcatggaaggactttagagaagttttcaagtaaagataaagaatagattcagaaaaataatattagtgttggttttgaaacatattgttattttatatggagaccaaaaatacacacttctgtttttcttcatctgaaagttagtgttcttactgtatatctaaaactattttctatgtacccagtatgtctggatttggaatgaacaggaatcaggcatttggaatgaataactccttatcaagtaacatttttaatggaacaggtaagcttattctggagctagtaccctacaaaaagtatgatagatttatgaaatataaagcaattcaacatactggtctttaaatacggtaggattttttattatgttagatggtagattttaattcagtgaaaaataggaataggattcaatacagtgaatagttgagagagatgtaaattttttttacttagcatggtaacgtagtaatttgtgttataacatcaggattatttccttaacacctggagagagcctacacattaacttagttagtatttatgcctcaaaatattttgcttcatagcttttactgtcctcagccctgtcactgtgagaactatagcttagactaggttgggtggtatgacattctggctatggagatccagattgaagagaacctttaaaattgtatggaacacttacgttttttcttaatagttttaataatactaatgttggcatttaacctttatgaattgttgattcagttttatgtataaaatttagttacatggaaaaccaactctgattttgacagtaaaaaattcct

SEQ ID NO: 70436 - DNA, 1697 bp, Homo sapiens
gccaggtataaatgatttatcctttacccttgtaatttgaaattgtcacctgtctttgaatgttaataaattaatggtgtctattgtttttctgtcaacaaagtaatcttgagataacagttactgtttgagattcttacagttgtgaaatttggagaaaactaaaaattaattgggaagtggcaaaataaattgaaaatggtaaaacaaaaattaaaagctatagcgcaggctaaaaggacggtagaaagttttcttcaaaaattaagaacccaaggttataagaatactaaaaagttaagaaattgagatgattaaaatagacaaagtagagaagttgggttaaattttaatttttaaaggaagccagctgattgttttaacttaaaatgaacaaaaatacatttaatttattctatatatatttattgagcgcctactgtgtaataggtaatataaacttctgggctttgtatcatatttctatatttcctatccatttaccatatatgggaaccctactgccaccctgttgtaccccaccctcaaaatgcgcacatgcgcacgcacacacgtttgtatatgaaagcggtcaattacaggtggaagtcctcagggcttctgcttcactgcctgtgcctcagctatatctttctggccatttgcaggaggcactatcattgtcaccatttgtgtgtaaccgaagcttcaagcattctagatataacctccatctgagcataatgaaaagacaagttatatcgtaacaatctccctcttgttagctcacaagctataattttaggttaccatcttccatgggggaaatatatgctttttattctctttgttacatctctaggatttggggtttctattatgctggttgcgtattcctttgctaaattgttcatggaattctttgacatgaaatcaatctgcaagtatcttttgagcacctacatacacctagtacagtgccgtgcattatttaggaagaaggcgcaatcatttcgaattatattatggttggtttttataatctcttaaaaaatatttgtagaatcaataaccagtgtcctttcttattatttagacggaagtgaaaatgtgacaggattggacctttcagatttcccagcattagcagaccgaaacaggagggaaggaagtggtaacccaactccattaataaaccccttggctggaagagctccttatggtaattaagctttttaatgatggccagtagaaagtttccattgtatgtgcacacacatatacatttacatgtacgtatacatatgcttgtgtgtgtacacatgtatgtttgcattttctaatcaggttagtgtaattttttcagaattgatatattagaagtgatttttcttcccagaataccatgatagcaaagttaaatgggaaaactttgtacaaaaacccaagaggaagtcctcattggtattcagaagttattttcttctgttatccctgccttagtttaccttaagtgttttattttgtggtctgccttttctctccttaattgatcacacattttttcaaaataatatattcctggtgattaataatgactgactatacattgaagatgtttttctgagccaaggtttttctcaacctccacactgttgacatttgggccaggtaattctttgtagagaggagatgtg

SEQ ID NO: 70437 - DNA, 1481 bp, Homo sapiens
cctcataggtccattttttcatccctttaatcattcccgttgctctccttggaccatctctagtttctccatatcgttcttgaattgtggagccccaaactggatattgttctccaataagggcccgactaatgccaagtatagtgggaggattatttcccagttcttgcatgttttacatctataacatggagtccaagaaaatctgaaataatatggagttgttttataattgattgcaatttgctcactctgtaagtcgctttcaagtagaatactgacatattcttttaaattttattttgttcatttgtatttgagagttaactggtatttataatatctagtcaaatatttaaataaaacaagcttttaaaccaaaattgttaataattaatccaatatcaaattaaatttttaagcacctacgcatgacatggattactgttgatttcccttgtattattttgtatgttgagttattaatcagtaaatgaaaatttagttcttcattgttaccctggatactaattttttgaagtacgctttcatagcattaaaaaaaagaaaccttttggtgtattatcatgaggaaagttaactttataatctgtagcaaaatatcataaatatcaattgcaattctccggattattttcattacatagttggaatggtaacaaaaccagcaaatgaacaatcccaggacttctcaatacacaatgaagattttccagcattaccaggctccagctataaagatccaacatcaagtaatgatgacagtaaatctgtaagtaactgagaagtgtgtatgtgagtgatgtagtttttcccttcagatttctcttatattaacaattacttactaaatactattacaaaactgttttatcttgatatctgtaataacctaacttctgaagaatgtggaaaagctttataacttagaagatagcctatttttttcctatttcatataggtttgcaaatttctgttgaacttctcagagttaatttagacttttattgtagtccctgtcagctggatcccatgaagtttgataatatagccttctaaggagctgtgtttttcttgagtaagttttctccttgaagaatttatacacatttttatacctgtgttgattcaaccaactcagcttcttctttctgacttaacaaatatgtttatttcttccacatttcactgaaaatagcttttctctgtgtgtgatgggagtttatatattattaaaataattgataaagaagatcggtaagaattaaaataagtacaaagttttaaagcttgtatgtctaacttatcttcaaggtagctttggtgattttaggtaatatactatatttagtttctcttttacatgaaagcattgaggagtgtaacttcaagtgtatcccaaagcataaagacctgagaaagagatagatttttttttttctgtgactgaagatctgag

SEQ ID NO: 70438 - DNA, 1032 bp, Homo sapiens
ttacaacacattttcacactttgttgggtcattttcatcaacatagaaatacattgttacttctctcatcttagaagaaaatcttcctttgatccaacctcctccgtaagttactttcccatttctttatttccctttgaagcgaaacttttcaaagagtcatctccatttctccgacttggtcttctcccattctctggtaagcccatttcagtcaggattttgtccctgccacttcactaaagctgcttttatcaaggtcaccaaatgaccttcatgttattaaattcagtggtcacttggaggaactcttgctccttgatacacattcttgtacttgaatttgagagcaccatttttacctcatcttcactggttggtctttttcagtttcctttgctggtacctcctccttttcttcttgacctcagtgtcattcctcttctctgcatttacatccttgatgatctttttctagtcttattgttttaaataccatatatattgaggaatcccaaacatatgtttccattccacacttctgagtttgagatttctacattcaattgccaattaaatatttcttgaatgatcaccccccaacttattctgtctacagcctttccaatctcagttagtggtaactctgtacttccagaaacttggcattattcttaactcctctttcttttataccccataatcaggcttttcccaaaatatatacagaatctaaccaaagctcactacttttaactgctaccacccttgtttgaatcattctctcttgcctgaatactccattagccagtcactgggggtccctgattgtccttataccccttcccgtacaatctcttcatataacagccaagacaatccttttttaatacattactcctctgctcaacacccagtaaatgtttgtggtttcattatgattaaaaaccccaaatctttttttttttttttttttttttgagacagagtattgctcttgtcgcccaggctggagtgcagtgatgcaatctc

SEQ ID NO: 70439 - DNA, 2688 bp, Homo sapiens
atgtgtatgtgtatatatacaacagcattctgagtgtgccttacagttctgtggtcaagtggatgttgatgtggacaggcaagtaaagggatacctttctcaatgtcttctaatacttgagtagataaaaggcaagaaatacaagatggagaggtctcctattttctatttgcggattgtgtgatttgctcccaccaccactgtagagctctttcgctccaattaccaaagtgttccagaaccttttcttattaccaatttgagaaatactaatttaggagaatttgtcacattggggctgctgcctgaatagggataacatgaatggagagaaaaattacattcagagaatgtgtaataaccaaataagtatttcgatataggatcaaataacgagataaaaatgttgttttgggacacttttaaggtttatttaaatgtgaaaatttgagactattgaacctatgttttacagtttggtaagcagttatgtttctaccttggggagagaaatgtaaagcaatcatctttcagacatctatttaaacaaactgaaaagccatttctttatgatttttgtattcatcatctgtgatttgctgaaagcatacaactgacttgtgaatcattcactgtcagatatagattcagtttaacattttttataagccgtctatatatttggcactctacaaggtgctttcatataccttcactcattttatttactttcttagtaaccctcataggtgtcattgtccacatttgacaagtaaagctaagagattttaaataactaggacacagtcatattaatgagtaataaaaccaggacttgaatacaagtcctagatctctgagcacaatgctattgttaggttcttttccccattgggtattaaatccttttagtggatcttgcttggaagtctttattgagcttttcttccagtcagcatatcaattagatgtatcagaaataattgtttaaatgacttcagtcatttaaatgaggaaattcccttttagaatcttaactacctatctgtgtaatcatgtaataacagttatctactacaaagtggggagtttctgtttatctctccattttttctttagtagtagcaactatatattaggatttgcagatttgttttatatttcagaataagttatttttctttttcagctggctgcaataaaacttggccgatatggtgaagaccttctcttctatctctattacatgaatggaggagacgtattacaacttttagctgcagtggagctgtatgttcaaagtattttaatcacttttgtattatagtggatcttgactatgctgaaaacatctttaagtgatgatggctatctttaaatggaactatttctccatcaagaaatttatttttacattattaaagtgaatttaatttagattaaaaccgtatcttaaccatggcttcataatctatatacctaaaaagaatttcaaacttaatgctgaagctgggtgcagtggctcacacttgtaatcccagcactttggtgaggtggacagatcacttgaggccagaagttagggacagcctgggcaacacagcaaaccacatttctacaaaaaataaaggaaaatattagctaggtgtggtggcacacatctatatagtcctagctacttgggaggctacagcaggaggatcgcttgagcccaggagtttgaggtgtcagtgagctatgattgtgccattgcactctagtgtggctgacagtgcaagaccctgtctctaaaaataactaataagtgccaaatttgtaagaagacagaattgacataactcatggatttggtgaatctaatttttgtaaatatgtgaattatatgatattcatgactatgttttttattccttgtggaaccatatgtataaataattcgatactgaatttaatcatttcataaacattattacttataagcaaggcagtgtgcatatttgttgtacgttttgaagtgctgattaaagtccacattttcattatcagcagtctattggccagtttaaacaaatattaatgtaaagaaattggttcattgatattttttccctgagcagttctgtatttacctgatgctctaaaattaagttttctgtcgttactcaaatgtacagttggcaacacattttgttatcaatagacaattatgtttactatagagtaaactattagtaattatttatgaccttatgattgggagaccttttcacaaatttaagtatttcataacatttctaataacatttctataaatggctttggatcaaatagtttaaagtatataattcagtatgttgataatgaattgtttcgtttcatttcacaactgagaggatttttcccttatgtttttccttcatttttgtgagaatagagattattacctgttgttccttttaattgttcataagtaaataaatacattcaggcactcattcatctatcactggcagttctgttttcatattttatttatgtcttaaaaactacctcatgacgttggtaggaaagcatttctttacatggaggtttattttgtgggacattacctcctctggatgttacttcctcagtttacaagtagtgtaaattctcattgattcttttatgaattgtaatggattttct

SEQ ID NO: 70440 - DNA, 1014 bp, Homo sapiens
gatcagtgattacattaatgtttttgtaatattatttgactatatgaatccattgcattcagttttgcttgaattgaacaagtaacctttggagaatacatagcctaattttattaatagaagaactaaggtatgaaaaagttgtctaaaaagtatttggaactctttctagcctttgcaatcatattataatctagaaatccttttttttccactaaaagcaaatatatacatagaccctctaatgtatcatttgataatattagaaaaattaaatgttttgttcctaaaacaaaggaagaaagcttgtgtttattcatcatatattaattacacatccattaggggcttggcactattccaagttgtaggtagtagtatacaaagtagatagacacttgctcctacagaatgtatgaggttgtgcatgtgtgtagtatgtgtgtgtatatataacaaacatgtaaatggtgttaccagtaatcaaagtaacttatgtattttaagaagaataaaagtacgtggaaaacaagattttaaaacgtggaaggcaaaattttacctatgtaatttctaaatctctgatctctatatcaaaatttctaaatctctatatcaaaattatttacgctgcttaggtttaaactatatttttctgggggaaaatgtacattgataaagttaatctagtttgaattcctagtcatacattgtagttcatcaatgtgaaaaattttagttaacttactcagtataacttaccactttgtggaagttacaattagactttttttccctgtaactacacattttgaaaacaaaaatgccaattttaatttcagaagaatgataacaaattttcttcacgaattcagatagtcaacttgaaccaagcaataaaattattttaattcctagctagggctgggagagggggagtagtgctacacagtgtattagggcaggatgtcatggttgtggtggtgattctggtgtttgctaatttttactgat

SEQ ID NO: 70441 - DNA, 2528 bp, Homo sapiens
tatctaaattcttgaatttgtttttataggagttccatctggaatatgacaaattagaagaacggcctcacctgccatccaccttcaactacaaccctgctcagcaagccttctaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctcactgcagtgttggctttgatttgaaattgcgaaattatttcttcaacatgaaaaatagaggaaacaaactgaagttttacagatatcaaactgaatggtgtgactcaaatgtctttttcagcttccaacaagtaatttaatggaaatatagtgaaccgtttcacttgtaggttaaaaatgtagacagtattaatcagagaaaacttttttaaatgggttgtggcagcattagaaataaaacattctgaatactcttggaacccaaccaaagtacttctgtgaaaaatttatgagaaatttcttgatagacctttaaatttatctttaagaagtaatgtgcaaatgaaggtaagccataaggtgggaatgggtagactttaccttcagtttgctggcctagatatctcatatttacaagttagtggattcttttcccatctaaatacaaatactgtattttaaaaatcagaagattgaagcttccaaagcagaactagagagtagaaaaaaggcaatgagttttgatcctttaaattttcatttttaacctatttttctatgaagagtaaaagtctgttggcattaaccaaatcttttgaaaatgaaacatttatgacattgctgtgtttgtgtaccaggaatataaagtggcttaaaatttacctttttctatgcattttgagatatgagaaacactataaaaaacaggattttctatctttcataattaaaccaaagcatctcctcagtaagaaagatagcactatataaatcattttatctattgtgcacaaaccttcacagaacactataccttatttgacataaaccagagtcaaagcatagaaatcaatctagaaaaaaaaagattacatttttcctagtaattcactttgtaaaataaaatgtaatttttcctacataaccacaaaaaacaagtaggaagaaaaatgtggaaggggatctttattctcatgaatataaacaacaatatagattgaagtctcagctgaagcgtgatcatgactggtactgatgaatgactccgaaaaataagatagctcataccaagtggtttgttgtcttggctgtaatctttttttctctttttttgttaactgccatatacagagttttaaatgcacacttttccatttttttgagttctttttatcctgaatcatcaaaatgaagaaactcttgcatgttagccaactttttataacttgttaatatcagaaattaccatgctatggacttcaaaatacaaattactctatttgaaatatttaaaacactactttgaactttttaaatgtaacagttataatacgc

SEQ ID NO: 70442 - DNA, 1026 bp, Homo sapiens
cagcgggcgatggagacagagagacacccgacgagaggaggcggggtgggggaggcggggagagtgcgggggcggaggctggcagggggcgctggaagctggagcggtccgtgcgctccccgcgcccgagggtgcaggaggctctgaagcggctgctgcaccgcggggcccaggcggcggctggggggctggggggcgctgccgccgccgccgccgggggcgtcgctggcctcggcccctttgttctcgcgcgctccccctcgccgcccactcccctgctgtcgcgcggcggcggcggtggcggcggcggctcctcccgcccgaggcagtcgggctcggcgccgggggcgggagggggcggggggagcacgccagccgccgagagtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaaggtaagaacgccccgcgcacccaggggctccccgcgagggaggtttggaggcagcgtcggtgttagactccgcgcggggagggttcggcgtgtgctcgcattgctaggaggagaccaggtggcgcaggctgtgctcaaaccaggaatgactacatcagggagccccagggctccggtcttttcaggtgggtttacgcgcggcgaccagtggtgcccagaggcttactttaaaacctgtcttgcctggtctcagattttgaggcctcgacccagtccgggtcctgcgcctaccggact

SEQ ID NO: 70443 - DNA, 1024 bp, Homo sapiens
agagagaggaagtctcagaaaactgttcccaatggagaaaaataacttataaaaagcagtgtccttagcctgtgaactaattgagctttgtagtgcacctggttctggttccgtttctacttcccttgatcttttctgctctccttgttgcttaactatcaaaggtatgtatctttttaaaagttactgacatttttcctttttttgagggatcaagcagaaaaacagtccaaaagggaatgcatcttgtgttcacaggaaaactttctgttaactctaacaagatatatttatattaatccaaaagaaaaaaattctacattaatattataatagtatttaaaacagcttaccgtcactctgcaataaaacttgtggtcttacctcctgaacagtaaattcttgaatttgagacatttagaaaatatttctttttaaaaatatgaatgactcctctcaaaaaaaaaatgctcctgtcgacaaatgaatattgatttaccttaaaaaatatcaataatacataagcagtaaatataggactaagaatatagaatttggagtataatgttaaagatcttgaagaggtgataacgtctcaaagacaaatgttgtaacttgatcctcttaatgctcaggaatttaaaaagaaatctcagggttttagaaacatttttttttttagaattaaatcaataatgtcaaagatgagtgccaaccagtagtaatgatttagaaattatatggcagttcatcatttagaagttgttatagttggtgaaacgttgctaattattttaagatagtggttcaagcactaataaatttcatatctatatatacatatatatgcacacacacattaataaatggctaatatctaatcaagacaaggacaaattataatttattacaaaaagactgcttcacaattttcaggcagtttgaagtatctggcagaaaaagtaaattgaaatcattgggacgttgatttttaaattacctagaagcaatcccaatgctttat

SEQ ID NO: 70444 - DNA, 1096 bp, Homo sapiens
gccaacaagtcctgcttcagccctgtaaatcccaactttatgttttagtgagtcaaaatagcccagcatacagtgggtaaaatggtaaattgatgttgcatgttcaggcattcagaccctactgggacccagtaacaaaccacttgtttctcaaaaggagaatagtcacttgccaaagaaagcatgggtttgctttataccatcagggctctctctgggctccatatatccgctgatctgtcatagactcttgtttgttattgaagccactgagccatagagatgaattgagacagcttcctgctctgtagccttgagcaggttttcctgctctgattgctactgaaagctggcaggttctgggttactcagtatattgatcagagaagcaatcccaaatgtcagtatatgtttcctccaaaatgtgaagacgctatactttcaggatctgtaggaacaatcgtgaagagagttcatggactccctgggcctattgtgacactaacttggaccaaaacttcattttcccctgacccccatgagctctcattctaagcacaggtgtacttagagtccccagggattagcattagcgtagagccagtgttcaatactattctgaatatctgccctttctgctctatactactctgctacatgtcggcatgttctgctgggaaaggctagattttcagtaggtaggacttgaggttctaccacaagggctttaagtataaaccagccccctcacccttcctctaaggagctttgggcctgggattggctgaggagtcctaccttacatcacagtgactcatagacttcatttcatcaaacctcaagtgtttttatactttcaggtatgtaaataaagaagaaccttagaaggttatctatttattttaatcttagatgtcctgtgatctcagccactgtcaaagatccctgtggctcaagtcatttttcatatgttcacacattcttttattttttatttattattatttttttttagagaaagggtcttgctctgtcacccaggctggagtgcagtggcacaatcatagctcactgtaacctcaaactccagggctca

SEQ ID NO: 70445 - DNA, 1054 bp, Homo sapiens
ctctttggatcagaagggacctcctgggacaaggatggctgctcatgtgcttttcctcatggtgctaagtttatcctgaggtagaaaaaagggtcttcatgagacacttcagcagaaagttctgtcatttccctgacatccttcttttctgtgtttatgctcatgtttttccttccaaaacagctacctctgttttttcactaacaaaaaattcagctctttgctctgtcttgattctttgtcactggcttgagaaaaatataaaccaagccaattttatataagtcaagctggttaatgttgtcctggcagacactggcttttgttcagtgtgagaggctgatgaagcgtgagtcaaaacgtaactaaagatgctgtctagctctattaattcattcttatccccagatgtggaggagcaccctctcaaggacaacagttcccctttaatacattcaatatgtgcaattttttaacagactaaacaccaaatttgtttaccagaagcactgggagggaaagaaaataccaacaggaagtaaaattaaaataaaataaattgcaggctacacacacatcttgaagaggccacagcaccctgtaagtaggtgactgttaatctctgtgcttaattatgagtcccaaagtcagacttcagattctacaggatggtaattctgcacatcttcaaatgcacttcttgggctcacacaccagagctccaggccatcaggaagtcacagttatggttatcagtagaaaacaataagtgaaatcctgatggactaggatgttactaaaaagctgccacacccatctcccacccaatttcttcaccatggtgaggcacagaatgtggaagccgctaattgccactgtgatcctctgggctccctaagggcagaaagcaattttaaaaggaaaagaacaacaggagagagagagaggaaaaaaacaaaaaaaaaaaaaacagagatagagtgagaaagaaattttcagaaaagccacccactgcagcgaagaaaacagagcagacattaattcccttttcatc

SEQ ID NO: 70446 - DNA, 1037 bp, Homo sapiens
gccaattagtgagcccggttcagttgaagagctccatccgccagccgtcaacacctggccaaagagacatctctcctacttagaagttaatactcctgcacactccctttcttttttagacgccccagtgccattgagtcctgactctcaaatttctcatgattagtcaaatgaccattttaacgcagatacttatagaatgttggtagtcagcaagccaagaaaatctctttccataaagaaaagcagtgagaacttccattagtcatatgggttccttggaatagcatgttaactttccttgtaaatagagtatatatgaagttttaaataaaaaactgaaaatactatgtactcattttcagagatttaaattacaataaccttgatgaattccccactgcaattaggacactctccaaccttaaagaactgtaagtatttaggacaattttaatgggagaactttatccttttgtgaatttatttaaaaatacatgtgattgttttacataatatgacttgctagaaaattttaagtttatataaataatgataaagtacacttgaaatatattttaattgattctatctctagcaaataccagataatattttttatttatgcggggtttttctaacatatatattaaaaaaacatatatttctgtaagtcatattcttttctctttttctaagccatacatactctcccaccatttatgtactttatagatttgtagatttttagtagtagaactaaaatggaatttaattgctgagcatttctgagaacttgaacatttctgggttgcataagtctagaaataaatgaatcaaactgtctgtgcctagtaaagtatgagatgcattcacatacattgcagctgacccttgaacaactaggggttagggacaacaacccttgcacagtagaaaatccatgtataacttttgacttcttaaaaacttaactactaatagtctaatgttggccagaagccttatcaataatataaacagtctattaacacata

SEQ ID NO: 70447 - DNA, 1047 bp, Homo sapiens
gagggatagaatgatgattcatggaagggttagtgggttcctgctgtatttcccctgtggcaatggaaactgtacctgagctgggaaagagaggctaagaagatcttacccagacgtttaggaaagacaatacagctatacttacaaacgttttggacagtcgggggtgggtattttgttggagagtggtttttttgtgaggcacaataacaactatagaaagttcttcaaactagttcaagtataaaagaggtttcttgaaataacacaacaggcaaattcctagacacctaaaaataggaccaaaaaacatgaccaagccacccagggaatggaactgtctagaaactttatcattcatggagctgcttggcattttcaactccctttttcttgctaccccagccttttgtttttctcactatagtggccatttctgcttctcaaaacttaaatttacacataattttggcttctcatggtgtcattgccagccaaaattctgtttggtctttcagttcaagcaccttcccctcatgatctgactgagttagtgtctcccagtgtccctaattttcaattcttggaaaaaagaatctgattgctctggcttaggtcaattccacagaggatgtgttaggggttgtggctggaaaacaactgcaaatatggggtcatgggctggattagtacccccaatctgcctcccttagtaagggaaatcaaaattagtctgtcttggtcccttgggttgctataacagaatggcatcaattggatggcttataaacaacagaaatttatttctcacagttttggaggtttggaagtccaagatccaggagtcagcagattcagtattcagtgaaggcttacttcttcattcatagacaccatcttttaaatgtgtgctcacatggtagaagggctgagggtgctctctggggtccctttttataagggaactaatcccattcttgaggtttctgtccttacaacctaatcaccctccaaaagccccatctttaaatgccattgcactgggga

SEQ ID NO: 70448 - DNA, 1089 bp, Homo sapiens
tcagcagtaactattttgtctctgtcttttttttaatgagttctttgcattggtgtatgtagaactccactcagtgcatgcagtcacagggtccgtccatggaggctgtacactaacaactctagggatggccattcacatgttccgcacagtcatgtaggaataggccctgtttcctctttgatccattgtcatattgctatttaaaggtaccttatacaaatgatattgccttaaagataaattctgatatcttttcctgtcagtttataaactcaactttaaccttcatgtaaaaaaaaatcacacacactgcttaagggtgaggtatatgttcctgtcatccttccattgtcagttttacttttttttttttaatgaagtactttcagtacatgataattaaagtattaaacaaatttgggttaaagtttttatggttattgtagaaacatgaatataaaaagatttcacatactgtgtgactaaagtctttcttttggacagagaaaagactagtcattgagaactgcagtcccttgtattcgccacccctgctgggggacaaaacatgcacacaaaagaggcctttttaggctgtgggattttatctctgataaaggaaatggagtggtagattatgatgtatttttatgtgtttttgttcattttagagaacagcctaatatttctatttgccttttaacggaaagtggaccttgtaacattgtttttcactctattatctaaggcggtttgctttcaattaaagggtgtataaacctacatcataaagtaagcaagaatctccaggtgcaacatctaagagctaaaggcactaagcagacaagaaaaaagtgattaagactgacaacaaatgtagagggactttattgaagattgtagttcaaatatttatttttcaaggttgttgaaaaagtaggaacatgtggctagaatacaaagcagggccaatattcttggttaaagctgtcatgtgttcacagataagtcgtaatttcctcaagtctgctttcatgtctatgttaacattaatgtgagggaagaatggggaaatacaattttaat

SEQ ID NO: 70449 - DNA, 1039 bp, Homo sapiens
ttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaatatttgaactgctttgtattgaaatactactttgtagtattgaaattgtttatatacttttttaatataagttaactttctaaaaactcttgctgtctttattcacttttcacactggtgggaaagggttgaagtcggagatacggatattcaccataacttatagcaatacttttttatcttgaaactgctttcccattaaaaaaaaaaaaattaatgactttttaattcatgagaagatggatactgttgtgaggacagtgaacagagaggtttgcactaccattaaattccttgttctcaaattctcagtgtttagaaagtgcctcccaaccgtagtttgaatgatttgcctagtgacatgccatcttatgttgaatatcagtgtgattgaatgcaaaggagaccttgctttttattttgttttcagtttatatttggttgttttaaccttggcaggaaaaatgttaatgacacaacgcacactggcacaaatctgatcttagaactacatgtgcttgaactgttagaggcagagcagcaaccccatgaaatactaggaaacttgtacatgtttacatttgtataatgctcac

SEQ ID NO: 70450 - DNA, 1013 bp, Homo sapiens
aagtaaaggtagactcaggaatgaaaacccagactcctggcttcttgtcagtgttctgcccatggctctcatcactagaccatatttcctaattcatatttggaaagtcactaataaaattaatggtaggaactgtaactcacaacatcatacattattataatttatacattcatatcttaaagaccattttggttttcgtgttaaaacacataggtaattggatttcacattttggttgcattcatttttcgcccccctcaacctttacaggttattttcttttatttgagctgtgttccaaagacccagcattccaaaaccttggaacggttttgttcagttatgccagctaattctggacttgcattgaggtaagaaaaacttaacattcttttggtcctctgcctaatggaataggctctttatataagattattcttgaaaacttgataaaaatagtctgttgttccactatgtcctcatgaatatatactgcttaatttcagagttgttaagccaatatttagctattcattcaaaagtcagtgtaaaaattctggtcgcttcagaaaacttcaggttacaaaggggcaaataattccattcaagtaaagttcatctgtgttccctaaacacacaccatctgtccttagcatgtgcattataagcagtaagcttgttttccacggcaagggaatattatttaagatgttttcatattttcacctaggtcagttgctctcaaatattggcaaacattagaatctcctgggatgctcatttaaaatgtagattcctgaccttgagccctcacactacatttttgaagcactgattagggatttcatatattcgatcagaacgagatttctcagcctttctttgtagtttctctgctctgatacagcaaatccactttcatccgcaagaattatgctttttaattcaaaaaggtaccctgcatgctaatgcactggcttccacgtttgcagtcattcccactgcatcag

SEQ ID NO: 70451 - DNA, 1057 bp, Homo sapiens
tcaaaatacttttaaaatttcatgagtagaaattgttaagcaaaatgcttagcactataatttttacctggagttgaattctgtcaactctctatgtgacatttagtataaagatggcaggcagaaagaactagatagggtaattttcatgtgtttcaagtcaatttgaagattaagtagatagccagaaaaattaatttggggatttcatttactttagtaaagttaaactagggattatagtcttaagtagattagatttgaagtcatctcttctgaccatctcagttttcagtgaggaagttaagggattaactcatggtgatgtagcttgtcttggcaaagtcaggatgataacctaacttctagatgttctatttcttctctttcttgtgtttgccccccatacagcccgtctaattcattaagacttgttcccttgcaattatttaaaaatttaagataaatagttatactagattgtcatttttgcgatcaatgtatttcctttaaaaacattgttcttaaagatggtggtaagtatcatacacacaaattaaaatacattggaaggaagatggacttagtcaagtagaattctatactgattgacttcttagagtcactgggattgacctataatcctagtaagtattgtggcttttcaagatggggctataatttgtagtatttcccaaccttatttgatcatagatcttttgacaggtaccttacaggctaatgtgttatagaatacactttgatatcatgtctaaaattaaacttaaatgggttgtatgtgtgtatggctgtatgtgagagagattactttcagatataaggtttagtaaatctttttttttaagaaagggtctcactttataacatgggctggagcacaatggtgtgatctcagctcactgtaacctctgcctcctgagttcaagctattctcccacctcagcccgggagtagctgggactgtaggtgtgcatcaccacacctgactaatttttgtatttttttgtagagatcttggggtttcacccaagttgtt

SEQ ID NO: 70452 - DNA, 1874 bp, Homo sapiens
tttgcagtggtcagggaaagatgaaaagataatttattctgtaattttttttttgttgagatggattttaaagaatttaggataattgcagagatacttgtttaaatgaaaacactgatagatgcaaaagctcatatgggatggctttattcttaccaggaaagttgagggtaaggaattgaattttaggattttggagattacttgaattacttcctttgagtaaaagccagctcagtaaaggtgaataagatgatggatgggtaatcaaagggaggggtcatcttttcccattggtctctcagagttgaagtaacacagtcaaatatttcatttttatgattgacgtgattcatgttgttgtgatgtttttgggtagatgcagtgaaagcttgcacagatgagagccttgctgttgaggaaagaatagaggcctgccttccactttacacaaacatgattgctctgcaccaactcctggagaggtacaacttaattgccaagcagctaaccttatattaaaaagtgatcttttcatgtctttagcctttttttttcttttttgttaaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacaggtaaaaatgatgcataattcttaaatatgatgcttttatgtttcaaattttgctattggcctcaccaggaagtgtttcctggtccttttaccctttgcaagcagtgttaggtgttccttctctctttgccatagcacttagtacagtgctttgtaattttattcctagctgctttaatatatactatactaaacttcttgaaggcaaggaacatgtttactcatatttgcagcccaacgcctaccatggtgctagatggctaatacataattggtggatgaaatatgagcctgtggtaatactagaagttaagctgtttaatcattagttgaacttaattcagagagtaaaatataaaagttttctgagtatgtctcaaacttatcccctccgccccttacccactcaagaaacttaatctaatgagtacttttttaaggctttttttctccctcgtgacattttaattaaacattgtaagcctgatatatatccccctccctctttttaaaatagaatcgaggcgataatcttcttccatttttgcggaaatttattgcatccttctttaaaccggggtttgagaagtataataacttggatctgtttcggtaagttgtagaattcttagtttgtagaggaatgagagagagcacagttcagtagaaagattacagtttttttcttatatgatgacattttagactgactttttagtacttgaatacccacttaacagaatacttgaaacagaataaatagaacaataaaaatggaggcaagatggaaaattctttaacattctgtggattaaacacactgtacaaagtaaggcatatactaacaccatagtaactcattcttttactttatcgttattgttgttaattttagtacttaatattatagcacttaattatcccaaggcaatctcagtgattttttacaaaatgtattttcatttatttgataggtcatcaaagtgactataaataatacgcctttttctttttttaattctgaagagaactgctctagcctctgaaatgttatagagtaagacgtttcagaggattcttttctcaaccattaatttcttaatagc

SEQ ID NO: 70453 - DNA, 1377 bp, Homo sapiens
atttgcctgatgggtgtaatatctttagagtttttataagttttcaatgaaaatattttatgttaagtatccacaggtaaacttcaagatttaagccataaaggaaaaaaatcagtctgatgaaaataatctatatgggtgtggtttaaaagattttttttctttttactgttttgtctttgtcttattagattttaagtatcaggacacttaaaatgtacaaataaatgtgacctttttattatttcataaactttagcatagtaaaaattatgttaatctggtactgacatctctaatttttttatcaaaaaattttaaattttgcctagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaaggtaagtataaagtttataaattgtaatatcaactgttataacatcagtgtttagaacattaactacccattattgtgattctctgtaattaagtggaacaaatttatatctctatattgcaagttttagtttcacaatttattaggcaaattaagtcttgaatcagagaagatggacactggcatctttgaaaaccaataactgcacgatattacattgtttatctttctgattgtggcaaaggatatctgttaaatgcgtagagaaaataaattatgtaagtttgatgaattgattaaatcagagaactaggtacttttttttttttttagcagtccattaaggtggaagtttaaagatttctatcttttcaaccaattaatattttctccatcagtcagtgagtttggttgcttctctatattaaatgatacgactattgtggaacacattacaagatataaagcctcttcctgaaggaagtatatagcctagtcagaagataaaatctatacatttgtcataattattaaacatacaaggccatataactgtgtgttagtatatagtctaaattgtatgctacgtaaaagagactagggccgggcacagtggctcacgcctgtaatcccagccaaggaggccaaggtgcgcggattgcctgaggtcaggagttcgagaccagtctggccaacatgatgaatccctatctctactaaaaatacaaaatttagccgggcgtggtgattcacgcctgtattcccagctactcgggaggctgaggcatgagaatcgcttgagcccagg

SEQ ID NO: 70454 - DNA, 1044 bp, Homo sapiens
accaatagtttgtattgcaaatggcatcttctaacttcttggtagtagaaataagccaagaataatcttttcataattataactttatagttacaataattcaagggttttttttttttacacgtttctttgaaatatttgactatcttaaagcttttaaataaggcagtgctgcagagtgctaataaacccacacatgcctggatgtgttgcttatttaactttcctgtgtgtcatttccatgttaatgggataagttacagtgttttcttttctgactcatttactgagtgaaggccaaaagaaccatacattattttatgaataggatcatgagaaagaattatcttctccaagagatagcaagcccttgaccgttgaaaagaactattatactgaaagctttgatattttgtacttgcagtagctggccttgagagagagttgtttaacttttcgcattcccaaatggtgtaaatcataaaaggtattgctgaatatggacataaagcacatttgaagttgataatcttagtggttttataacactgtacttttatctgtggtaaatgcttactgaacattcacttaaaaaaattgttgggtctgtggaaaatcagaaacttttaggcatgtgatttaaaatctgaaatctagtaccccttttcataagtgatcctgacttcttggtaaattctagtagaaaatggaattttaaaattgactcattggattagccctatttaaattttcaagcaggttctaaaaagcacttccaccttttcttttatatatacagggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggactgtgagtagaaaagataacgtacgtgtgtgtgtgtgtgtgtgtgtgtgtgtataattat

SEQ ID NO: 70455 - DNA, 3434 bp, Homo sapiens
caaattccagtttctggctattggtagaagtgtggagaattttggatttctgtttgttaggaattttaggaaaaataattggaatcttagaggttttttttaatttttgatttttaattttactgttattcagtctaagaagtgcattggccagccttcataaaatttatttagacattttcatatgattaactttgtgggtcccccatttagacttttaaaagttgtgagaatgttaaagggttgcatgtttttatcttaaaattgtaaagcaccttccaggtaatatagactttttccagattttcttgtcttggctggtaatgtgtgtaagaaataccggtattatatagtattttattatgtggtgagaaactacttttagaatacaaggttttttttctgtttaaactattttatgttcttggtataaaagcaacttgtttctatcccttgatattctaggtcttttctcgaattaattttggcattaatttaattagataaatagctcataaatagtaagcatggaaattttaacttgagaaagaaaaactaaagttttcttagttttctgaggaatgtttgttgggcataatatacctgttcactctcttcaccttagatttagtccatattatcgaaccaaggaaaaacttcccctgagctcagtatcatacagtaatatgattgaaccggatcagtgtttctgccgttttgatttaacaggaacatgtaatgatgatgattgtcaatggtgagtagtttttgtgaacattttgtaatttgaaaaatggtcttgtttgcttaactttgatatgtacatgattatcttttctgtgtttttttttatcttaggcagcatatacaagactatacacttagccgaaaacagttattccaggacattctgtcatataatctgtctttgattggttgtgcagagacaagtactaatgaagaaattactgcttcagcaggtttttaaagacttcctattctctcccaaatgaaaattgaatttaggcaacttaaaaattctatattagttgttgacattgtaaaatacttactataattcagtgtatttacccataatactttatctagatttgctgtatccagtataattacggtaaaaatttacttcctctgttacactagccacatttcaagtacccaatggccacatgtggcaagtgcatgccagtaggacagcacagatttaagacatttccaacatttcagaaagttctttggacagagctcatttaaatatttagttccatttatttaaaagaaaatattaagctatttgtatagaaactttactattgattttaacataggagcctatttttacttattgttttcaaaaaatagaggaaggctggaaattacgatggctgttgtttccaattctataatgaaataagacttgatacacttgtgagcaaatattattaagctttttctcagatttggtgccaagtaataaacctcaagctacaaatcttttggaagtaaagaaaataataattactaaatttggtgttatcacagcccagagtgattgtaatgtcactgaatctattttatcgctcccaatttgggactttaacttaattacttagttcattttaggaactacttttttttttttttaatcccaaatggggtatatgatgtggtaggatttgccatagtagttaagataatacaggctttgccctttcaaatgccataggtgttattgactagtaccatataatcgcctttaattcttaaactagttcacgtcatacattttaattatcctagtctctgtaattgatatttatcatgaagattgcattgctcttatttcagaaaaatatgttgagaaactttttggagtaaacaaagatcgaatgtcaatggaccagatggctgttctccttgttagcaatatcaatgaaagtaaaggtcatagtaagtacatatataagtgtgtgtgtgtgtgtgtgtgtgtgtgtgtgtgtgtactgtatctctttctgaaaaggactttttagtttctgtatgacagaaattttgttggtattatgttcttaatgtaatacatatcattccaggctgggtgcgctggctcacgcctgtaatcccagcactttgggaggctgaggtgggctgatcacttgaggttaggagttcgagaccagcctggccaacatggtgaaaccccgtctctactaaaaatagaaaaattagccgggtggtggtggcgtgtgcctgcagcctcagctacttgggaggctgaggcaggaaaatcacttgaacccgagaggcggaggttgcagtgagctgagatcgcgccactgcactcactgcactccagcctgggtgacagagtgagacttccatctcaaaaaaaaaaaaaaaatacgtatcatttctaagatggagtgaatgtagttcttctcaaatattatttgagtatccttcaaaatgttaaaaaaaaaactagttatatcaattaacaatcttctcctatctactttagctcctccatttacaacctacaaagataaaagaaagtggaagccaaagttttggagaaaacctatttcagataatagcttcagtagtgatgaggaacagtctacaggaccaattaagtatggtaagaagttatgtaatttaagatccagaattattaaattgtggtgttccatctttatttaacactttgctaatcctttggtgtatcagcctgcctggttaaaaaaaaattttttttaaaaacgatgccattgggtttttagacaatacagttaattcactgtgcaggattgcctctgaaattgcgggatatttgtgttcatggctcctctccagtaaatgcaaggagcactgcttagttaataattatgactgcttcagatatttccaaacatacattagttggtggggaaggtagctcccgtttgagaaccactgcctagcctgtgtcctccttaagggcaggtgttctattttacttcatctttgaatatgttttctgacatgcagaaggctcaaaagatgagaatgaacaaatgatgaatgaactaatgaacaaaataatgtatgaatgagtgcctgtatgttaggcacattttactttctaatttcaagtttgcattatttgtgaattagcaagtatccaagagatgtatgctattatgtacttatttacactaacgtaacactgtttttctagtttagatatagtagaataatctttataaattatgacttttaatttcttaattataatttgcagtttaacaaatgtgaattcatttgataataatgaaaaagcagttgaatcatagttactgttaagtggactgaaaaggtaatgtcacttagccttaaaatagcagagttctaattactccttttgttctggt

SEQ ID NO: 70456 - DNA, 2286 bp, Homo sapiens
ggtaagccagttttggcaatttaccctctatatgtaaccacaaagtacagaattttgataattattatgtaaaattaacaaaatttttctttggttttaaaagagttaatttaaattgcattgtggttctttataatagaaagttagtgaaaataaaattttaatgagagtaattatagaatagaaagtcttaaagaatatacaacattttatgtctcagtcatataaccagtattggtcgactcagtggattatgtaatacaaccctagaaggagccatagactgtctacttggagcccattatttttgtggattgaaattgaacaaggttaaatgacatccttttgttatcacgagtaataaatatattgtctttgcagcttccaaagcataaatcagtggttgtaacactaaatgattcagatgatagtgaatctgatggagaggcttccaagtcaacaaatagtgtttttggtggattagagtccatgattaaagaagcaagacgaactgctgaggtaagtgcaataattaaaggtggaaagaaagatgaccttttgatgatcagtaaagtttattttttcctgaaaattaaaccataaagttatagatttttaataacattgatttgtggaaatattttaagtatttgtgctattaggactttatataatgaagcatgtatcaatgtagattgattttactattaaaagtttccattatttgtgtttcctattaagtatttcctttttcaaaatagtaaaattggttggataattgttctgtgtagtaaggagactgttgttttagagttgtgttgtgttaccagaaaacagtttttattaaaatgtattctctaagtacaacttttatcgttttttccctatttcagtagttgtttagctgtgatttaattcaatgattttcagactgtagatcttcactacttggtggcgtatacaatttagtagttatcaaccaacattgttttagaaaaaagaatagaaaatgatgacattcaggtatttctaaataaattcagtatacactgggttgcaatgtaaaatataaatcttagtatggaattttggaaagctgatgatctagttgacttcaaatgtttttttttttttagcaagcttcaaaaccgaaagtacctccaaaatctgaaaaagaaaatgatcctctgcgaacaccggaggctttgcctgaagaaaagaagattgaatatagattgttaaaggaagagattgccaagtaagtgtaattttatgtaattaacattaaaagtatgtgatgttttcaaaacttctcttatagagtttcttggcactggggaatgagtgatgatagttttatccaagatacagagttaatgttttataactcacacagaagatggtgctggatggtcatacatacacttgaatagagtgatgtgctaggacataaccagcttagaaaaaagatgaaaacactcaaagagaaggactccactatcaactttgaatgctgacttgggtcttgcatattggtcatcatctttattattagtcggtgtgattaatattgttactgcatgaaatagaatacattttaaaaatagtttaagtttattcttgggtgtaatgcatatatcctttttgataattttagccgtgagaaacagcgtttgattaaatcagatcagctgaagacaagttcatcatccccagcaaactctgatgtggaaattgatggtattggcaggatagcaatggttactaagcaggttacagatgcagaatcaaaactgaaaaaacataggtgagccttgttatcttcacatatctaattgttcctgtggtagagaaatacatttttgtggtgtatgttattaataagcgtactataagattatacattttctcacttaaactttgtagaatgtagaagtctgtcattttgttgaatgacactacatttacataaagtaatgaaattaatgtttaaataaaaataccggccaggcgcggtggctcacgcctataatcatagcaatttgagaggccgaggtgggtggatcacttgagatcaggagtttgagactagcctggccaacacggtgaaaccctgtctctactaaaaatacaaaaaaattagctgggcatggtggtgcatgccttgtaatcccagctacttgggaggctgaggcgggagaatcgcttgaactagggaaatgcattcccactgtgcctggcccaacgttgaatatttactacaagttttcaacagtaattcacgtt

SEQ ID NO: 70457 - DNA, 1035 bp, Homo sapiens
tattcacagaatcccttggtttctaatttttattttttactgaaatattatgtcttgggtttcagtacctctacttgctttcaggtagtcatctagaaggaaggaccctgtatagtttgatatctatatcttctagaatgctaaatggatataagaattggaacagagaagtttctataattttccttgaagttaataaatgtttcaaatattgttgattttttttaaaattgtaaaaataacactttttcgtggttggctattgatttctggtttgttttgaggttaacatatacttagcttactatatttacagctaaaataataatgtaaagtttatttttttctagtttaatattgctgcagagagaagcatttgagttgataaaatttgcgttgtaattctttctttttttaaaaaatagtctctgccacctttgagccagccttatgtggaaggcttgtgtgtttctcttgaacctctacctcctctaccaccattaccacctctcccacctgaagatccagaacagcctccaaaaccaccttttgcagatgaggaagaggaggaagaaatgctgcttcgagaagaactacttaaatctctagcaaataaaagagcttttaagccagaggtaatttaggtacctaaacctctaggtggtgctcttgagcttagctttacggtagtcctacttttttctggttacttgggcatcattgggcttttcagcaaagtggggataattctaacatgctcaagatttttaaaggtggcagaaatttatttttatttaggaatgtttaatgtctttctcttccttatgtaggaaacatccagtaatagtgacccaccttcacctccagttctgaacaattcacatcctgtgccaagaagcaatctatcaatagtcagtattaacacagtgtctcagcctaggatacagaatccaaagtttcacagaggaccccgtcttccacgaactgtgatctcggtaaaaacaaaaatttaatgctacttttattcaaacagtt

SEQ ID NO: 70458 - DNA, 2636 bp, Homo sapiens
tgagccaccacacccagcctattgtatttatttttaaggtagcaatgtagtcataaggtacctgctatgttaatagatacttgcctctatgctacgttaaagggaggtgctgccattttttatagacaagtgagatcctaatcaaccagtagatttctcatgacttaatgaaactcataagtttctcatgtaggagaataatttagtgtttaatgtttccctgtttatttttgtataatagttattactattctgttgtttttaaaagcgtgatcattttttctacagtgggacatatgcatttcccaaaattaccacactgcaaaattatgcaataaaaacaatagggtgtgtggagaaaatggggttagaggaacaacactcaaaaactttgtccgtggcatataaaaaaaagataggaataaatgaaaaatgatagcacagctttgcatgtgaaatggagaaaaaaagtgtgaaatattaaagtaaacatgtcagcattccataaaatagacctgaagtacacctgtggaagtggaatatttgctacttatgagttattatgaagtaaaacaaggagtgttacctgaaatcagacagtaaattgtaataccagatgtggatggctgtggcttataacacacgcaatgaacttgggtatttgatagatgtttgaagtatatgttgtttgtgtattcctacatggctcagatcacttgggtgcagttttctgcattcttagtgtttctctgagacaaatcacacataagtaaatataaatttgtgttatgctcaaattcttttcttttcttttctttttttttttttttttttgagacaagagtcttgctctgttacccaggatggagtacagtggtacaatctcagctcactgcaacctccacctcccgggtccaagcgattctcctgcctcagccttccgagtagctgggactacaggcgtgcaccaccatgcctggctaattttttgtattttcagtagagacagagttttgccatgttgcccaggctggtcttgaactcctgacctcaggtgatccacccgcctcggcctcccaaagcactgggattgcaggcataagccactgtgcctggctgctcgaattattttctaatgtatcagtcatgttgcaacaaattcacatttatagactaagcctttcaacagaactcatttgtcttgaaatttggtcattgccttctatttacattgatttagatgctagattagtcatttatttattgaataagtcacgtattctttggttcacttgagcagtcaaattaggatgtttggaacattgacaggtgtggtgttatggtaaaaacaccagacttaaaattaagatctagtttaaatcctagctttgcaatttcagttttgtcatcttaaggaaagatttctgagtttttaacataatctgttttagctacaaaagtatctcaacaggattgtagatattctgtaactttatcatgtgatgtttaaagctgttgtagattaggtaatatataaatgtaagattttgtacattatttcatcagtcatctgggcccaaggctagatatctggaaaaaatgtatggatggacttaattttattgatacttaagctgcctctactgatgcttttctaggtaaatgaccaattctctaatgcacaaatccaatacagtctgtaaacattgcattcattccaatttagaggactggattaatttagtcatcattatattctatcagtgtggataatccacttggtaattaagtgttgctgcttgtttctatgctttataaattctcttctcatttgaagtgactatttctagttcagaagtcattttattaaaagtgtggctttattttaatattttgaatcattttgccttataactttgaggaatgaggctgataagagtttgttcagattttcattctctttaatggtatttccttttggttgagagattgagaaaatgagaccctttaatgatctcttttaaaataattaccagatattatataggattattttattttagattgtggctatcttttggattattcaaaagatattattttattttaaaggattacaagataaagaacaaaatttaacaagaagaattagtacctcagatattctgtctgaaaaggtaagatactgctttgtgagactatcatctctgtaagacccatttttgcattgctttattttgttcttttgtaagggaagtctatcttactttcacttattttctttcatcattcctataactccatttggacataagccttaaagaaattctggatcgacatcttgcagtctcttttccctgggttctgcaaattatgtttaattaaagtgttatatatattcatacgggatcttttttttaatcatttgttttttgaaacctttaattttgatccagatattttctccattttttgtgtgttatcctgtgtgggtaagcttttggagtaaggtagaccttcacctggtgtcaaattctacctccacttcttgttaactgagtgactttgtataaactatttagcctttgcttgcttctatattcttttctacaaactgaacttaatgtcttctgtta

SEQ ID NO: 70459 - DNA, 1338 bp, Homo sapiens
agggtgttcttaatatatttgacttttccatccaaaaatggaaatcctcttccacctcatcctacattctctcttaaattatgtcaagtattcttcctcttttcaataagacttctgagaggtctagtcggtaccagcttttgactttacttctcattgccttattagcccaatacagtttgcttttctacccccatcacaatactgaaactactcatggtagttttctgtgacctaattgcaaattttagtggatgttttttatttcattcttccatttattcaaaaattagttgagcactttattccaggctcttggaaataaattggtgaacaaaatagtcacttatgttttcatgggcttacattttagaaggcaaaacagtaaacatgatgtgtaaattaactgttatgaaagagaaaaagtatagcagggtaggtaggaaagggttattgaggatacaggttgcagcactaatagggtggtcagcatggtgtctatttgaaggtgagatttaaagaaagactttgaagacagtaaaggaatagccaaatggatatctggtggaagaggctcctatgcaaaaggaataactagagcagtgattttcaaagtgtggttcctggggactgcgttatctgggaacttgacagaacacaaattctcagtctctaccttagatctattgaactgggagctctgcaaatggggcctagcaatctgtatttaaccagcccttctgttgattctgctacatgctgaagtttgggcatcgctgaactagagaaatgaccataatacagaaagatgcctgacatgtttggggaataacaaggagtcctgtgctaatacaggagagtgaggggaatgaataatgggagagaagggattagagatggcaggagggggcagatcttatagacagagccttgtaagaactttgtttttttattcctaatgaaatggggagctcttacagggttttgagcaaaggactgacataatctgttttatatttttaaggcatcactctggctgcattgctgagaatattctattgggggtagacatctctactatattcagtgatatgtttcttcccttgaaattttgggatttctgcaatggattttaaaaataactttctgatttttgttttctgtcttttgtttgttttaaataattacttttcctgtgtaatttcttaattcgtcatgtcctcagtgtcccattttctagggatattctcattattatggttttaactactacctgtgtgctggtgactttggctcacattagactttcagttggtaatattttaaatactgtgtgac

SEQ ID NO: 70460 - DNA, 1490 bp, Homo sapiens
cttcagattattttcataacattttcccttgtctgtaggagaaaaatagatatattttgagtactattttaaagtgtttttttttttcttttttttgagatgaggtctccctctgttgcccaggctggagtgcagtggtgtgatcttggctccctgcaacctccgcctcctgagttcaagcaattctcttgcctcagcgtctcaagtacctgggactacaggcctgcaccaccacgcctggctaattttttaatttttagtagagatggggtttcactgtgttggccaggctggtctcaaactcctgacctcaagtgatcctcctgcctcggcctcccaaagtgctgggattacaggcgtgagccaccgcgcctggccccctgaagtgtaaactatccgcatctgtgacaaagcattcagtttctcccctcttccttcagaaaataatctctaacatacagctaattatggactttcctggcacagaaggaatgatgctataacctaactaggtggactgtctgtggatactactggtaattatgacactagtgattttgtaagtggactgtttatatggtacttactaaattcaaatatgggcacgtaatgaaagtgggcattagctgcacatacattaaatggaatttagtaatttaaaaatatcgattcatttttcttgaaaaattaaaaagggagaaaattcatctataatctaagtttttttgttaaatttaactgtggaaaatttttggaaactggtttccttaatatgctgttcagccaaaagttttggaaggtctccatcaagaaaacaaaattattcatcaaaaaatgaaaactgtgtggaagaaacttttgaagatttgcttttaaagtataaacaaatacagttggaactagaatgcatcaataaggatgaaaaactagcattgagtagcaaagaagagaatgtgcaggaagatcctaaaacattgaacttcgaggaccaaactagcactgataatgtcagtattacaaaggattcaagtaaagaagtagctcctgaggagaaaacacaagtcaaaacttttcaggcatttgaattaaaaccactcaggcaaaaattgactttaccaggagataagaaccgtttgaaaaaagttaaagatggagcaaaaccactttccctgaaatccgacactactgattctagtcaaggtaatggaattaaatatttcagttagtaatgactcttcttcctctaaagtagtaactacttgttttggcagtgtacttcattgaaatgattgtaattatctgtaaattcttttgtactttctatgtagacattcatatcattgaataattactaattttgtttacttttagtctttatttatttatttattttttgcctgacattctggcctctataatagaatgttatacataagtgataatagtggacacctttgtttcctaatttaaagaaaatggttttgacattt

SEQ ID NO: 70461 - DNA, 2002 bp, Homo sapiens
ttttatataatgtgagcaaacaaaatatttgttacaacacttcattcaaatttatttaatatcaaggttgtactcagtttaattcatatttccactatgtgattataataataccttttttattttacaaatactgtataaagaaagaatgcaggttactctgtggcatatttctgtaatttagaagtaaagtagcctgagtatagggtttatttctatttttgccataactcctttcactgtaataactaagatatgctagttgcaactttaaagaaatagaataaactagattcaattgcagttcttattttcacccttaatttttcttaatgatagacactttgtcagtacatcttagcatgtctcccttgaatgactactcttttaaactttcaaatctgaggagagctaacataattaggctagtgtctctcatcagtaaaaagtcattccattttcagctgcagctgaaaaggttgaatagcacttctttttgtttaaaccaaggttcagttagaaattgtatcttgacaagcttaaaattaaatctggtaagtgttggtttgatcttaggcttctgtatagatagggatagattttctttagccttgaaggagattagtcagttatagttgtaactcaattgcttttccttatttttctatttagcatttttgttagtgtatttaatcatttccctttcttttcttttttttttaattgcagttgtgcctttaaatggctccagtgaaaagtaagatgtaaatgcagataattacagaacttacatacaaagagtgtgtaagaggggaagggagagtgagaaactcaggcttcacagaggtgacacttgaattggggttaagttgaagaacagacaaacttagacacaaagctatgcaaaaattgtgatgaacaaggaaaaagtaagtttggaaaggaaagcacaggtcagattatatttattctcaggattttggacttttttattagggaaatttaaacaaggggaatgatcttatatttgtattctagaaagattactctggcagcagcagtatgaaggatggcttgtaggagataagagaaatatcttatcaccagggtaaactctcctgtggtaggtaaaactgtggaggtgcattagaatgctcaaaatgagaaagaggctaagtagtgctccctgaagagcaccattatttcacaagttagagagaaaagactcaatggagacttaaaagacaaaacacaaatagggaaacaaagggagatgcggagttatggaagccaagagagaagtggtttatggtgtcagattctcagaggggtcaggtaaaaaaaaataaagtttgaaaacattgatagggaaacttagccacagcagtctctctagattaatgggacagaaaccagattccatttggtaagaagggtacagagaaactagttttctttcaggatacttggctttgaagagatcagagaaccagagatttactagaacagttttgctgtagaactgttaagattttcagatgtacttattgcttatttttgtttcttagatgatggtaattctcatttttagaactggtcatcaggagagtttaaaaaccttttctgctgcttgccctgtgaggtgtttaaacagaagaaccgtatttggggtactgtattttacatcctagccaactgaaaataatctataggctgggtgcagtggctcacacctgtaatcccggcactttgggaggtcaaggtgggcggattacctgaggtcaggatttcaagaccagccttgtcaacatggtgaaactccatctctactaaaaatacaaaaattagctgggcatggtggcacgcacctgtaatccaagctactcaggaggctgagacaggagaattgcttgagcctgggagacggaggttgcagtgagccgagatcgcaccactgcactccagactggctgacagtgcgagactctgtctcaaaaaaaaa

SEQ ID NO: 70462 - DNA, 1007 bp, Homo sapiens
aaaaaaaaaaggaaaattatatagatatttaactttttaaaagccagcaaatggttcttccaagaaggttagaaaacctctgcccacggtgtttcttaatccatggatttgtggtctattttgaatccaaaagccagaaaggctatttaagcatatatatgtgtatggtttttatttatttatttatttatttttgagacagagtctcgctctgtcgcccaggctggagtgcagtggtgtgatctcggctcactgcaagctccgcctcccgggttcacgccattcggcctcagtctcccgagtagctgggactacaggcgcccgccaccacgcccggctaattttttatatttttagtagagacagggtttcatcatgttagccaggatggtctcgatctcctgactccgtgatccgcccacctcggcctcccaaagtgctgggattacaggcatgagccaccgtgcccagccaatgtggatggtttttaaatttttttaattaaaaaaaatttttattaaatttatttaaaaaaatttttttttggggagacgaagtcttgctatgttgcccaggctgatcttgaacttgtagcttcaagagatcctccttccttagactcccaaagtgctgggatttataggcgagagccaccagtttatatgtgttttttaaaggtacaaagatgaaacctgtagtttgtattagggaaacaaatgaaaataagtagttgcagtttagtataaaaagttgaaactgaagtatgtatataaaaaagtactatgggagctcaaaggtttttcttaaaatttttattctgtattagaaaagggggaggtgagtgggctttctgcttttgtcctctttctgcgtgtttattcaatactattttgggcctctaccatagacctttattaattggtaagcttgcatgtttttattagtaaactggcatatgatgttgcaaaaaaaaaaaagtaccagaaaatatccagtctgcttgtgtg

SEQ ID NO: 70463 - DNA, 1156 bp, Homo sapiens
catccgccttctgtacggatgccttcgagctcactgtccgaaagcagtccccggccgtctttctgggagcggagccacctcgccttggaccgtttccgctttcgaggcaggccttaccggggtgggagtcgctggagtcgggggcgaggagtgggtgagcgaggaggcaagccggggtgcagacctcctctgggaggaggagcaggatccgggttcagcagcagtcagagctggcgagagccctctccacctcggaagagctgtatccttaacgtggcggtcggcgctgggtgtgtcactaaagttccctttagcgtcattactaggtctgtgagacgagtgtaactttgaatcatcagaaccgcttatttctccctgtgtcagtatactttaagttgttctttggtaattccccatgtgtcacactatagcgttattcttaagactgcttcattgggtatattaacgtgctgtggattgggttaagcttatgaaatctaagacagttaagtctgatttgtaataataccttagaagcccaagtttcattagcatttgtatttttgctggtacagaaactttgtgttttatatgaagttgacttggattgttagagaaaaaatattcataaacagtttaagtaatattgttgctttatcatattgcagtttgacgttgaaaattgtaaagttttaatctgcacagtcctgcactatttttgtgattctgtttttatcttgatttattccggttgctgccttttaaagtgggggggggaggggtaaaaaaaaaacaactctggtgtctttaccaagtctgtttcagagctttttgattcatttgatctttttggaacactttacctcctttacgtttctatctgtgttcacttttgcacattgtgtaacttcgtgctgactaaatgagggccagagagagaaagataaacttatcagcatttttattttaatacgttagagtggaggaatgtgtatgcgagggtggagattacgggtaagttgagaaaggaaatagtaacattccagatttttcctacttctaaccttattctcagttttaaacattactgagtttactcagcatttatacagaggaatcaatcatccgaaggtttcctgttttataatgggtttgt

SEQ ID NO: 70464 - DNA, 1038 bp, Homo sapiens
ttcggacagtgagctcgaaggcatccgtacagaaggcggatgagaccggaacggttctttgggtcggtagctgctgggtcccctgaggtggccccgctcagacgcgtgccgcgagcgtgagaaattcctcagctgctgctgagaagaggacgatgacgaggaagagccaccgcctccgccagatccaccgccccgggccgagtgaggaggccttcgccgcggatagggtaacagcccgccgccgctgctgctgctgctgctccgactccgtatctggctgttattatcgtcgtcactgatttccccatcttcaagctccccttcttccttcggcgagaggccactggaggccggggccggagtatctgcggtcgccatccggggagcagcgccttccacacaaccttagccctccgtccggggatccgcccgacaattgcctcgtttcccttctttcctaacggactgggtcggtgcggtcttaccctactcggacaccaagcggcctctgctccccaacttccccgcaccccagcaccccagctctctctcgccggaccgtcgcaacccagttccctttcctagcgcccccttgctcctcagcgatcggggttcttccgcctcgcgagaaagggactctggtagcggctgtacccgaaacgtcacttcctgcgacacgcaggaaacaaaggctcccagttcacgcgataataagaccaactcgatactcactaggatttgtagtctttcgtctttcttcgggtttactcttccggtcctagggtcacacccaccgcagggtctggcttggtacagttgggtgcatgcagaagtaggtggagctgctgttgcagccttgagagagttttattgtaaaactcttgtaatttatagtaatcggaggggaaaacacctcttccttttaattgctctgaggaccgctgccaaagaaacgcagtagatccgctccctcttgggggcggggagaaagaacgggttgtgtccgccatgttggtgaagtcaagcgaaggcgactag

SEQ ID NO: 70465 - DNA, 1040 bp, Homo sapiens
attttctaaaagaaatccaagtactgtttggtcattaccccttagtaaaaaaaagtaacaggaggatatcgtaattttctactgttttattcctctgttagaccgggccttgacatgaatgacgccgtaagggagaaagagatcttcccaatcagcaatcaccgtaaaagcctgctgtgttcccgttaaaattaggaaattctcactagatgaattgacatgggaggcatttagatttctaatagtcacatagtaattctgcggaggaattgagtcatctttgatagccatggaattaagcgatgttaattaaagtgcaaaagataacctttctgttcttactagaatagagtaataaaaagaacctaggttttcttttgtttgctggaagaaaaatcaaaattctttagttctgtcaaaccagaactcttgaaagcactttgaacaatgcctggaaaataacaggtactctgtaaatgtttaccttctctgcaagtgcctgccacgtgcccgaagaaaagacacattaaaaagttaagtgacaccagtcctgattttatatattttatatacctaacaacgtatatgttagtatgtagaaattatatccttgacctttttccctacctattacgaactgtacttttattaaaagctgccacttaaaaaaaatcttgtgatgtttctgtttttaaactagttcatgcatatgtagtgctttgttcattcatccatcaaatatgtacggagttcctaattacctgacattgtgctaaggatccagaaagttctaaccctcctggaatttagaatttaatggtggagaaagacataaataattaagtgccacagaagaaacattcagagacctaacttagtcttggaaagtcaaagaacactttttcaaaggatgtgacatttcaaatgagaccaaaggatgacagattgggtcctgtgtgctacttaagtattttctgttttatcctaagagtacttgagaaaccatggagggtttaaaaaagaatggcacgattagattt

SEQ ID NO: 70466 - DNA, 1014 bp, Homo sapiens
tttgagttgcatttttttttttttaaggtttcctttggatcctaaaagaagaaaagaatgggttcgcctggttaggcgcaaaaattttgtgccaggaaaacacacttttctttgttcaaagcactttgaagcctcctgttttgacctaacaggacaaactcgacgacttaaaatggatgctgttccaaccatttttgatttttgtacccatataaagtctatggtaggtaatgttactctccttttgttaaaaccatttttagaactcattcctttttgtttatgcagttattaactgaaattcatttatagtgatatgcctcaaaaaagttgcagaccttcctcttgtacagtaaaggtacaggctagaatcagagtttgggtctcctgactccaatattctttccccaatccaaattgttttactatattggaattttacattattacccattattattaataattgcaccattggtaaaactgaaaaatcatatgagtaatgaaacctccagcatcactgtgctctgattttaaaatgacatacaaataacatgtgcaaagtactttaagagcacacagccagaattaaaccaaagaatgtaagttcagagggaggcaggcatgacagaaatcttcagagagcttgggcattcagggtgggcttttgaagccttgggagtttaaaatagaggaaagggaacttggctttgcacagaataattacagttgcataatgagaacaaaaacgagtgggttgaggcgtgagtaggaaatgttagcaagtgatatttaaaggaaagaatgaagaaaaaatgaagcaaaaaaaagtaaattaaaaaaaacgaaagaataaaggtataagatgaatgaattaaaacaatgttttatctagttagggaagatctgaccagagaggaaaacctagctgggaaagacagggtcaccaagagtaagaaagggtaaaatgaacacaaatagtttagctttgaaagggaggacaaacatgttttc

SEQ ID NO: 70467 - DNA, 1079 bp, Homo sapiens
ccggccaggatgccagcagtgcctgcccacgtgagctaggcgacatccccctaagcggctgcggcgcatgcccacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaagtctgagtgttctaagttgtttctctgtaatctagtcagaggaaattaaaaccataccattgtgaaatccaaaactcatatcctctgaatggttatgaatggttgtgtttacttaacttccatagcctgatttaacttactaacatgatagtataaacaatgcctttaataaatgcttgttgtgataattcgagttatacctatttctttttttttttaatttttattttgtataagataggggtccctctgtgttgctaggctggtctcaaaccccta

SEQ ID NO: 70468 - DNA, 1030 bp, Homo sapiens
taataccatatttttactctactttttctatgtttagatacacaaatacgttataattgcctgtagtattcagtacagtaacatgctttacaggtttgtagcctaggaccaataggctatagcatatagcttaagtgtgtagtaggctctaccatctaggtgtgtgtaagtacagtctgacgtttgcataaccatgaaatcacctaaggatgcatttctcagaacatatccctatctttaagtgatgcatgactatatatttctttggtgacttcatcttggtgtttgtacttatgacagtattttagtctaaaagcagtaacggaagtttactgccaaaactaacctgtgcaaacttcacacaatttgtgctccacctttataatttttcaggtaacttacgacctatttctccgtggcgttggctgttttctgttgttgttcctgttctgatcgtctctaatggccttaaaaagaaaagtctagatcacagtggggctctaggaggtatgtttttattttgaatgtttacagtaactactaagtgcttgcttatataatttaaatttatgttttctaaattctgaatatatgagactgactacaaatcacagttatatattttagacaatgataaagttacatcttgctcagcattcctattgtcaaaatttcagaaactaacgtacacttttagtgtaacatacaaattaaactctgtgattgatacaaagtagattaataggatagatgaaccttgactattctgctcctttagtttgattagtcttctaccagcagaaacactggagcactcctcctatatgtaaaatagagcatttggagagaataacttttggaaattgctgttagtaatctcaaaacagagcagtccaaacttagtgttctggattaattttccaaaactgagttgagaacaggatatgcattcattcttttagcaattttttttttcccgagacagtcttgctctgttgcccaggctggagtgcagtggcatgatcggctc

SEQ ID NO: 70469 - DNA, 1096 bp, Homo sapiens
tggcttaagagtagcagaattgggcctggcaaggtggctcatgcctgtcatcccaactactagagaggctgagatgggaggatcacttgagcctggagttggaggctgcagtaggctatgatcacaccattgtactctagcctggttgatagagcaaaaccttgtctctgaaaagagagagagagagagagagagagagagagagagagagagagagagagagagaagcagaaccaagattgaaaccaggcagtctggcttcattgaaccattctgcttcattgcttaaaatgtcaagagttaccgaggagaaaatactgttttctaaaaagctacagtctttagattgcattaaagagaatgctttctttaaattagtcttgattagataggtaccttgctgtccttgcctttatgtgtttgctgattattaaccggatgattttctgcatgtttcttcttcaggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactggtaagaacattccttcattcttgcaacttattggtatgttaaagaaatagggaaaagaaagaaaaaaatgttaacaatgaaaacaaatccaaagacacagggtgttgagggactagaaatgatagggcaaagtctctttcacaattttggttttcttattcttttgtattaaattaattgaaagagaattagtcccgcgcagcaatgattagaagccatgtggggaagatacaatagtgcagagaacagacgtttttgtgtgagccattacctaatcccagaaaagcaagacgtttgggatcagatcattttaatacaattccttccattcattttcctattccatttgaggagtaattgtacaaatctgactatacacacgacctactttcttactgtggtatcatgcttgctattcttg

SEQ ID NO: 70470 - DNA, 1087 bp, Homo sapiens
tgtaaaatatttcactcaaaactactaaaaaaaagtctgggatggcagctcattatcaaatatactcctatttttgtggtgatttatgaacatccccactaagtataactaaagatcataaagagcctcagatcaagtttggtcaggttttgtcaccaagctttgtaaataaactggttttcatagctttttggagatgagaattgaggataagaaattgtgtctctgtcctttttttttttttttgttaagtcttacatgtattttactgtaacatcttttgaattggatatttaactaattcaacatatttttcctctttgcagaatgggcagttcatgttaaaatcacttttcatggaaagagctctatgtaacagcataataaaactgcctacctagcagcataaaggtgtactgtttcttatcatactgttccatgatagaagagagcagatatatgtggcttggggcagctcctgaagaagacttgcaggagtagcatgttgaaaactcattaaatggagccaccaagagaccaaagaattgatacagcaggtcattctattattagcttttctcattacttgagttatctgtttctcacatatatctttcctgtttctagctgctgtacacataggatgctgcctgcagaaatagcagccccgccccaattagataaaggactagtatagagaaaaagcatgtgaaatgatgttttaaactttgccgcatacctgtgatatgaacagctgctgcctgttaggcacagtgggtatactagggcccaatcatctgatcttcctgaagttttatgtaatgttcccagtgctatcacaatgagaatgatctatactagccaccagatctcaggtgaattgtggtgtgctttaaaaatgaaaacacagccggacgaggtggcttatgcctgtaatcctaacactttgggaggccgaggcgggcagatcacgaggtcaggagttcaagaccagcccggccaacacagtgaaaccccatctcttagccgggcatggtggcgcatgcctgtagtcccagctattcaggaggctgaggcgtgagaatca

SEQ ID NO: 70471 - DNA, 1680 bp, Homo sapiens
ttaaggttggctttggtagatttgctccaatagttaagcctgttaatgtcctttttaatttggattctgtaattcacaaaacactgactgggctcctttgggccaggtactgggttgggtcctggacatggcaaagaataaggtgtggaatctactgtctggattagctactttttaactttgtcatctgaaagttaggtaagaatgcctttaatgttctcaacaggtcattattaaagactatgaaagaaagcagagagagagggccaagtgcaaagctctgcagcaagttttactgtagtccagtgatacatgaccagaagtgcaattttctgtagacatatagaatcttaggggcttttttgggccatgcatgggccacaggccatcccctcctccttcccttgagtaagaaacagttgttaatggagtgctatacatattaatgataatggaagactgactgctatgggctactacctagtggacacaaatcccttaataaaatgtaaacatttactccagcattacagttctcctttttgcccaagctacatctgtcttgcccacaaggttatcatgagatgctttgtcaaattcttgcagaagacaagataggctgtgtttctgcagtactcaaatctattaggaggccatataatgtggtgaaaagagaaaggactttgaagttacactggggtttgaattcttactcccacttcatagccatcgtgatcctgacaggatattctaatgcctgtaagcaagctccttttctttaaaatgggagtaccttactcataggactttatgtggattattacatagacagccgtcatatgtaaagctactagcacagagcctggcacatgtttgtttaataaatgtttgctgtttgatgttaaatgaataaatgatgcgggatttatgtttttctttcatggcaattcagtcaaaaagggtaatgggattattttcacatgaattattttgagaactcatgctgtctctgaggggtcattatatttaaaattgcttataggttaaatatttttaaaacaaagcaaatccattctagtgttttcactgagatctacatttccggaattcactttcttttttttgttttttaattgtgacatttgccatactttggtgttttagtgtggctctctttttccagagctgctccaaggttactgatagttacggagtaatcctgtacgtaagctctcttaacttatatagagtccccaagctctcgtgtgatttcctcgctgatttgaggctttgataaacttgggaaaaataagaaagacaattggagtgagggagttactactgtttctctggaatttacgaaggcaatactgttgaatctatgcagttaaattcaagaaacgtttattttatacttggtatatgtcaaacattgtattagctggggaatataacgatgagcaaggtactttaactatcagttacttttcttgactttattcttaaaggattgtgccattttggttttaaccacttcctcaatttggtgtgccttctttatatctgtgctcctgggttatgtacccctttttttttcccttattgaaggtgcttattgaagattaatcaagatcaacagtcccctttctttttagagtcccaactatagaattctgcttg

SEQ ID NO: 70472 - DNA, 1677 bp, Homo sapiens
atggcttttttggcctagtctactacttcttaaaagaaaatttattttattttatttttgagacacttggcttttatttattttttaaacacaccttaacctgagcaacacttggcattcaggttgtagcagtggttttacattttgcatcatagtcttggtctaggaatcttggtttctttgtttgcataaagaatattttgagtgttcaaagtattttgtaagtatccttgaaaaccatattactgttaatttaagtgatttattataatatcttcatacagtataataattgaagttcttttaaaatctttttctgcttagtatttaattagtattttatagaagtttgggtgattttacttaagaaatgagtttttgtgaatgtggccacaaatttctatatctgactgccattttctgctttgtgctttgagttactctttaaacatgattctttgactttccttttgaaagtctttatttggactcctaaactaattataatccttgtttttagaaactaagaagaaatgtgaaaatattcaagcacctagcttaggttttgttttgttttgttttgttttgttttgttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggataggttttgttttgtttttttcctgagatggtgtatcgccctttcgcctaagctggagaggaatggcacgatctcagttcactgcaacctctgccccgtggattcaagcaattctcctgcctcagcctcctgagtagctgggattacaggcgcccaccatcacgcctggctaattttatatttttagtagagatggggtttcaccttgttggtcaggctggtcccgaactcctgacctcaggtgatcacccacctcagcctcccaaagtgttgggattacaggcgtgagccaccatgcccggcctagcttagttttttgatagctaatttttattgccttgctagagagggctaattttataaattaacctgcctgaattctgtcatctcttaagtatggaagtggtaatgctttactcatttatttttttattttattttaaaaattaacaaatagttgtacattatttaaatacttaagcctgcaccagtgttagcaactagcaagaatatttattttgcacgcacacacacacacacacacacacacacaatcttactatcttactcatacactccccaacggcaggcccccaattaatgaagtctgttgaatttagttgatactagataaagccaggaaagtatttgttcacaatgtagttactatgttgctttcaacagataccttataattatcaaatactactttaggtggtttgctttgacagaacggtagttagcaagcacagcaaatggtcccgctaacagagaaccaaaaaattgattaaacaagttatgaaaagactttaatttggcagatat

SEQ ID NO: 70473 - DNA, 1015 bp, Homo sapiens
ctgtattttttaaaaaaaatcaggttcacagctgtaaagtaaggataaatatctacttcacagagttgttgaaaattaaatgaaaaagcccaagcacagtgcttggcacatagtatgatttttctccccttcctatagtcctagaaccttttgaattggctattgtttaatgttactctccctccttccgtttgtggactgggagttctttactgagatgttgccaggcatttataaatctcttggaagtacgtgggaattgtttttagtatgtgcgtatgagtggtgttctggggagtgagtaggttcatggatttcttcatattcttaaagaagtttataattacttctcccccctcagtaccatgtaagaattaagaaccactgctccagagtaattattataactacagtggtatctcagtagtctggccaaattaaatgtgcctagtagaggtggttaaaaaagaaaagacaaatttcagccttttgattgtttgctgctatctttttttataaatttttatttttatttcaatagtttttggggtataggtgtttttttgctacatggataagttctttagtggtgatttctgagattttggtgcacctgagcagtgtacaccatattcaatatgtagtcttttatcccataccctcctccaaaccttcctccttgagtacccaaattccattatatcatttcttacacctttgcatcctcatagcttagctctcacttataagtgagaacgtacaatatttggttttccattcttgagctacttcacttagaataatggcctccagctccatccaagttgctgtaaaagacattatttcattcctttttatggctgagtagtattctatggcgtatatataccgcatattctttattcacttgttggttgatggacactcaggttggctccatatctttgcagttgtgaattgtgctgcagtaaacatgtgtgcatgtgtctttttcatatgacaacttcttttcctt

SEQ ID NO: 70474 - DNA, 1205 bp, Homo sapiens
agtgtaagtatttggctttatttctgcgttctctattgttccattggtctacgtgcctatttttatacctgtttgttgctatcttgatgtttcagctttcttcttaaatatattcataattttattttttaaaaaagttttctaaagttttttaaaaagagttctcccttgaagaaaatgtctataaaatattaaaaacttaggatttatatcaaatgagatgatttacgaaacagaatctttccatagagcagggcttaagtttttcattatgaaggaaaaaaatatttactagggatcctttgataatatgctttactagtgcatcatatatatgagttaaaataatttgattaagaaggaaacttaggagcatatctcctactaaattgagttatacctgcattgatttacctgggcatattgtagatgtgcttatctataataacagtatttgattgtcaattatgggcagggtactatgacttccacccacttcttccacaagagtggaagtgttagagagctcagatctcagtctgagaagtatcgtagcatagtagttataattaatatctggagccaaactgcctgggatttcaagtggcactgtgtcacttactgtgtgaccttgggcaagatatttaccctccttatgcctcattttccacatctgtaatacatgggtaacaattatctctgactcacagggtgttattggcacctgagaattaagtgaattaatatttgagaagctcttagaacactgcccatttcattgtaagtgctgtagaaacgttaaataaaaatatgtagtctagttaacagaatacttatacccatgaaaagataatttatagtataagacagtataagctgcagtaaatgcagagttgattccctaaaattcttcaggctagaaaaatttgtgtgcattgcgtgcatgagtataagagaacatgaaatttcaaggaaaaagagccatatttggataggtggaattcagatagagaacagagaataggctcaaattagagtggaattttatggacagaagaattgaagaggatgcaaaaaagccatataagttggagaataagtaaagaaatattggaagctgtcctaagaagatagatgtggacacgttgtggaagtctttggatataaagataaggctttgagacttttaattgtaaatgtgggct

SEQ ID NO: 70475 - DNA, 1002 bp, Homo sapiens
aaaaattagctgggtttggtggcacatgcctataatcttagctacttgggaagctgaggcaggagacttgcttaaactggggaggcagaggttgcagtgagcctagatcgcgccactggactccagcctgggtgacagagtgagactccatctcaaaaaaaaaaaaagatcgagtcatttaggttgaaagggaccagttgtctactactgtgtaacaaaacccccaaaatttttgacttaaaacaataatttattatttctcatgattctgtgggttgaccaggcaggtccactgctctttgtgatgtcactggagtcactcatagagctgcactgaactgggagtttggctggagctggaatatccaagaaggcctagttctccatctggcctctcactatatctggtgtgttatcatccagtactctctctatgtgctctctcattattctgtattctaccttaagctttttatatgacaactggatcccaagagttaaaagtagaagctaccaggccttcttaagacttaagtctgagattggcacagcattacttctgccacattctcttgtcaaagcaggttacaaggccagcccaaattcagagggtggggaatttgactctaccacttaatgggaagattagcaaagaatttgtgaccatctctaactcaacaaaaatgtatgggggtaaagaatagatagagtgcttgtggaggggtatctaatttgaaatgactaacaagcttttttttaaaaaaattgatcagattagtaggttgtgatactatatgcacatggaagagagggatacgtaattggattctgctgtgtttcttttgaggtggtgaagatgtatattttatgccaattgtattggcataaaattttaagtcaaatttttcttatgtgaaatcaataaagtggaagttaaatgctttgaaaactttgtacatatatgtgaatgaaacaaaaaggtggggctatactgagaaaact

SEQ ID NO: 70476 - DNA, 1492 bp, Homo sapiens
aaacgagtgtattgggtctgtttttaccaagctgctgagttggttggtggttgtgagcagcaggacgtgtttcctgagagaaatggagatttacaccatcctgtgcttgtctaggaaggcgtccaaatatttatttcctaggcatttcagtaggagtattggtcatgctggtttacggaggtggtcagtgacacgcctaatttcgttggaaactagaattacgtgcggagatttcgtcgaatagtgcctattcgcgttccgagggcacatcttatgcatagttagggctatcagctttatgatatgccaccgatagtatttcccagtgcaggagtatttcataaacagctggaatcaactgaagtgactcatcgaacactaatggttgtttactcattgcagatagcgtcctctgttccttgagtttcactcatgtctccctgttgctttccctaccccattttgaattatttgacagcgtttgtggtttggtgtttggagtattagactaggcggctgaatgacaaatatgggcttggttttgctgttaatctgaagtatgaccttggaaaattgggcaattgtgacttttgtcttttcgcgttctttatctgtagaatggaggagatgccaatcattatttcttgtattggagttgttagggttatataaatttttttttaaaaaaacataaaattacacacttgtacctactggctcttttaaaggataggtgggcatccttttttggattattcgtgctccttggttgtcttgtcagtttttttctttttatattcagggtggatgctgatatactgcttgacttactgcgtatttgaagattatcctgtttgattttccatctaaactgatccaggctgggacttttcaagaggggatcccttccgtttaaacatctccctctttcaggtttggattgattttgaaagaatccttgaggcaatgaagcagagttgtgaaatgaaaaacatttttcactctttgcagccactacctttcatagtctgacttcttaaagtgagacttatatttagtaattctgcttcataacctcatttattctcattcactgcaaattcacatctattgccatcactccactgaaactagttttccatgccaaaagctgctcctctcccaagtaatactatcatgaccaacaaaacccacttgttcttctctcagtaagttcagatctggtttaatggcatcatctttcacctggttgcatgttaaacatacttggaggcattcattcctataacactctctaatcaataaccatgtcctaccagttttaccttaagaggtttcttaaatttactgcatcttctttactatcagcgcatagttcaggcttttagtctgcttctattcttgatttcttggctgattttactccttttctacagtctctgcccttaatcttctctacaccaccactggagttatttttctaatgcgcaaa

SEQ ID NO: 70477 - DNA, 1077 bp, Homo sapiens
actgcagcctggcaacacagcaagactccgtctcaaaaaaaaaaaaaaaaaaaaaaagttaaggaggcattttctaagcccgtgggttcatttctaagcttgagggtttattttgaaccctcaagcttagaaattccagaggttttaaatgtatttcattacgaaactttcttattttctaaaagtttttttccccccaaagaaaaagcttttgtttttcttaccttttacccttctcatttttaactttgtacttttttcttttttgtgtgaggcacaaagccaatttgggacaaacctttaaaaattgactatcagacttatttaattatatttcttaagagcattttgctttatatttcataagagtttctactgctacatcctttgttattatataccagacaagttaaatgttttggaaatattccttccaagaacatcagactgtctcatgtttgttctagagatccatccaaataaaatttgtccttgatgttaattctatttaaggcatatagagacttactgaactgttctgctcttacaagaagagtagagttgtttgttcagttcttctgctattatatttagtattctcatgttagtgtgttggagatagtttttacatgtatttggtaacatagtaaattcattagaactaattaattttctttacctttgctttgagtagaaagatattttgaattcactcttgatttccgttttcctttgtaaccatttctatttctggctagctatttgcagcagaatgctttgcagtttagttttatgttgacttgatactaggttgttaattcacttattcaacagatagttcatctttgactacttactgtatgctagccactcttctagcactgaggatatggctgtgaacaagataaagttcctgttctcatgaagcttttattctagtggagggcctagaatatttgtcagggctttaaatttaaatatttcttcgtcacagctttaaatgtggaaatgtgtgaggcattttcttttgtatgtaatatatgtctcttctgttaatgagggaaaaatctatgtaaa

SEQ ID NO: 70478 - DNA, 1742 bp, Homo sapiens
agtataattatctccattttacaaatgaagtaactgaggctcagagaaattcaattatttgtcccaggtcattcagttagtaagatggtagtgctgcaatatgaatccagtctgcctgcttgcaaagccatgatcagtttttttgggcaaagcttgtattttacataggaataacatttaaaacatttatatgtggtaggataattattttaaaaatcattttttaaaagaacatataagtagccatatctaatacaggtggaagccataataatataagtgctatactgattccctgggttcaactaatttatgttaggcagtcatggagagcactgtcagtaccttttaaaaaggtgaacaaaaatattttgccccactttcttgtttttaagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgagtaagtatcatattattttctacttattgaaaccagatcattgtattaatcccaaagcaaactatttttacttgaccttgggcatcagtgacctatttgcatatgaggacatgaacagcttagttttttctgggatattgatttctttggaacaatgactgaataatattgtgttattttagtaatttgaatctgagacttaccacctaattactgttacaaagaaaagggtagtttaatattttttatacatttaaatgaatgatgatgcattagtaatttatggcctatgtgtttacctaatttaccctttattatgtattttctattaaatatacagttttacttgtgatgttgcagctttaagtcaggcaagtcctaagtcctttataaaattatttctcagttggaagacagggccttaccactttccaaaaatcttgtctctcatttagttactgtgtgcatctgtacacacacatgcttcctcactgttactctcagcaaatattttttgggtatctgttacatcccaacactggtagttgcttgatatttagtagtgaataaaacaggggtgttcctaggaattagagaattcatagtcttgtgaaggatgtcaacaagtaaaatggcaattaaaactgaaggactaagatgaagaagtgtaagccgctttgggagttcctgggaaggaatgaggggcacttaattcagactgggagtagggatcaaggaagacttcctggaggaagaagcatctaagtagagacctgaaaaatgagtgaccactataaggaacgggaaggagatacttagagggaaggatgttttagatgaagggaagagtacaaacatgatgtaatcacacaacaaattaattcagtattacaggtctgcaaagtatgaggaggggagggtgatacagttaaagatgaggccaaagagctgagtaaagtccaaagcacaaagcatcttttaagtcatgttagcaggttcttccagttatccaggtgagattaaagtggcctgaactgggatagtgacaggaaagatggaagtattggagtctttagaattagattttgtgatggattggatatatggaggtaagaagggagaagttgaggttttgg

SEQ ID NO: 70479 - DNA, 1080 bp, Homo sapiens
agtaagtatcatattattttctacttattgaaaccggatcattgtattaatcccaaagcaaactatttttacttgactactatttttacttgatcaactatcaagttgatcaactactatttttacttgatcaactatcaactatttttacttgattacagaatagaaaatactattctgtattgaagagataaccagtgtaaggaaggggatcaaaatggtcctatgaaaaatatttcattgaaggatgtggtttaacttgaagaagagaaatttcaatgcaacattaaataaaatccaaacttcttcactgtcatcaacaagggcctgccctatcttagctctgtttatctcttaaaactcatctcatgccattgtcttttccattctactcatgcagatttctttcagttcctaaaaccccctaaactctttcttgtcttaaggtcctttatgcatactgttttttctacttggaatattttcctctctttctgatccctgaggtctccatttaatgtcacttcctcagaggggcttatgccctctttccccatctaatgtagttttcctatctctgctcctcactatctaattttcttgtttgcttccttcatggcatctaacagcatacaataatttggtctattcttttgtgttttactctagaatgtatacttctgaaggatagggattgtatctgtcttgtttccatattcttcctagttcctagctacagtttctggtacataataaatgtgcaataaatattagttgaatgaataaatggcatgatgattatcaatttgacaaataatttttgaaaggttattgtgagaaacagattggagatttgctttatgtgactccagaaagaaattagaagacaggttttagctcaggaggtagagtttcctatcctggatgggttcaaggatagtcttgataaccacttaagcagttaataggggtatatgtatcttgaatgtgtgttgttcatgtttcgtgagagtagcaagtgaaagcttgtttccttttctaaatttgtaaacaaatgagaagtatgagaatcagagatgg

SEQ ID NO: 70480 - DNA, 2286 bp, Homo sapiens
gatggcagtgccagcagcactgtgctaggaataaaattttgtttctttattagctacttttcttttctgatgctacatttcaaagtccatcatttaaaaaatgccttgtgagagaatctgtaagtctgcctattaattatgacccctcaaaatattcagaaaagtaaatgttttaaaatgtattttttttccctcctatgtcaaatgactcaacctcagccccttttgaaaggccaaggggcttattagctactattgtatatgcagatcgagtgctgttcctgactgtgtaagaatataagatcctgttttggatttcatatccactctagcattactgttacatcctgttatgttagaattgagaagggataactgttattaaagatcttatctcaaacatttataataaacaggaggtgtatagcagcaaaataacacatttaatttttattttaaacatagaaaatttgtagatttattagaactgactaagtcataaaactcactaaatagaaaaaagactggataatttgtcagatgactagaaattagatgtctgttttggaaacattttgttaaattctgtcattactaagaaatgtgaagagacttgcttctagagtttaataagcaagaactaaaaacatagtattacccaaccattcataataatcttgttaaaatatgttcatatgtgtgtgtttgtaattatggttagcatgattaatgatctttatcaaataactaatatagcttacatttttaacatcttatattgcagtattactaagctgtgaatgaaggtggaaatgatttcaaaataggacatattttctgtatgtaaatattatatactgatgactcctaatgtctgttttggctttctttaatttttatgataataaagccagctatcttgtaatggttttctactataattctagagaagaatttaggttcattccagtttaatccttttggctttacctggaataaaaatacactttatatttgttttatttacgttatatacagtgtatttagtatttgttaattttgtattttatgtttcatgtagttttgaagctcctttaaaatagttactaaatatttgctaatgtattaatggaaaactgttaaaatattttgggttttttttttttttggtaaggaacatttgtgttagtaattgttcatgtagtaattgatacagtgtgttagtattttctacaaatcctcttttttattatagatctccacaggataaaagaacacttcttgtgaattgtcagaataagagtctttcacagtcttttgaaaatcttcttgatgagccagcatatggtttaatacaagtatgttccttaaatctatcctgtattattctgactgcattattttatataccctgtacttctcatcttctcagagagtatgcaaaatgagacaggtacatatatatacatagatatgtgtgtgtgtgtgtgtaatctttttggaactattctctaattttacagaaacaataataagttttcatgttatttgcaagactcagaggcttccttggttcttagttactcataaggaaatttctcagtttattataatactaaaattagacatcagtagatttgtatcataacttttattgattaggccagggatcacagagtaggccagtttgaattcattaatgatcggtttaggcaaaaatctggtttgaatttaagtagattgttttgacgtcatgacaatcttattcccctaagaatatttgagtactgttcttacatttggctaaaaatgtgcacttaataataggcagaagtaaatttaattatcactcagatgactatgtaaagtaatgagatggtttattcatttatttatttattcacttattcatttaacaaatatgtgagtgcttgctgtgtcccagctattcttttcctggttttgaagatgtaaagattaataagatatagagggaactttaggaaagaggatgagagagagaactaaacactgtttaaaatggacaataaaaggataattttacttattgtgaaaagaattatttaataaataactgtttttgctaaatatgaatgagcaaatagtttgggcttcagaagttaccctggcacttaacagtagaaaaaccttttgctgttttccagggtagcactgtcccagaataaattattcttgttggcatgatttactattcatataattagattaaaatgtcaactaatatttaaatatgagtttttaaat

SEQ ID NO: 70481 - DNA, 1080 bp, Homo sapiens
gtactatagaaatagaaacttaattttggtgatatctgcttctttccataatctgttcttaacaactttttgctagtatatctgacaatgagtgcttgtcctgccactaagttcttcatttgttctctatcttatactctttcttgattaatgttggatctctcttctttgattaccttttgataatgaagtttgtttcattgggtgcatagcagagtgaggagcgaacctttcctattacctcttagttctgttccttacttgcatgttttctcataggcatcagagacagctagtcaggatactacttttagggcttttattctcatgtaatacttccttttttaagtaagatgggttttggcctgaattatggcagatctttatatgtgctcagtaagatttaaatttgctacaattctaggcttgtacatagttagaaaactataaatatctaaattttagtgcttaattaaagggtttatcttgcaaatactattttaaaattaccaacatctgttaattgaataaaacactatagaaaatgccgagtgaagctagtgggtcatgaatcaattctgagaaatacaaactttagaagaaaagctaatttttagaatatgattaatggaataattatatattctctctttttaaataatacagcatatcatttggtttgaaggtttcttacagaatttacatgttgaatgttctatacttacataattgaacccaaaatagtaaagagctttcttttaataacaaatatttttagtctgtggggttttctgtttctgaatttataacccagtttgttgtgtgtttagtagaagggaaatacatgtaatgctaactattatagttaaactaaacatgggaaaataaggaacaatcttaaaagtattagaagtcatgtctgaaaaacagtattttaaatttagtttctatatgcctttatttcatttcactggttaaatatgtacttattattgcttaatcttatttttagattgatttgggggaacgccctgttgttcaaaggagagaaccggtatcactggaagaatggactaagaa

SEQ ID NO: 70482 - DNA, 1437 bp, Homo sapiens
acttttacatggcttcagtgcagatagattttggtgaataaaaatgtaaactttggattcgcaaatgaaagactattttccagacttcccaagctaccaataaagaaatttctacatgattttaataaatacacaaaagttaccgaagttgaatgataacgtttaagtaaaaaggcttagtataagttcgtgtcccttcattggttcaagaacctcttaagtctgaaaatttttcaagtcttgaaaattgtaaaacaaggataattgagggttttataagaggaagtaaaaaagaagtttgacatgttcaggtgaaaaagtaaaactaacactttttcttatttttaagtgagggatctgactccttaattttctagtttttcttttaatcaagggctctattactgtcaccattgagaaattgtaataatatcaagagacatgtaggtaagtggtcactttaggtacaaaatattgattgggttaagcccagttgctggcattggttgggtgtagagagtaacaaaaaaagaaagaaggacgtagatatgactatttaaaagaggctcttaattttgtaactcctgttatgtgaatctaaaggtctgattgttaaagcagttgaacccaaagttcttgttttatgtggcttactcatggtagtttggcattgctaaccactctgggcttgcaactttcttgttaatttttgcaacattattctcgcttgatttttttctttacttctctgactggtctttcttaaacctgtctttgagtgtatactcttacatttgatgttcctctggattatctcttcacccctcttctttctcatgatgctcttgcacattatttttaaaaatattacccactcttgatagtgtatctgcactgagacacgtactggaagctatatattgtttgacatctcaatctaaaacaactcatctttcttacttatgactagagttcctcctcttcatttatattcttttcttggtgaacatcagtgtctaccaatttctaaatgcaaaggagaaagatacaattttaagcgaaatggtggtgatatgcacaacttgcagaaggttacataaaacttgggttttcagagatgattttttcttttctttttaggatatgttcaaggaatgagtgatttactttcccctcttttatatgtgatggaaaatgaagtggatgccttttggtgctttgcctcttacatggaccaaatggtaagaacagagattccttccattaaactgatttttaaaattttagttgtataattttatagtataaggttgatttttatatttagccaactatgatggaacttaaaaaaattacctcatgccttttgttactttttctttttagtagcctttcaagggcttagaaatactggtggtatttttaatacaggaaata

SEQ ID NO: 70483 - DNA, 1042 bp, Homo sapiens
tctgccttctataggtaatgtggaccgaactaccatgtacaaatttccatcttcttctctgttgtgctattctggaatcagaaaagcagcaaataatggaaaagcattatggcttcaatgaaatacttaaggtagttattcctttaattcagattttagtgttctggcttttctatttggtggtcctgatatacagaacgtttccttggaacattattaaatctcttgagtaacttaaattgtgtcaataacagtgctaggaatgactatctgagaatgacagttcaaatacatattggccagttatttttacctggctaattaggaagaaaaggaaattcaacaagtgctcttttatgtagtttagtttttcaaaaattaattgtcttttgattataactttgagatatcagacttggaatagctgctggatttaatgttccataagcttattagctagtctttagctttaaaacttgaaataatctaaagaaagatatattgaatttcttacgtatttgtagtatatgaatgtttttattttaaggattttatctgcagtgaaatataactggtaataaattgtttatataatagaatataatagtgtattcagtttcgatatcattttattttgttgatactttttagcatatcaatgaattgtccatgaaaattgatgtggaagatatactctgcaaggcagaagcaatttctctacagatggtaaaatgcaaggtatacagtgtttcaagtaattgcaagatttgtttgtttttggtgggttgagatcaagaaagatttttcttcttggaaataaaatagcaactttagtaagctgagggcaggcacaaagtattggctggctttttgtttgctgttctagatttacagcacttaattgaaaacagttgactatggcagataggaaacagctaataataaggcaaaatggtaaaagtaatgaaaatatttctataacaaagaggctgtagaatttcagcaatgatatattacccagttgagctcatgaatgcagaat

SEQ ID NO: 70484 - DNA, 1188 bp, Homo sapiens
tttcatttggagctgagaaaaatgttgtgagaagggtacatgacatttacactgttaggacaaatgctcagattctggaatcaatgtagtcttaaacagaagtgttactttgtggttatttttcctctgtagtgaaatatggttttgagtttgatttttcatatccaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacct

SEQ ID NO: 70485 - DNA, 1035 bp, Homo sapiens
agagaaaaaagttgtgcagttctaaaatggtcctagagattgacttttttcccccaagaaagttagggaacaaaacgaacttttttcctggttgagcattaactgacaatcacgacagtagaaccgttagagtttagtttttaatattatgtgtgttatctttcatcagttaataatgagtaagcctattcagaaaaagaacataaactgatcaaaaactcagcatctccagcctttcatttcctgctattcaggaaattgcttagaacatcttgatgtcctccttgttcttcctggacagtgactttttgggagtttgttcctgctgcgtaatgtgatacccacttcagattttttttttatcaatacatttagtaagttgaacttctgtcaagttttattacaaaattacttgttaaaacaatttttactaaactgcatttctatctagcatatttttgatatggaagtgatagtatagtatagttccaggagaagtcttaaatcagtccacagagtccagttagcaaatactctgtgccattaagattgctaaaatacacagttcaggtaaatttactagtgttttttaaaggtttatttgttttcacaagatgctctgtccacacccttataacatgtaaaatattgtgtgctgtattatgtggtaaagttgttaaaattcagtttctaacattaacttaaaagtacagacaatctaacatgatgatttgacttacaaactttcaactaaatttatgatggctttaaagcagtgcactgaatagaaaccatactttgagtacccatacagccatttttcacttttactacaatattctataaatcacatgagatatttaacactttattataaaataggctttgtgttagatgattttgcccaaatgtaaactaatgtagtgttctgagcatgtttaagttagggtaggctaaactatgtttggtaggttagatgtattaaaagcatttttgattaatgatgtcttcaatttatgatgtgtttattggaac

SEQ ID NO: 70486 - DNA, 1041 bp, Homo sapiens
gaattcaaacccaggctgtctggctccaaaatcttgggattcggctgaaatggattccagaaatttaaataattcagagatcaaaatatagcttgccttataaactcgatgatttgattgtcagaggaatgatataacagctatttttgttaattttttactgattttactgatggtctttgtagaaaatttgaaaacttaaaaaagtgcacatgttataactcataattttattaacctgaagacatgtgagtattgcaaatgtgttttaatttaggtgcactatagttaattaggcatcagataaaatgactcaggcttatactgtaatattttgttattcaccctatttagacttcaattaatgacagtgttcagtttccttttactactactctgtaatttgtaaatcaatgtttcaaaaaggagtttgattgctttttttcaagacaccatgcttttatgaagaattcattacctatctggaacagtgctatgattgtagagggagcccaggtgttttgtaactagaatttctgccctcaaggagattgtggttttgtcgaggagagaatgcaatatttacagaaatgaatgaattagagactcgcacaatatggaatataatcaagcaccaacattttgtagagtaaatatttagcactatgttgaaagagggatcattgtacaatgctgtaggaataaaatgcacataaagagaagtcttatttttacttcatgccagaccaaaaaatacatgaatttaattggagaagaaaggagagaagaggccattttgagaattgtatagtaggaaagtccatgaataccctaggatctatgtatcatgctgatggagtcaacatttttctataatagaatagttaaattatgggataaattgccctattgaagttcacaaataagaccccagcttaaatgattcatttttgcttaagatacaataaacatatatattttttattgtggtgatgatgattgtgatgatgatgataatttactacttgcaaatactaaagc

SEQ ID NO: 70487 - DNA, 1043 bp, Homo sapiens
ggaaaatgcaaagtctacctaagaggcaaaggcttttttattctaaaaaatatatgtaccattctcacttttgagaacttttaaagtaatatattttaaaagtttagtaggaagatagaaagtagaaaaaaaaagtgaagaaaatgatttacattgagccaagcatagagattaaatgaaaacacagaactacttaagtccaaatttgtgcaattgtggcctccattttgcacctgcactgtgtgggcataatttaaatgaaataacatctggcatgttgtaagtgtagtcatcaacaattgcagaagcatttaagttgtgactgcacttatggggaaaaaagagagaaaacgcaattaagaagacgtgagtctaagataggattaaactcacaatttctacataactcattctttagactccagaggccaaagccccaagctgaagagaatctcacagagtatcagaagttctgaagcaagtagttcaatcatggagtggtggaaagagagtgggctttggaggtgattagaatgggttacacagctcagcctcaccacttcctaggggtagggagttgaaccaattaaacgttttgcatcatatgtctctcagttgtaaaatgagaataataaaaaccacatgagtttacagtgagaattacagtagagtgtgataaagtaggaggcaccatgaatggcagcatcctttctcaactctcgttatttcttatatttctgtccctatattttatataacaatgatatttttatgtatttaaattgactctatgtgtctcaatttgacttataaattcacctacctcataccccagggattggggaatcatttattcattctaaaccatgtatagaaaacctcttatgtgtaaattaataggccagatcctggaattaaaattgtgagcatgaagagacatgctcccttggttcatataatctactgggtgacacagacattaatcaactgtacataaaaagtaaagtgacattacaaatgtgatatgcaccatggatgaggga

SEQ ID NO: 70488 - DNA, 2395 bp, Homo sapiens
ttccattcaaaaaaagaccgaaagataaactatactgtaatttgtttccttgcaccatctagtggatttaaatgacaactgcagcattgctataaacgattcaccagtcaatcatgtaagtcaaattttcaaacacctccggagaactgttcctaaaatgatgtttcgaatcacaccacaacagtgcatataattattaaaattttccacttttcagaggatatcaattaagcgtggctgctgaattcattagcgaatgtttaaatttacaaataaagtaacataaaatagcatcctcgcaattttttaataatcagagataatggaagtcatacactaagttcatcctgttccttttcataaactcaaacgctctcaaagcagcagcgcgttgagaagccccaagagtctgcgcggaaccagtgcgcaggcgctctgaggggcggaagcggagaggcggggctaggcccgacaggggagcggaagaggcccaggaggctgggtgaggcgctgagacggtttggcggtgagtcctgggccaggcgcagctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctgcagcgctcacctccggaattccagtagctgcaaaatgagagtctgaaagtggccaggacaataacatagactggtcctgtggcttcgaggagtaagctaagtagaaaaaagtagaaaaatcagacaaaagttttaattcccccttgaagatcctagcatttaaaaacccaaagtggataatttaggaatcctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcttggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatggaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggta

SEQ ID NO: 70489 - DNA, 1058 bp, Homo sapiens
cctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgttttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtagtattttgttcatattaccccccttttgttttttgtttctggcccctctaccaatagggcagtagcctcctgccctggatgggtataaggtgggcttggtccaacaggtgcccagagggtacatactcctt

SEQ ID NO: 70490 - DNA, 1021 bp, Homo sapiens
ttcttcatgatagtggccttgtggaattacattattatgaaatgtctgccaaatcagaaaaattttattgggtggggtacagttttagtagaaagcatagtttattattctcaaattcgttgaaaacttataatatgcatagggatataggataattatcaataagtataagctgtacacaaccatttaagattacaaataatgtgttgggtttcctcctgaattgcctacattaaagattgtgaaaaacaaaattcccaatatttttaggatacccctttattcgtgaagctggtatgtctaagaaggagagatgaaacataagatttatcttcaataaataagtaaggctgtcatgtagggttttttttaattgctaccaagccgtctttaatgctacaagagacgctggcattatgtaatgccttttgcatacatcaggtcatttttgagaatcaaagagtaactatataaagagttccattatctctgtccttaatgtgggacacaaatagaccaagtaaattgtccagaattacacatatagcaaatggtgaagatatgcttcaacgccaatcctgcaaaatatactttctactataccaaaaaaagtaataggtacatgaaaataatgagaaaaataaaaataaaaaactgagcaagataaataaaagatttaatgtgaaaaatatgtctgccattaagaatatggactattaattttaaaagaatgtatttttaatgtgcaattttttcttctacatgtatatgtcctatgtgtatgaattaacatcttattctaaaaaatagtttatcgaaatatttgtactctttatttcccacaaatgctgtcctaataaatatttacaatttataaagttagtgtctctaaactaaaaagatataaattttataaagggtgaatataaataaaatatattaataatgcatttatatgtttataaaatatcattttgtagtaaatgtatttgagagtatatatatatttttttaaagttct

SEQ ID NO: 70491 - DNA, 1033 bp, Homo sapiens
ccaacagattttgagagtcattccacttcaaattaaaaatttagttgaataaaattaaagtataaattagattaattaaattttctgagtcttcttttgatttatctgaagctatggtctatgacattaaactttcaataacaatgtgtgtgtgtgtatatatgtgtatgtgtgtttctttgggtaaagatataggcttacaaataaataagccgtaattaagctggattctaattgaagacaaaactcttttttttccctggagagattgaaagtggcctgaaactctgtgtggtagtatcagcacagtattcttacaatccacggctgaaggacagaccaatgccctgtaaaggacatggacaagactgcacttcagaatcaagatacaaaatagataagaggttctactcccctgtttctctacctatattgtgagcttgcaaagatggacttctgagatttaattgacagtttcttatagtgggcagcccatgtgttcttagtctctctaaactccatttgaagagagggtgggtatgacatttggaggtgttggtatggaggctggattgcagaatgggcatgttaacaggccagaattctgacacaggatggtattattcctttataaatataaacctacatgtaagaatattttgaacgatgatactgaagagaattctctattttcattttccttttatttttttctgaaaattacaggaggaaatagtggttttaaagttctaatggtcagaaactacatatttaaatgactgatatatgtgaatcaaggttgagaattcagctttcaagagatagtattgaggtcttttattatgaaacttaagtatgtttaccttactggtccaaatcgcttgatatgaacattgtgattagttagtacattaattttaaagcatttgcatttgtcaaatgatagaccccattatgtatatatcttcactttgaacattccagatgttcaaatgttggcagatatataataacaagcatcagtttctagcct

SEQ ID NO: 70492 - DNA, 1013 bp, Homo sapiens
tggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccatttaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacatagga

SEQ ID NO: 70493 - DNA, 2793 bp, Homo sapiens
gattcttttatgctgtgatcctgtactttgaatggtaagaaaaagttgcattctttttcactgcttcctttctctattttgttcacacttttggcattgattagatagttggcttctattagggggacttccacacactctcaaattattgtctttattaccaaaatgttgttaaatataccaaaatcttgttaaaatactattaattagtcattcattgaattaatattcaatgaattaatctaacattaaatgaattaattcattgaatattcaattaatattgaattaatatttggaaaactttaaattttcgttttgatattagaggaagtagattttgacctctagcttagggttagctgattaaacttattgagaagggatacatgtaattttaaattattttaatgtgcaagatggaaaataatgactcagaagttccaaaatatggaaaagaatgtaggtaaaataatttagtctgaagtaggatttaaggaaatagtcttaatatagttgaatccagtaattggttcaattatgccatttatgccatttttatgtatacttgtactaatatataaagtattttatgatttgttttatcttaatctgaagaaatttctaactgctttaggcaagtgtttttatattttatactgtgatcacctttcaattattcaattataagaatactctgaagttaactgccttaaacatatattctttgttaaacatatattctttgttttacttggtaaaatctaaagtattacatgtgttgtgcttttaatttgtctagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggctttttttttttttggtggtggtggttgttcatagaagagtgttctttataaattatattattattgtattttttgaaaaatttatacgagaaagtggtatataagtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatatagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgcta

SEQ ID NO: 70494 - DNA, 1074 bp, Homo sapiens
gattttccatttatagtaatggtatagtttcctttttataaaaggtttataaagtttatgtaaaaagtcaacttaaaaataccaagttaattcagtcagttcaaaaagttttgaataattaaacttggaaagtcactgcaataaagccaaagcaagttaatggtcataattataagacttagctttttaaaataaaactctcaactgtgtctacccttttaattttttttctttcttccccctaactttacagttaaccgacagcgagaccaagtcaaacgtacgtacatcaatcttaaattgtttcattaagagctatgtgaattctgtcagtgcattatgaggaacaatgtctaagaggatattctatgtttgtttcacaggttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagaga

SEQ ID NO: 70495 - DNA, 1104 bp, Homo sapiens
tattcaagggagattgactgcctttatgaaagatggagaagccactcagagcagttgaaggaactacttaattatttaattacattatttaatttggtacccattacctgatttttgcagtattaatcctcttctccatagctcattaaaatccttgtgactaattcatttttctttgcaaatttcaggttagaaaagtagtccttgatactatgaagaatattcatccaatttataacattaaagtgagtggtaattatatataactgtaccagtgattatcatacttcttttagctacagaaacctttcttgaaattaaatgttttatgaaattctaatgcacaaacagataaagcagagctattttgggtaaattaggggtagacttcagcctacttaattctaccccagttttgtaggtacttcttagaagctctctgtggagcacagtgtgaaaactactgaaggggatactgtaatatgttatatagttgtaatcaatgaaagtaagcttcacagaatctgttgtagatcatatcaatccagttttcttagattatgaacccatgtatttaaggatatgatctttcggaaatctgcctttttctattaaaatctggaacatctcatgttgcgttaaaacctttttatgaatttaacactcaaattgtagctcctttgagagagaactgttatatccctgtgtgcacaaagtttgattattcttggaaatgtaaccatggtatatagaactattttatgatgggtttgttgagcaatccacttaaatttgatgaacttaagttataaagtcactgttagattgggggaaagtgattttgagttacattgggatattgggatattgcagacaaaaacaaaactatgtgtctgatccctggtttgcatcctctgatgttccatggtctgaaatttaaatggaatagggaaatgtgaaaatactggttttctgtaatcgtgagaaagtttacttttgtctttttctgtgatatttcagttgctactgaaaacttcctgcttgcagggaacatcagctaattaagagccctccctgcttttataagtggcattttaaatgttt

SEQ ID NO: 70496 - DNA, 1087 bp, Homo sapiens
tccttaattgtgaaactcctgagtatttcttttgtcagtttttttcctgaggttgtagtggggattttaaaaaaaattatccatagcctttgaagtgtttaaattggatagggacttcgtcaggtaaacattgtaagtaactagttgcagtgactcacacctgtaatcccagcactttggcaagctgaggaggggggattgcttgagcccaggagaccagtctggtcaacatggcaaaaccctttcgctacaaaaaaaaaaaaaaaattagccggacatgatggcacatgcctgtagtaccagctacttgtgaggctgaggcaagagaatagatcgcttgagtccaggaggtccaggctgcagtgagctgggatggagccattgcactccagcctgggtgacagagcgaggccctgtctttaaaaaaaaaaaaaaaaaaagaaatgtgtatagtatataagtaatcacttttgtggaattcgtgttctttaaaggacattggagaatcctttatatgaagactagccaattgtctgtgatttgaaccagaaatagcaacgtggatgtgagtataagcagaaagtttacctgtctgaggctgctaacatagggtaatgacgtgtttttcaaactttaccgtgcttaagagtctcctgttgagcatggtaaaacacagattcttgtccctcgtcgaagagattctcattcagtaggtctgtagtggggcccaataattgcatttctgacagacttacagtttgtgctgatactgcaagtctatggatcatacctttgagtataactgaattagagtatagctattgaaattaaggagttcttcaaattcaagatcaagagttttttaaataaatgattcagaagataatttacggcccttaggaggcattttcttgtagtgaaaggagtcccaggctgagtgagctttgtgttcccttaggcaagtcacttaacctttttagaccatcttctataaaatgagaataataatacagattctaccttttatagttacgatgaaaggcgtatggaaataaggcactcaaaatgcttaggaaaatctagaatt

SEQ ID NO: 70497 - DNA, 4621 bp, Homo sapiens
tttggttagtgctatagatctattatgcccttgccttgacttcacagagctaggactttctttagtgcacaagaaaacatttactgggaggcatagaatttctattcaaggtagtattgaatgatggttaggttaagattaggttgcatatagatgttttgaatatgtttattgctcaacggcaattgttagagtaggctttaggtccttttcgtacagtgcattccacacttaagtgtaggtgagtaatatttacagtaatacttgtctgatcatccactttatccacatgattgtactctgttctttaattttataaattggcagtgagcagagtgattcttgcagctactatgtgttttaatttataatcagccccttgataggaaagtaggttttctctttttagacactagtttatacagtgataaatgttactgatgctactctgaaatgtgtgttacattcactcaacacttaacgctgtttttccttttcagtatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtgagcaaaattagtgctgctttctattaaatttaagatagctaaagtaagagttggtgtttttgaatatcaagtttctctccgttaaagtctttaataaataaagcctattgactggataactttgttttttcagtcccactggcattgtgaacagtacacataatttcagtggacgtttttctaaaaaacattgttttttgtttggacttcgtgctttttatagtttcaggtacagtgaaccctaggattctattttaatgggacgatttgtaacagtttttaagcattagaaaataaaggtttttaaaagatctggttgtaggagtgttcgggaactggggagcagtgcagtttgttagatccttccaactactcttactcagtccctgagagtcctagtctattattcctgagaatttgttatattaggattagcaaaaacaaagctgattggtaatataactaacataaattgcttggtaactttatttttttaagattatggtttagcgtgtgtcacattttatggagttaattctacagtgtaaagtttgagcttgattttagcatttcagtgacttgctaataaaataaataatttaccaccattgtcctataccatttcttttgacaacagtgagctactgttataattaaggcagtaattactattgagaaattcactgaagcaggtagaagaagatagattgacttgttgttttcctttaacagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgggttattattctgagttatctacaaacatttttgagatttgtctttacactctgattgtagtttccagcagcccatgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaa

SEQ ID NO: 70498 - DNA, 1752 bp, Homo sapiens
ttaaatatttcatggctgggtgcagtggctcacacctgtaatcccagcactttgggaggccgaggtgggtggatcacttgaggtccggaggtcaataccagcctgtccaacgtggtgaaacactgtctgtactaaaaatacaaaaattaactgggtgtggtggcacacacctataatcccagataattggcaggctggcgcaccagaatcacttgaatctgggaggcaaaggttgcagtgagctgaaattgtgcccctgcactccggcctgggcaacaatgcaagactcagtctcaaaaagaagattgtatttcagagtagaaaaaaaaattatcatttagaatatttataaaaacagatgaagctgtgtttactaaagtactgaaatatgtgaggtaggtatttaactgatttttatgcttcctctccccagagttttgtcttagaatttcactttgaacccaatgaatattttacaaatgaagtgctgacaaagacatacaggatgaggtcagaaccagatgattctgatcccttttcttttgatggaccagaaattatgggttgtacagggtgagtttaattttactaccttaacaaaatgttttttctgtttttgttatacttgatttgtatactcggttattttcagttacatatgtacatagtctgtctctgaacattttggtaatatgttttctgaaaagtgcttatcaagtttcctgtaattctccttggacccatgactgtctcacatatatttttgcagaggaatgcttctttaaattatactatgtgtttgtgctaattgtaaatgtgtttattttaaatatttgcttagaaataaaatttttccctttatactgctatagaaaacatttgaagcaattcacccttctaaaatttgaaatctaaatagaacatttacttctaaaagtttagcagttgaaagattgtcaattgtaatagatttttcttctttgttttgcaaggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaaggtaaataatgttttagcttgagtattaacggttgttttataaaaagcattgcttagcttcttattcattgtaatttcttttctcaattttgcagttcctgagagtggagatctggtaagttgaattgttatatatttattgaattgttaagtatatttgaaattaaagcactgaatttcaaaaatggagagtgggatggttgttacattgagttctgaggcctacaatgcatggggcagactttttggatatgaaaaataattccattcaaaattatatcagtgcttctgctgagaaacactgagataaaaagcttaaggttttcttttcttttgaaacttcacatattgctgtgagggatttaacttttcaaaactgttgtcttccttagtaaaaccagaatatattaagtcacttatactgttacattcctaactacattatggttcaaattcattcctgaatttgttactccaatgtaaatatggtttcatattgtgactaagtatgttcacatatatggcatatggcaaagaacatgaaatgttcctgccatatagactgaactgaggaacaaccttaaagaaagtctatacacacaaggtagggcaggt

SEQ ID NO: 70499 - DNA, 2628 bp, Homo sapiens
ctctgttgcccaggctggagtgcagtctcggcttattgcaacctccacctcctgggttcaagcaattcttctgcctccttctcccagtaactggataacaggcgtgcgccaccatgcctgactaattttttgtacttttagtaaagatggggtttcgccatgttggccaggctggtctccaactcctgaccttaaatgatccacccacctcacttcccaaagtgctgggattacaagcgtgagccactgcgcctggcttacagtttttagtttgtagattcattatattctttttttttttttaacttcatggtaggctgaggattgttgccattttcaagtgaagacatggaggcttctaagtgacttgcccacaatgaataatggcagagctgtgacacacattcagtgctgtgttaagtgttccacctctctagcattgctattttatgttgtttggtaaagagaatataatgttttgattaagaacaccatggggtgaggcaatggaccaaattagtatttctgttgcttttcttgtttattatgcttaagtcttcatttttaattagtttttacattttttttttactaaaatggtttttcctacacatcttggtcaccttagtggttctctttggaggggtgtggtagcagtaattttgatgggattaaggtttgttatgggcaacggcggtgtttacacagatagactagaactttgaaggtaatatctggtgactgtgctttttggtttttatacctttgctactttatcatgaggtctaatctatgtattaaataatgtttgctgtcacttaatcaaggaggaattgaaagaaaaggccaagattgaagatgagaaaaaagatgaagaaaaagaagaccccaaaggaattcctgaattttggttaactgtttttaagaatgttgacttgctcagtgatatggttcaggtaattttattcataaatgtaccagtttactttgaagggtaaacctttgaagtttaaatggctgtgatcactgttctcttcagtgttgatctttctagaatgattgcttacttttgaaatagctaatatctgtagaagagaaattacagctttgattaatgtaatcaaataaattagtttattttaaaaaatgagataatgaaatggtcccattgataatggctcattatcgactggtgttttcttataaccctgtgccttttgtctttacatacttagtatggaagtatgatgggaaagttaatcttatagctgcaattatgcaattcccttaactcttccaggagaaatttgcattttaaaagaataccataaagatgttaaactcattcacaatggttacattctctggcaaaccataactgttgtcacctttgggaaactgcctcaagcatttcttgagtgagcccctaccgtctacattgtagtagtacatgttgccctgtcttgtcattgttggaagttacatggagaaaaagaaatgatcttcacacaattactgcttattacaattctactttagcaaagtggaaaaggaacgaccaggaggaaggggacaagcagctggaaaaggcagcaattacaatcaggaaacattttaaaagtagatatgccttatttagacttgattttggatttttcaacctatataataattcagttgtctatttggacactttttctctaccagtggcagtagaactacagtataaattagctttagtataagccataacctggagagtaagtcttaaggttcataattgctatacaaaactactttgaaatatattatgtctcagtcagctggtgtttgtgtagtaacagaacacagtcctcgaatgccatgttattcatttttattatttttttaatttgaaggaacacgatgaacctattctgaagcacttgaaagatattaaagtgaagttctcagatgctggccagcctatggtaaaagaactttgaaatatttataattttgtaacatgcttacaggtagataaatagaagcttttaaaaagataacattcaagggtaaggttggtgctctttgttatagtgaataaatatttggatgctgctaattgtgaggcagtatttattccttttcctccttctgatcataaattgtgtttgaaacacagacaatccttgttcctggataagtggataaaaataatgccaagggaacatgaataagtactttttctgcattaaaaggcatgagcttgggaattacacaaaactgatgttagaggatgcccactccctaatgaggaaagatcagccaacaagctgtccaccaaaccaccagaattaatgtcaactaagggcaaaactgctaagaatataggctgtagatgcttaaggttgggctttttctgtgtcaagttcacgtttagtctactatttaaaagcctgattcctccagtagttggggagtaagggaggcaacatggtcactttattcaggaatgcctagcctgttgtgtaaacatgttaattatttaatagatgtaaattgaaactaagttctattcagttcaatttgtacctcattattattttaacgtaatttttttgattttaacataatttggggctcatc

SEQ ID NO: 70500 - DNA, 3425 bp, Homo sapiens
tgagccatagcacctggccctaaagctgttattttaaaaatacatgtctcctctttatagtatgttacacttgtatttaataatgtaattactaattcctaattaaatatggagactaaaaaaataatggtgtgtggaatcttgtcctttttcctgatatgtctatgctcccctcctttttcctaataacttgtatgggtgagatatatgtaaaagaaaaatccaagtaatcattgttctcagaattaagatggtctgtccatgacttcagcaatgacaagtccaacacttaacttgggtaaagatttagggttgacaatatgatttacattttgtttatcaatttacccagttacatttctacttttgaaatatagccagtggatcaatgtatttatatctatttgatttttatttactttgaatctaccttttgcttcagataaaaaacctgtcattcactaactccaatgcttcagtttcagtatgacaaaagaagtgtgacttccattttactctgatgctatataactgatttctaacctttcagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataaggtaatgctttctcctactttgtttaatttaacattctagaagacgaattctagaaacataagcagacttggaagaggttaatctttagaactctcattgaaattgttattagaggcagcacttggaggaactatcaataatagcagttaaagttgtggtatgcatttgttaaatttgtaagacttcttagtgagaaaccactggttttagcttggatgccagtgtttttatacagccttttttttttaaatcattttagcgatttgaaattattaatgcaatttatgaacctacggaagaagaatgtgaatggaaaccagatgaagaagatgagatttcggttagtaccaactttattttggtatgtttttaagatgataaaatcttaggacttgtcagaaatgttagcatttaatgatggagtacaatattatataaccagttgtattttttcattttttaattttacgtctttattacacgtttttctattactttatttttaaaaaacagtcattcaagattgtaatttgcatggcaataagcagcggtttcatgggttctaagtttcttaagtgtccacagcagtttaaaacaccacaagtcttatttccaatttgcagcacctgacttaaagttcgaattcatctgatggagcattaaaactgtcattttctcttgtgaaaagacataattgctatttccaggactgtatattgaacatggttgtacattatttttaattggttagtagaattttactcatgtaatttatatccagaataagaacctctagcatctctgaatggccttcctctcagaacgatgatgattaaatgtctaaaatgtatctggggtgcccccacttgacattaccaaacatgtttccaaataatcttagaaaatatgattctttaaacatatgcataccacatctttaaacataaacataccacacagtgcaccatcacttccttaaccattttccaattgttcacttataacatttgcaattttttattataaatcatattgtgatgaatactttcatccataagttttattgcaaggcttattgtttcttctaatgtcttctaatttcaaagaagtggcttactggttcaaacagtgcacatacgtggttttaaggcttttagtatactttaccaaataatctccagaatagctccaacaactcctaccaacagtatgttattgtgcccatagggtggacttgataacagcaaagcaaattcaaccacagatatattagattctcacccatctcaaaactatcacatcagagaagcaaggagacatattattggtgaggaagccaaattcaaattcttttaaaaaatcactcagctttagatcagtaaaataatcaacaaaaatggtcaccgcaaagtctaccgggtttttcaaaaaataaaaagagagaaagagaaaggccaggcgcagtggctcatgcctgtaatcccagcactttgggaggcctaggtgggccaatcactaggtcaggagttcgagaccagcctggccaacatggtgaaatcccatctctactaaaaatacaaaatattagctgggtgtggaggcgggtgcctctaatcccacctactcgggaggctcaggcaggagaatcacttgaactcgggaagtcgaggttgcagtgagccgagatcgcaccactgcgctccagcccaggcgacagtgtgagactccgtctcaaaaaaaaaaaaaaaaagtaccaaataaccaaaattttttatttgactaaattctgttcatgtatgagcatgacagtctctcctgtttatttgactttggcaataaaaaaataagcagccttgtacagaacagggaaaatgccaagaacgaaggcagtctacagttttactgtagaatacatatatatatatatatatatatatatatatgtaggcctctctccctttggccatatctactgtcagttcaggccattaactacagacaaattttcaaattcacttcttctccaagatcttcgatgctgtcatcatctacttctgtctgtttttcctgaatgacctcaattatgtcatctgtaaagtctccttgaatgataatttcatcctcctctgttactgaggcaccacaggagaatttttgagcaaaaaatctttgtgtgatttaagatcaatttcaaaagttacaaggccacaacccttgtcacatatttctttgctctgggaattttggctatagtaaccttttgtggtaccgtctttgtttttttgttttatttgaccccttccacctctcttctgttttttcttctcctcttcttcccctgctgttccttgaccttgacagattccagcttcttgtttgggtgaattttccacagtaagttttgcatattcatttggaaaattcttctctaatcattgtctacatttagcaacatcaggcatatattcacagtactctattggtaatgaacagactccacaataaaggactcaaagtaggtaatcagcatctaacttggctctgttccttgggtctcctttgcagtcagccctattggaatcggaaacgtcagcagccatttcacaaacccaggcagttgcacaggccccgccagctctgctcccgccactgttgccagctgagccgacaaatgcaactcgtttccccggccagggcctccctagagcatcagttgtatttttatacctagga

SEQ ID NO: 70501 - DNA, 3529 bp, Homo sapiens
attgcactccaggcagcctgggtgacagagcaagacactgtctcccaaaaaaaaaaaagctttcagaaattgtatgtatcatttctgaagactgaattatgctggcagagtacagttgatttttttctgtacttgcatgaaaattaagtcattatttgtccctgtggaaaattaatttttcaaatgctgtttagacacaaaagcaactacatttctaatccaaatgttaaaataaaaaatttacacaggaattatacaatgatgttttacattgacttaggaatccttattttcctttctaatgctagatgtaatctcatgttcaataattagatttttggtgattttttttttttaagatgaaatgggaaggatgctatcttattaatttttaaccttctctttgaatggtgctatcatcttggctttgttctaaacaagagctagactcagaagtcttcactttattctttctcacctccactgtgaagtaaagaaaaggaaactccaaagatagtataggctagtattgttgctccacagccataagggatccaggactcttctgttttcctaactcctttttctttagctggtggctttcattctctaggatgcctcctggtccagtgtggctgctggagcttgagccatcacattcatattctaagtgggagggggagagggattaagataaaggcttcccagctatctaccatcctgttaaggatacttcctcaaagaaatacagcatttctgcttttttatcttgctgtcaaaatagtgtagctaaaggtaggctaggaaatgtagacttttagcttggtgtgttgccatctcatataaaatgagaatgttgttactaagaaggaaaagtaaaatcagtagatattcggttgaatgcacgtacttgttgacatcacattccccaaaaacctgcaaaaccaattttataaagcttcaaaagtataaactttacatttgaccagatgcttttaatgaaagtgtaagcacttccagtgtgtacttgtttacatatgaagttagaaaacggaattaccttttgaatttcctatttcatgtctttgaaagagatactaattttgaaaatgaattttaagtttttctgtaactttttttggtaattggtacatttgaaccttggtgtgatactatgatattatagcaaagaacagtctgaacttgatcaagatttggatgatgttgaagaagtagaagaagaggaaactggtgaagaaacaaaactcaaaggtattactttaaattacttcaggagccagtgattgctggcacatgtctactagagggtagttataagtaccagtctatttttttggacccttgctcattgtcccatttatctactggtccatacttctagtgtgtgtgtgtgtgtgtgtgtgtgtgtgtgtgtgtgtgtgtgtaaggggcgggtaggtatagatacagcaactcaattagaagtcattgtttgcatcctgcactgttggagtgacttggtgtacttgtgtcaaacagctgcccatgagttttgtctgaatttagaaatgttacaggttgtgatgtggtgcttataacagtatgtttagtgtttaatatatggagaacatgtagtgtgtgtctttttaaagatccactccttcaagcagaagagccatttattaaatgtaggtaatattcacaatttattttagcagatatttttaaaaggagtggtggtgggggattgtactacttagggtatgtcttgtagatctgcgccaagaatattaaggtaccagatgactcagcttttcatttttaagccggatggaagttaattgtgaaaagacttcagaacttgtattaatagcttcagcttttgtttagtaacattttcttaacagatacagaactgtatcctcagtgaccaatattgatatttaaaaatctgtattggttatcctggctgtgtgtacatcatctagtaattgaattattatcagaagtaaattgacctcaaaaaaagtaattgggaaaattaagtttatggcactttgtgtaataactgtattgatgatgaagagaaggttagtactgtaatttgttttgtataagtctagtgcatatttggattgagtatgtttttaaaaagccattgaaaaccacattttgtttggctttagttacagtctttgactgtcccaactattaactttattaactttattcatacacatagaaatacattacacaagcatcaaacataaacattcagatcactcacttcatctttctcctgggcctaaaactgtcagtatatttgcagttttctgatatgtgttgtctgcattcagaggactgtcaagagtcatagataggcatctgaatgaagctttgagcttcttaaaatgcaaggtgggtgaaacacaggataccaggaagagaaaggatattgttcatatagttgtggcagtggccttgagaactgtcttgactagagatagattaggaatctgaattattcctgaacattgggttttcctttagtgtattctctttagctttccctgcccgtctctactcattagatataccagcaatttatgggccagttaggaaaacttcatgagattggattgtcctattaaaaaagcataatacattttcataaaatccttctttcgatgcccttttttttttaaagcacgtcagctaactgttcagatgatgcaaaatcctcagattcttgcagcccttcaagaaagacttgatggtctggtagaaacaccaacaggatacattgaaaggtacagcttttccatagtccttatttatctttctataatcaacgttgcaggcgtatctatttttaagaccatctaggatttagatatgcaatagtggaaacctattgtctgttagtatccagtataggattattagaagtttaaaattgtgcttagtaccacctgtttgcattggtcttttaaagtttatttattgtggttcaagtttataggaagtgtactgatcttgagcatttcagagatttgtttagaggtatgttagaaatgcacagaattagaagaaatacagatttcttatttcactgatgacataaatcattattaatagcatgaatatcttactcagcttacacatttaaaaaacttttttgtgattttaagatccattcagttactgtctatatgttaattatagttagtagcttctaaatgttgcctagttctctgtggtatgtgttcgctgtgttttattatctgcttttcctatgatggacttatttatcaacacaaattctattgttatagacatctttgtacatgtcctgtaaaggaactgtgtgagaatttctttgagatgtgtgctcagcagtgggattgccacctacatagagtgtggaagcctttaagtattaaacttctagcatgatttccagaaatactgtactcaatgcaagaagatagattcatcttcatgtctgccaacaattggcaccatccag

SEQ ID NO: 70502 - DNA, 3435 bp, Homo sapiens
taaacatgaattacataaaatgaatattgctaaatacgaaatggataaatggatttaagatgctacgtagtctaaaaatttaagcagaaattgacctttcttgattgttgaaagaatttgaatgaagatccttttgtactgttcctttcctatgattctagcaaatgttagttttgtttttaaccaatggtgctattatcatagtctttatacaacagattctaaaagcttagtggtaacttttttgttttaagtaatatcctctgaaaaattatttttggtactagtaaggaagaatttgcatgttccatgagttttttcttcttaacactgatagtattttaaaggaaatagacatttcttgggatagttttcagtatggtattgatttaaagggttttggtttcttatttttttttaataaatcatatactttttttttaacattgatgtttctctccatagatatttggagttcttacaacatggcagacattgacaagtaagtggcagagagttggttctttttcagagatttggcatcactttgtactctgttcttaacagcaagtagtatgaattatatattatgaaaatgtagttactaatgcttagtacctacttttacaaaagtctagtgcagtgtattcaaggtaaaatatagaatatatgatcattagcatatttatgatcatatattcgaaaccatcgtatatactaaaccatttgtcactatttttaagaaaatgctgagcatgataatggattataaatacttgcagaattcatttttattgtatatatttcccaaagatttactgcttgcattgtaatgtaccaaacacccaaaatgtgtataaaatgtatttatatatagagcttaaggaatattcagacaagttaaaaatagaacattactatcagaagccttgtgtgccccttctcaattgcacctttcccttgcagacatgtaagtgctatcctggcttttgctaattcttttctttgctttccttcagagctttaccacctataaataatcagtgtttaattttgaaaatctgaatagtgatcacaaagttagctatgtaaagcaacattgccactttgccactgttaattgaaggctataagataggataacaaggaagaaagactatctgggtcatagtctggcctcaagttttgtgaggctttataaaagacttattgtggagaagtattgggcaaggtcatgtgtcctgggaagtataggtttaatcaagttggcatgtggcaggattctaatgtggatggatgttttatagaaacagggtcaggaagaatgggatgaggtacacagtgtttgttgcgtgtaattttacagtagcccgtgttaaaatagagcacttgggagtgaggggatgctaaattattttccatagctgttgtaggcatcagcgaatgatagtgggagggctggaaacttcagtacaagatcaacacatagaagtacaaataagaatttgggccactcttacgcattttatcttcagcattaaaaaaaaacagatgagtgacttatgcattctgtcttcagcattaaaaaaaacgagaagagtggaaacggcatttttaataataatggttcccaaagtgattgtctcctgtgtcacacctctaatttggattgcttaaccttggtgacatggctgtcattggatctattttactatcttcctgaggtttcaccttgtttctcctcttgggtttgttgtttgccatatctcacattgctttctcggtttgttagtaccttcttggaagagtacaagggagctaaattattttaagacatgtcatgactgaaaacgactattctacctttatgccggatagtttgggtgtaggatagtaagatgggatcatttttcttcagaattttgaaggcattgctccattgtcaccttgcttccagtgttgctgtgttgaagttcagagtcattgtaactaaccatttgtgtgtgataattaagaaatatgtacatttacactatatatacatttctggaagctactctggcttcagagttctgaaattttcacattattatttttttctcttaatgttacatattcagtggtggaccctttcagtgcagcaattcagtggcttttagttcagggatattcttgattgaactttgtgattgtctcatttgttttctctttctggagctactattagatgttgtgtgttggattgctctcatgaccttttgtcctattttccatctctgtctctttgctcttctttctggacagaactgaagactttcagcttgtgttgagttttaaaatttctgttgttttagtttccaagacctgcttcgttcttcctgtttttttgtttttttttttttttaaatagcatcctcttcttgtttcattgatgataatgtcttttctctggatgtttcttccatctttatagtccatttgctcttacattttctttctctcatttgttttggtctcaatctaggatgctttcctcaaatataaatcaatacttggttggctgctcattaagattggattgggtggggtgtagggacacttcagacatgtttaaaaaagaaaattgattggaaaatttgagcgttggagtggggaggcttgttaatttgggatttcagtgtagggtcaccagagtgggcatttgttagaaaccccagtgttagaatggtcatttttttttttttctgggctagtcagattcatcgttgaacagtgtctgggtaaagatctggcttctggtgttcctttaaatgtagaggaggctctacatttagcattctaatgtgtacatagtcctatatctttgatactgttgactgtgtctgttgtcttccagtccaagttctgaattttaccctttcctgagaggaaactgaatatttctgctagtgtagagaagatctaatgatttaactgcttatcagtttttactttcttgttttagcgaccttctctcctgtcccaccccttgccctagttctagaaatgtacctggtgctaccagttcttatccttttgaagactgattgggctgcttctcagctttccccactgctaatcttagatttcagttctctcaatgaaattatcacttgtctggtttccagcttccaaaatgttgctgcccttgttttctttgatttcagtgttagcctgctaacaaaacaaaacaaaaaaaccctttatcataattttagtggagattttagaaggattaagatcagatgagtttgtggcatctgccatcttaactttgcaactctcattttaaactttaaaaagagtaaattggttgtgacagcttgatttcccccttccttattatttaattttggatgcctgttagccctgggagggtggaagtcagaggggagt

SEQ ID NO: 70503 - DNA, 1052 bp, Homo sapiens
ggcctcaccttcattcttaaaagatgttttggttggggatagtattttaagagccttagttattttcaacatattgaggattctgttgtcttttagtgtcttattgaagagaagacagctgtcagtctttttgtgcctttgaagttaatctaccttttttgtgtgtgcttttgagatgaatttgtttttgctatcttgcctttttactgatgtatccggagctggataaatatatgtgtgtgtgtgtgtgtgtatatatatatatggattctttattttatggttttgatttgtagggctacttgaatctgtggattggtgtctttcatcacttaaggaaatggaaaattattgcgtattaacttcttcaaatattctgtcctcctgctcccagaacttgtatgaagtctttattaggcttcattggatcttaacatgtcttttcatttcagtattttcagtcctttagattctgtggctctgccatattttcaaagttttcttctaggcttcatttcagctcacttaattctctcttcagctgtgtatcttactcttaagccagcccatttagtttgattcattagttttatttctagaagttctagttttccaaattttgttatatcacctttaatagatgacttccttgcagacagtgtgttttcaaacttagatcaaagacaaccaggcttactatgtctgtaggtatgtatttgtttatagtctgacaatttttaagtctttgtgtaggattgatttctgttatattttctgtttttcctgttggctgtgaaaattacttgtatgaattttttaaggtctagaaggaagctttcatttaattttgatatacaggtgtctgaatataccagggacagatcattttaagtacatagcttggggtttggagggcaatacagatgaggtaaatttgggctgtttgtccaggagaatgaatttattcttgaggatatagcattttggggttcctgcttaatttgggagggttaccataaagatagccaccgtggacaggcccagaattttaa

SEQ ID NO: 70504 - DNA, 1098 bp, Homo sapiens
ttagtaaatagaaatttaaaagttttcactataccaatttgaatatctttctaaattttatctgctacaaagtgcctatttttatattaggcccattgatttgcagaattataaagctaatactgaatatggtaaattactgcacttggcctttaatgagatttttgaaacgaatacctgtaccataactaatgtaatccaaaatgccatctcattttattcagcttgctcctgttggctcctggtaaaactgagttgattctaaattctcaaaatatattcaaaactaagggtctttttgtagaaggggctaaagaagcagtatctgttggacttcaaaggtctgaagatgtcaaaatacaatattttattcacttcttggttgtaaatttgaaacaaaggattagagagaatgactcatcaatatcaaaatattaatgatcagtgtattcagatcttcaagtttaatcaaacctgtaattgtgttctcagtttagtctttgggtaactatctagcacctgtatggacatgtatcttatgtcatgagcaaaagaggcaaattggttgcttagatgtagaatgttaaattgtgatgagagctataaaggaaggaaagggtaaaggggtcaaagagtaatacagcgtttacacaaaggaacctgttataatttgatgattttaagttccatttcaaactagtttcatctaaataagtttttgggcagaataggggttagaaggagagagttgttactttacacctatccatatgtaagtcgtttagcacaatgactacagaacattagagtacattagtgggcttgccatagaaaatggcttctatacctttggttaccaactctgccttttacttcctgcatatttgtatatatttttacttattcagaagttttgtacattttaatttttattgggaaacagggttatatatattttttccttgtggagacaggctcttgctgtgttgccctggctggtcttaaatgcctcacctcaagcgattttgccttggcctcccaaagtgctgagtgtatgggtgtgagccaccacacctgtctagagttataatttcagtc

SEQ ID NO: 70505 - DNA, 1028 bp, Homo sapiens
gaaaagaacggcggaggctgcgaattccgacgggagggaggggctgtggagggacgagtccccgaggcggggagggggcgggggaggctgcgacgctcccgggctctccgcccattgggggcggccgcgcggggaggggaaacccccggcggcttcgctccacacgtggtaatgggcttcatggccactggctgggcctggttggagacccttgccctcggtctgtgcttactttgaaagttgtagagacggtggaatgtgaaaaggaagggtaagcgagtaagccctgtccctgggtttcaaactcttccctgcttctctttggtcttaatctttttattggtaccagagattgtggatgttagctgatgataaggaagggcctccactgctagtattttaaaaagttaacgcgtatatagcgcttatattaactgttattagcaaaaggttgttattgtgtttcccaggtactgttagatgggtgtcttgatcagggttttttatttggggagtattgatcctgatcgatctaaacccctaaaccaagcttgtccaacccgcggcccaggacggctttaaatgtggcccaacacaaattcatgaggttttttttttttttttttttttggaaaaaaaagctcatcagctagttaatgtattttacgtgtggcccaagacagttctagtgtggcccagggaagccaaaagatcggaccacccctgcaaacggttcttagatgaaaataaaatgtttggccctttatgactttaattgttcttggctgtcttataaattagttcctttattgaagtcactagaataagatacttaacggtttcctttttaagatgggaggtgggatggaatgaggtgttagtataaactttgccaagtttgtagcctgcaaccttgtcaatgaaccctactgccctaaagatctgggggatggcagtgtaggggggctgggactgaggtcccatctgggaaggctagactttgagagtgcaaaaaggatgaaccaggc

SEQ ID NO: 70506 - DNA, 1059 bp, Homo sapiens
tatcatgtccaagcagcaggtgggggccccataagagaggtgctggtttaaaagtctttccctcatgattttcagattttcctaattggggctacaagttcatattcagatgttgtgtttcttctgattttggaatctgtaaaccttccccctctccctacggaagccctagtttttgcaacagctctccatctgcacatgcatctcattgtggggtgcaaagggctggtggcgagattttccagtgtgcctggctaacctgtcataactaaaatttatggagcaaaatagaaatgtaggtggttgctgtgttgtcacaatgaccgtgaattgagtttggggactgtatgaaaatagaggaatattcttggtttgatggaaatgtatagtgtattttccggcaatttctcaaattcagttattcaaatctcacatctatttaagccggtctatggatcctgtgtaggggatcaaattacacagattgaattcttgacaaaatttctggaaacaggaccctttcaggtttatcaaattctacgtgggtctgtgtctttcattgtccttgactattttgcaaatctgtagaaattgaagttaagtggtggaaggttggtggtgatgtacatgattcctgttcttagaaataagaatgacttttgtccaatgaaggtgtattgatttccactctatggaagaggctagttttgcatctataggcaaaattaattcaatatttctgattgcctatatatgtgttttgtccttgaattctcctttcaaccaatttttacttcttactggtttccttattaaataataagtgaaatagactgggcgcggtggctcacgcctgtaatcccagcactttgggaggccgaggcaggcagatcacgaggtcaggagatcgagaccatcctggctaacatggtgaaaccccgtctctactaaaaatagaaaaaattagctgggcgtggtggtgggcacctgtagtcccagctacttgggaggctgaggcaagagaatggcgtgaacccgggagggagaacttgctgtgag

SEQ ID NO: 70507 - DNA, 1058 bp, Homo sapiens
gataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagcaaacggtgatcaagtgacttttaatacaatatgatgactaaattattgctaatttgttttaatccccccttttgtggggatagggatagctgcaaaggatggcaaagggcttgaaagggattcaacagtgagaatccctgaagtatgctttgcttggtgccttatattcattcttctcgaatc

SEQ ID NO: 70508 - DNA, 1018 bp, Homo sapiens
taaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatt

SEQ ID NO: 70509 - DNA, 1350 bp, Homo sapiens
tgggttgcatgtggaggtgggattgtttctgagaaagtcagttaacaaaggcctctatagtcccctctgtgcatggctgttatttcattggaatgcatcagttgaaatattgaaatacatccataacattgggtaaatatttactccctgagcccttaagtattcctctttgcagtcccagaccccgcccccccccacccctacataccaccccatgacccagcaactaaaaattattaacattaaatgctctgtgactgtttaatatcaaattgtgggctctatgccaacatttctggcaaatcattacaaaatttgttgttgcttatttttatagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttat

SEQ ID NO: 70510 - DNA, 1049 bp, Homo sapiens
gattctgattataaaaattctctgataattcatggatccaaacttcagaagcactgcattacattaatggatctttatgaagccagtgaatcttaaacagtgtaagacgcatctaggaagcttgctaaaagcgtagattcctgagctttaccttcattacatcctatcatcttgagccagcaacacttcaacacttactatcatgagtttaagagtctatgtagtaagtttctcttgccaagtaaaaaaaattagtctccacttatgaacaggtctctctctactcaagggactggatttatatcttgactcatttctaagcctatgagcataagtgttgtcaaagccagaaattcatgtgagcattattttctctacaagggatttgaggcctattctatatagattttattttctgttacatttttaatacttttaatattttcgcacatgtattagactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagagtaagtaacttaaaatagtttatttcaaacaatgtattagcatggtttgttgcctttatttctagaatatttgttgctggagtagtttttatttaattaaaccatgtatattagtgtgagatttttaaacttggttttgcattcattataagcttgactctatgatagaagttagcctataaaataagttgaggatctgaagattaggtatggggaaatctcattattagaactatgtatataattattaataaaattggatcatagaatagaaagttttaaagttctttgtttagtcattgagcaaatggtttttttttttttcatttatgtagtacccgaccatgggacccacttaatgatatgatacagtttgaaaaagatggtgttattcagaccaaagt

SEQ ID NO: 70511 - DNA, 1038 bp, Homo sapiens
ggagctgaaccaagagtgtttgccttgctcagcctcagctcagaatgtgtgcattgggtgactcaaatttttcgctactctgcacatgtctccaaatgactacagaagtactgtgggtattgatattttactgagtaggtgaatttacagatagggaatctgcacataatgtgaatcaggtgttatctatttatatcctacagaaccaactgtatgtctatattatagtttttcatttgagtgggacagagtgattttgaattatgtttctcctaaaagattagattactaaactgtttatcgtgagccatatactatactatactcttttcaattttttgtcaaatctttttcctttaggaattctttatggtacaatgacactggagcttggtggaacagtcaatattacatgtcaaaaaactggatacagtgcaatacttgaatttaaactaaaggttagtagacaatacagtaggtatcacctagctaaaggagagccatacaataaatattgaataaagggcaccatgtatttcctaattaaggactaaatgtaagaacacaatttatgtcatgtcaaggataagtgcatctaaggaataagggcaaggctgggtgagtatcttcgggtagcctaagatagcagccttggaaaattcaaattaacacaaaagacattttttgtttttcatcttaattaataaaactgtgggtattatatagaagatgagatttaagaagtgattggatagaaatttcttagtaaattaaaggattgtttttaccaaataccagaagatatgtgtcatcttgcagtctagctgtgtaaaccaaggcacagttgtattagtcactatttctgtgtaataagttactctaaaactcacagacttaataactatgtgctgttcctcatgagttctgtgagtcaaaaatttggacagggtatactggggatagcttatctctgcttcataatgtctggggtctcagaaagactttgtaggccatgggtgactcaatagttagggactg

SEQ ID NO: 70512 - DNA, 1073 bp, Homo sapiens
gtacaggaatctgagagctgcttagttgggtggttcctgctcaggatttctaatgagcttgcagtcaaactgtcagccagctttgcagtcatctacaggcttgactgggctggaagattcacgtccaggttcatcacctggctgttgacagaagagctcagttcctcaccacgtagccctctctgtagggtttttcacaatctcaaagctggcttttcagaactaatgattgagagataggcagagagacagcccccagcatggaaggtgctttgtaacctaatctcagaaattacatagtgtcacttccacacaaaccaacttcagtacaatataagaggggcctatgtgactaccaggagggtgggtctcattaggagacaggaggctggttactataaccatcaatatttaatttttactacttattaaatgttttttcttactcattataagacttgaacttttgataatggcacaataatatgcttatctttttatattttatataaacatgtttttatattttatatatgcatgtttttcttatgtttaataggtgtcccatcatccaccaatatctgccttttatgttagtaatcgaaaagatggattttgccttagcggtagtatcctggctaagtctaagttttatggtgagttttcccgtcccaacttgcaccctctcctgggaggtattattttctggtgagcttttatttaggcagtgtcatgggctattttcaacaaggagtttgtcattttaagtatcatctttccttgaataatggcttttttctgcccactcataaataaaggtgtggcttatgtattcatcacatatatgtgaatatatcacaaacatttcttatgaaaagacagaatgattgcccattatagccctttagtgcataaagtgtttcttttgcctttagtctggccagttttttgtgtttcatttcagtgtatctaagggattagtctttctattttagtctttgaacagagaggaagaatccaagtatggttacgatacctggcccagggtcagtcagtaaatatatttaactttg

SEQ ID NO: 70513 - DNA, 1524 bp, Homo sapiens
gcattttcctgacttaaaaagtttcatacatacaagtagaatggttgttaatcttgaggatagacctcctattaacaaaaacagttacttcagatagtttgtttgtagtagaatcataaatcctcaagtgtattttatgtaccttgcttgataccttcaaattatactgcatgttaatgttctaagatttgaaaaataaagtatgtttattttagattgggtatagtttctaatgcatgctgtatactattcatttatcagtggtgtgcttagtatgtgaaaagcatttgaaaaacggaaagatttcattaaattctagcaagatgttatgttcagattaacttttccagtgcatgtttctcaaagaaatagtggtaacagggtaagttaagatgcatgctagtttcatagttttaaaaattatagtgcttatgaatctgtgttcttttaggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagtaagtagatactgccgctgagttggtaatgtttcagagaccatactgttcacaaaattagttggcaggcctagaattttagtagtgtatctaggactgaaatttgcatatcttcccattatatggcctaggaaccggcttaaaatttgtttagctgctataatcaggtgtagaaatgtatttccttgattccagccaacgtgatttactttatctttcccaaatatagccatgctaattattcaccttgtctgtgcatgatgtcccttctattaagaatgatttctgcctactcctccttacgcttttctcctgtctatatattcttcaagatcagtctcaaatattacatcatgtgtgaaaccttataactatgagacataatctgtctttctatagagtaacatgtttttagtaatggcactggacttaactctacctggtatttgtgaaattcatttatatttctgtttggaatggaactgtatcctatttgtggttttattccctgaagcatttattgtagttaacactaaaaaagcatttctccaaggaaactgggcagtagtgcaaagactttcttgagattcaggtctttttgttgctttgcaggaaaaacattagacttttctatttcctccctgtccccaccccttggcttctgctctgtaaccactttcatcagcattgaggttgctcttctcaaagttagactgctattctcctcttcttcatattgcctgatttagacatttcttccctatcattttgcttgtttcttttttttttctgtctgtattactttaaaaaattttttagagccagggactcactctgttgcccaggctgcagtgcagtggcacaatcatagctcactgtaacctggaactcctgggctcaa

SEQ ID NO: 70514 - DNA, 1077 bp, Homo sapiens
tgccagcagtgttttcagcactgttgatgtggtgaaggggaaaaattgttttaagcagaatcatcatatgcacacaaataagattacagccatgatcagtgttagaaaaagaagaatatcagtactaagaaagcatattttaatggcccctgacctggtcagggagattaggaaaattatcctacttagtacactactttgaaactgttggcctgtctcccactaaaatttaagtttcttagaaataagagccatgtcattttcatgtctgtttgctgtgcttgccatgtagtagcttttaaataaaatatttaaagtgtacgtgttatggaaattttagattaaaacatcttatttgcagtattttcgtttggaccttggagaacagatcttcctttttaaaataaatttatctttctgtagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaaggtatgtaagcccttgttacataggtgaaaggtaaagatgataatccatgaatagaactgagatacatcaatcaaatgagtttagtcctctgccaggacttataaatctgttctgctttccattgcattattcccccattctgcctctacccacaacaaaatgtgcaccaaaaagctttacctttgaggtctaactttttatattgcatctttttatctcttttgcccttggggattcaatttgtactgtttttttcagtttctaattactaactcggctttgtaacattgtattatatttattgttgttggttttttttttcccacccacctgcccccaccccccctccccaccccctgtgatttttctctttgtcaaaatggtaagtaggattccctggaacagaaactgccatttatttttatggtctttcctgtagtgatgtaaagc

SEQ ID NO: 70515 - DNA, 1035 bp, Homo sapiens
tacgaattagatagagtggcttaatactagtttctaaaggtgtttgtatttcttcctattgaaggaggagtagaagcagggcaatatgtgcatcagcttgttagaatttgtgtctttgtttgtttttagaatatttcaactattaaaagataacattgctttggctacttttgtgctaagaataactaaataattatatatgttcttagaaatactcttaaaaaatagaatgtaaaatctacagatgatcttatttaacttcacattgtaggtttgtatactgattagttttaacttttttatatttatggatttaacatggattcatttttaaagacatatagggaaaattctattgaaaattgacatttgcttaaatcatagcaataaatgagaaaaatgtcacataattttaacattaatttttatgcgacgtgtagaaaatctgaaggatttaatttctcttgtttctgtatgatttcagtctgaatctaaactttataatggctcagagaaggacagttcaacttcaagcaaactcacaaaaaaagaatctcttaaggttagtttccagttgtttctgaaaggtaatttacattgtgctttgcatgtgtgtttggaagtagactaataggataaatatatatgtgtgttcctaaagaaagaaaaaacatccagtggtacagacaggcaggcacacatagaaaatgttaatatttgtatggtacactgtggtcaactgataagattgattgatgactgtcacagagcagactgctttaggcctcaaatggcaactgcagaggctgaggatgtgttatctctgtacagctgtatccaaactaggtatattatcactatgttgtggaactcctaatgggaactctggcacccattgaaattagagattgctaactcctgggtcatggcctgaacttgacctgcataatgttttaaaattttgacccaacagttaattaaaagtccagatttccaatttctctgagaaatatgtagcactgggcttaccttcct

SEQ ID NO: 70516 - DNA, 1092 bp, Homo sapiens
gttggaggctgcagtgagctgtgatcacaccactgcactccagactgggtgacagagtgagacccatctcaaaaaataaggcagttcctctttctcatgcaccttttcctaggctttttcattgtatgaatgagtgaattggaaaagtcggttaatcagattatcccaaacaaagtagcattttaaaatgaatttttaattatccatctcaaccaaaggaattacaacataactaatgtgtctagtgggataaaaggaattctgttaaaaggataaggagtttttgagctcacatctctttaagttgatttttcaaccgtttaactatttgccttgtaggtttgctaaatcatcttttacttgctttaaaatatacatttacctggatagttaacaaacctttctaaaccaaaatgtctgatgtgatcacagtaacttatcattatccttgttgttccttgtatctgtagcattttgtaattttcaaagcaaattgcaaagtattttcataaataaatgccccattatttaaatctctaaaggtcagatttttgatagcacctgcaatctgaaatatagtcataaacctgaaacaatatattaccaagtactaagttaaacactttaagtatcatttaaccctcaaagcaaccctataaattagtagtagtatcttcattttacagatgaagaaactaagactgacaggttaaattaacttctcaaagtcacagagcctgtaaggggatagcagttaaaggggaaaataaagaagaaaaagagaaggaaagaagtaaaaaatatataacatgctaaacattctaatgccatttaacaaagagggaagcagtagtatacattaaacctgcctatcttgatggtcatcattaagagagtggtcaataaagtttatgaaggcagggaaacttagtttagtaaactatccccaacaaaaaaatcgtttacatttttggcatttgaaaggtgttttgattcagaaaaccgaggtagtaatttagaaaagactgtggaacttggtcattcctttttgtattacagaactagactgcacgttatggcagagattccttg

SEQ ID NO: 70517 - DNA, 1059 bp, Homo sapiens
tagtgatgtcatgatgcaatgtgtttgttttatttagttcatatctgattatctatctcttgatctcagctgttacttttaggtatgcttgttttactaatctctagaacagtacgtacaaattggagtaaataaactttgaacaaagaaagcatctatagacatctatagattgtacattttagtacatagttgttttgtatattttgacttctcagatttttttcttggctcttggctgtattcaatatagttaatgtagcaattctgtatttattttgtagatacttataaaatctttatttgtagatttgtttatgtaatttcattttaataagactgacgcaacataaaatttgctttattatatcacagtattaatgaaccaggtatatcaaaaagataacgccttatcagtgatgatagtacttgcattttgtggacaaattagaggttaagggcagaatgctaatttattcagcgataatattccattgcattagcaggaaaaagtaaacctatgtacttacactagagattgtctaatgtaaaatttactgtagatgggaaactgaagtctctggaatttaaggaacttaccatggttatataattacttgatggaagagttattatattcactggaattattatgagtctgtgactacttccaaaaccaaaagattagaagaaagatatgacagacttttttcaaccaggtttgaatgtcattagtttttgttttggggttgagctttaggaaattcttttttatttgctttgatggctaaaaacatttctgaaactcattactatgtttttttctttttatatgaagagaatattatagcactgtcttgcttcagtcttaagtactttatcactttcaagcctttccccattggagaaactgaaccattggaagttaagtattgtgcccaatgtcatacagctagtaaatggtggcgccagggttgatagatagtctgaccccatagcttattcgcaggtatccctctgcctttattataagcagttattttactgtattataatttt

SEQ ID NO: 70518 - DNA, 1047 bp, Homo sapiens
tggatacctggcaggaatatgaccaggagaggtatattctgcttttttagttcaccatgttcaaccaggattaggtaaaaagtagaatgcttcattgttttggaagtattctcagctgatccaaacatcagcttgaaggaacagagaagaagttttatcagcatacagtcagacagacaagccagtgtcaacaaagaacttgggcaaagctcacccaagcagtttgcccatgtgtcaaaaaagatggtgcagtggcagggggactttttggtaatgacacctcttttatattggatgtcctgtttctgtaccccatgcattcttgatttatcacattttggtacagttttatcttccagtacagcctttcttaactggagtctcatgacagaagtaagtcctataggaatattttctctgtttctcaaagatatagtgcattgttggaaatattatagatgcatgggagataaatttaattcatcttgaacagtggatgccttagtacattaggcttaattctattgcagaaccccagctgagaagggctactgtagtaaattattttaaatggtacatagaaaataaaattttgagaccttgcatgtctaaagatatctttattttactctaatatgtaattgatagtttggctgggtatggaattctaaattgaaacttgttttctttcatattttgaagattttggttattttttggcctgcttccagtattgttgttgacgtaaatagcctatctgattcatgatccagaggaacttggtgctgtgaattatgtgcaaaagggttatttggtgtaaataaggttgactttcagtttttattactgctgttgtgatttggctttcttggatctgcaagaccatgactacttgttcatctcgagctttgcagtgtcaaatttatgttgttaatatatcctctcctggatatgtacttttgggatatatatagatatttgtttatttttttaaaataccccttttcttgattttacttgagttttaggagggaacgcatttgttca

SEQ ID NO: 70519 - DNA, 1045 bp, Homo sapiens
gcaattgagagcataaatttaggcttccatatctttggtagtcaaggttcttagtatgtctgattttactgtactcttccagtttcatcttgtgtttctcatcatcgtggacccagctagatagctttcttcactgtttcccagtgagactgtacttttatttgtgctggtcttctatagtggaatatgcttctcctttctacttgcttatccaaatacttctcattctagaaggtgtagtttaaatctgttctcttttgtaaggctttcttaggtgatactgttatctcagttttcaaaattcttatatcactgctttggggatttcacaatatgctgctttatattgttattataataggtatgtttgatttcttcaagcagtgttgtaaagagagttaaatgccttaaattacattcataataaatgaatgattgcttaccatcaatttaagaatttcatctattctcattcatgtttctggctgaatctctgttatgtatattgactcataccaacttaatgtagctcatcattctttaaaagctgttctaaagttttttgcactctggttttgttctattgttttaggattttttttaagagctggggagactgactctccttaccccacacacatcaaaatacatttttgtttgttatatgtttagattttggtgaattagattattcaagaaattatgtattttccagattgtgttccttattcaaaggcttagtatcagtttactttaaaataattttaccttaagtaaaattatagtctcttaaagaggatggtatttgttttgatttatttgagccgaacatatttcaattgtttattaagaaagacagatatgtaagggccgggtgcagtgtctcatgcctataatagcagaactttgggaggccaaggggggcagataacctggggtcaggaatttgagaccagcctggccaacatggtgaaaccatctctactaaaaatattaaaattagccaggcatgatggtgcatgcccatagtcccagctactgggga

SEQ ID NO: 70520 - DNA, 1007 bp, Homo sapiens
cttttgtagaagaaacatactaaatctctttgtagtgttacgtgctttcatggcatgcagaactaatctttaatagtgcatgggtgttatatagttttaaaccaccttaaatttaaggaatgcataacttggctgtctcttaaatttctatgtaatttttacctttactaacatatcttgaattgtaattgaaagtaatttttgacttaattttcaaaacaaaatacttaggtgatccatttttctcttaccaccttcattttctaaagataaaacaaatatttgatactgcttaatccaatatctttttttgtgtgtggaaaaggaagtttcttgtaaattattacggttattactattgatgtgcatgtgctttctacttataaactaatgctattttccttgtccttttgtttcactgctgtttccgtcctgatgcattttgcttcttcctgatttggactgtatttgtttgctgctcaattaccctgccttaaaagcttcttggtgatagcaaagatgtccttgggccatcaagtaagtagctgaagcttgaacggcatgtttggggacatgataatattttgatgtgtgattattatgaaaggcaaatggtgtttcaattttgaattattaagtgttctacttttctttccaggaattgaaatataaagtaaagaatataaatggtcatttagtacccagtgccccatctgttctcattgtccatctgagattcataggcagtgtttgtatatttacatcttacctaagatgcattatttacttaattatctaactcataatttgggacctcttcttcatagtatttctttctacagttatcacatggcatagatctagcacaaggatttcactgccatatgaaagggagaaacacttttattttgtcagaatttttacataataatttgattacgaaaattgttttatactttgggtattttataagtgaaacatgttttaccttaggaatttagaagatg

SEQ ID NO: 70521 - DNA, 1234 bp, Homo sapiens
ttgtctgtgggacaatggtaaacaataacatactcaaatggagtcaattagagaaactgttgctttttagagacagggtctcactatgttgctcaggctggagtgcagtggctgttcacaggtgcgatcatggatcgtggtacactgcagccttgaactcctgggctcaagcagtcctcctgcctcagcctcccatgtagctggggctacaaggcgcccatgatgacctttttctgaataaactgagaagctgttcttggattctctgagattctagctctatttaggttctttaacaaaaaccaagaagaacgcctagcattttactttttaaatattgtacaagttaattgtgtagagtggttccacatcaataatttcacattgtttttattcatgtgttatacaacatggtactatacaaatttgacccaggtcctagaagtggtaagaataagaaattagtagtgtgcagtttagccatgtgcagaagacttcagtggtatacgttactttgtaaatttgatatgtaatcctcaattacttatatcctgtttcccattggcatcacttacaagcaactctggaaggatgatttcacttgactcccagttcagtgcttttgtatccatatccttttgaggaagttttctgaagccatgcttatttttcattgtgtttcagctttgcatttgcagtgcttgagtgtgattcttagttgtgttgtccattataatatatgtttttctagggcctgttcttttatcccatggcatttttcagtctcttatgattaagccattcaggtcatataacataactctcatacataatttatatttttcttaccagcctgaacctttccctatacagatttatatatccagctgcttacttgacatttccacttggatgaatgtctgacatgcatttcaaacttaatttgacccaaactgagttccttatatttcttcctgtaaactagctgctctcactatcttttctgtctcagataatgaaagtcccatccttccaggtgctcaaaccccaacacttgacatcattttgttcctgccttttttatctcacatttggtctatttggaaatcttgtttgctctattttcaaaatatatttggaacttagctacttctcatcaccttcactgctaacactttggtccacgattccccctctcctagattatagtggtaacctcctaagtgattatacc

SEQ ID NO: 70522 - DNA, 1027 bp, Homo sapiens
tccttcaaaaaattgtcctgatttatattctcataacaaaagtacatgagaatatctgtttccccacattctctcccatgatggattttagcatactttttagtttttaccaatgtaataatgaaaaactaatttatttcattagttgtaagtagatttatgcatcctttcaaattttaggcagtctcatgtttaaccttgctcttactatttttcttcacttggaatatttttttcttctttcatttttctctgaacctttaccattcttcaagcccatgtcaattttttttttaattattgaatttccaaataacctcagactaaaatgatttttcccttctaacaaactcaatgctttatttctacttgtcacagttttataccagtcctaataaatatcattttcttattttaggatttgcagatttacagaatggctgcacattaatggaaagagaagcataaacctatcttctttcattatggagggaggtttggcagatggagaacctgatcgaacttcggtgagtagttcatatatgacataggttctatcatctgtaactgtgaagtgtttgatgtaagctagggttttgtttttaaaatatattaacaacaaacttttaaaaagtatttttaaaataatgctttaactccttgagaattacagatactttaaatgatatgaaaattacagatagctagctaggcatggtggctcacacctgtaatcctagaactttgggaggccgagatgggtggattacctgagctcaggagttcaagaccagcctgggcaacaatggcgaaaccctgtctctattaaaaatacaaaaattagccaggtgtggtggcacatgcctgtagtcccagttacttgggaggctgaggcacgagaattgcttgaacttgggaggtggaggttgcagtaagccaagatagcgcctctgcactccagcctgggcgacaaagtcagactcggtctctaaaaaaaaaaaaaaaaaaaaaaaaatgaaaattgcaa

SEQ ID NO: 70523 - DNA, 1054 bp, Homo sapiens
ggacatcctgggagataggaagtcacatatttatcatataaaacttgttgccataagagaaagccactattcattactgaataattgaatgttcaatattcaatcattattttaaggttattatgattagatatgtattaaagccattaaccttgcctagtaggtgctccttccttttccctgtgactgaaataactatttgtaaatcccaaatagagaataagttttataaaaattactttctctaggaactttgttagggtaagtatagacaatgagctaccagttccccagcttctggagtactgataacaaaaggaacaatagagagaacattgtcttctttatactttgaattcaactagtaattatatttaaattaggatgcaggcctggctttagtttggcagttttgagaaatgagtcaatatggttgtcaaatgccatactcttttacaaaaaagttacttaacttttaaaaaattaacagaagcaatatacactgtttaaaatacttaaaacagcagagaagactacctttcttctctcgaagcctgttccttacagcctactgccattaagtttgcttttaattactgttttagcttttaaaaaatgcttccctattctcagatttattatcatttaaatgtttttgactttgacctctaaaggatgaagagattggtgtacttatactttaagcccccagccactttccccttccaggattttttgttattagcagtgtttcttaactgttatcaaaggtgtggaatttagggcatttatcattaattttaccttttgtcatcttgcttccttttttagttagtgattttataatttttattttgtgtatgtcttgtttttcatatagagtaaatctctttttacatagatatatagagtaattctgaaagttgaaaacaaaaaatcaggattcattaattcattcattttataaatattgattctttaatactggagcacctcagcgctctgatcttgggttcttttctgtctacagagatttccaaaattatctcattca

SEQ ID NO: 70524 - DNA, 1033 bp, Homo sapiens
agctgtaacttaaaatatctaactttaaaaacagacatttagtgtataggactaaattattaatatatggttgccagtatcatatttgcaagcattatctttaagaggccttgagttactctttgagacacccttgtcacaatgcgacctagtatcacaaatgctgactgatttagagaacagatgcactgggaaaataaacctgcaagaagtgttatctttcctagtaagtaactgtgtgaccttggcaaaccacttactctctctgggtcctagtaaaatggagagtttggaaccaatggccttttagattctttagagaggctaaaattccaatcaggtagtatattatgtaatccttgtaatagctctgaaataaatagatggtattctaactgttttacagatggaattattcctgttttttttttttagactcagtgtttaagtaacatgttcagtcatgttgctgctaaggagctaagtgagaagttgaaccttcgcctatttcactctatagctgttaagttcttttagtataacatactgccacccaagccatgttgtttatattagaccatcggatcttattcttaaaatttgttacatttcttaatctgaagtttataataaatgtgcttttgctttatagcatgcgtcattcaggaaaatcagaagtcaggtatcaggcatgtctatgagttgtgccaaagtagaaatatgaccagttttaaaattattattctagaacttatgtgtttctctaagagatggtcagtgtgttcaaagttaccttatttcaataatatcactattgttcaacaaacacttttggaataatgcatttgacatttctttactgtctttcacctcattcttttaacctacattctgtggtgacaaattatatcttttgagaatggatttggtatttggtatttggaaaaggtggcaagtctttctgaaccaagtctcacacataaaattaaggatcaaaatgaagaaggccatttttagtataaataagcagtga

SEQ ID NO: 70525 - DNA, 1029 bp, Homo sapiens
tctagactcatgttgtgtgcatatttcatggcagtatgtgggaaacccctgagagattttagatctttcttcccaccttggtccccatccctcacatatcctcacaaagtcataaaattctcatgtggaaggcgtgatagaaggaatttttcttcctgaaaagtgttatcaagcttgcaagggagagagctattttcggagaccttatagggaagaaatcctagtcctagagcatcatattcttataccctgttatttttacctttgtcgaagatccagataatgtaaattctccatgatagcaaggaccttgtctgttttgctcaccattgaatctccaaatgttcaatagttaatgaatgaaaaaagtctacttccagatatatgactggagaacaaaaggagtatctgataatgtagtccaaactaaatgcaagcagcgaaatgataaaggaaggatgttagcttgggagaaggggaacaggtcatttaatctgggaaactttcttggaggaggtgattcttgagttaggttttggtgtgggctgtgtgtctgaagataagcagtgtctaagggggtagacaacgtgcagcaaagcatttaagtcagactgaataaattatgtcagataaagcacagtaagtctttttttgtaacattatgaagaatttttattctcccatctctattttcacctctccctaaataaaaagattaacttgctttgcaacagcagagattgacagtacttgagttttggaagtacgataagggtcagaaaatttgaattggtgttctgactgaatcttatacaagcgtcgtttccatcggccaatcacttggtcttagttttctcatttgtaaaatcaggataataatccatgatcgttgggagaacaaagttatataatgcatgtgaaagtgcatacctcaatatgaatgtgcctacctcaatgtgtcacacataggaggacttcagcaaatacaaaattattaaaacgtttgtctgcagatctttaaaacatatt

SEQ ID NO: 70526 - DNA, 1018 bp, Homo sapiens
ttgtggagaatcgtgggtgaattgattgttaaattttgctaatttcctagagtttcatctaaacttgattttgctgagaggctatgatcagtttctatgcttgctagaacctgttttgcagtgaaattattaagatcatgctagttttataaaataggttggaataggaaaagtaaggccatgcaatttaaaactgttctctataaaagtacaactaatttcaaatgtttgttacttttatttttttttaatattaaccgtgtatggagtgactataatatacctgctcaaagggctgagaaaggaaatagatgaaacttaagctaccttttgggtctttaattatggacatcaagttattgcggtcacattccatgtcaaccgtttgaacagcaataccgtgtacacaggtgcttagaaatgcctgtttaattaaaaatggccatggtttatttctctttgattgaatcataatagttattgaatctctgatctgtggaaagatgctactgtattttccttagaatgttactgcattttaaagacagtcaaatatgttttttataacacattcagggtacttatacatttgtcaatattcagttccttggttcatttaaaaattggaagccttagaaaacactttggggataaatttacaattgtgtataatgaatttatgttttagtttgctttaagaaaaatgatgaaattatgaatttgtaaaatatgcattacaaaaggattttttttttttttttttttaagactgtctcactctgtatcccaggctggagtgcagtggtgcaacttggctcactgcagcttctgccacctgggttcaagagattcttatgcttcagcctcctgagtagctgggattacaggtgcgtgccaccatgccaggctaatttttgtatttttattagagatggggtttcaccatgttggccaggctggtctccaactcctggcctcaagatccgcccgcctcagcctcccaaagtgctgggattac

SEQ ID NO: 70527 - DNA, 1010 bp, Homo sapiens
gaggtggaggttgcagtgagccgagattgcactccagcctgggcaacaagagcaaaactctcttaaaaaaaaaaaaaatccaaagctgtggtgacaaactgaaaatgtagcttctgcagcttactgttatcatggtcaaagtacatttttctcatttgtaaagttgggttaatagtgacaccttttacagttattgtgaatattaactaggctaatgtttataaagcagttttcatagacctaggcacataggctgccaagcaaattgtaccttctgaaggccctggcatatagtgaatactgaaagggaagctgctgttactttgttttcttttgaaataggtgattatttgttttattgaaatgaaagaaattaaaggctctttggataaagaagaactgatgatcaagggattagggtactagttctagctcagtgaccttgagctagtaggtatttaactggtctcagttttgttgcttttaagataaagtagctagactagatgacctctaagatttcttcagactcaagtgttctggttttaaattgtgatttttcaatataatcaacttgagcatctgtctactaggtacgtagcattgtgttaggttatatgggttaaaataacataaaaaagatagcatatgttttccagaaggtaaataactagttgggaagttgtaggcacgtgaaacactggacgattcaaataagtactgaattaagtaatgtagcttgtaagtggtgtcagattcctgtcatttagagtggttagaagaaaggcttccgtagagggacagagaccatatgttggtctactggtccagcagactagccatgaccagcttccattttacctactagtacatcctcagtaagtcatctcagctctttgatagaatgagatcacaatatccccttctgccacagtatcacaggggctatttcagaaccatctgactcagagctttgaactggattgcctagattatctagggctttcatc

SEQ ID NO: 70528 - DNA, 2016 bp, Homo sapiens
aatctcaattctgctcactagcttgcaatcctgggcacgttattgaactctgcatcccaattttccaaactaaaatgggggtataataacacctactttatgaggctgttgtgaggattaagtgagataatacatgtgaagttctgtgtctggcacttagtaaacaacaataagtgttggctattaatattgtggtaaaaagtagtacctcaaattgataaacaattgtagtatgcatatattagagtggctaaaataattagtattggttgtctctggggattgaagagaagatgggcagaggacttcttattataagcccttttgccctatttgatgtttttaaagacgtgtgctttgctacaagggagtgtttattgagaatccaagtatggtcttgaccctttgctaggctccgaagtaataacatttacaaaataacacattgtaaaatgatgtaagattaactgtagaccttcagatacctcaggatagatgagggagagtgtgtctgtgtgtattttttaaaattagaaatgattcgtggtcctcctttcctcctagagagggttgtaagggtatgttaaggtagtcagcattgaacagttaaggtgtcttaaaatgcagtgtgctggccgggcttggtggcttacgcctgtaattgcggcactttgggaggctgaggctggcagatctcctgaggtcgggagttcgagaccagcctgaccaacatggagaaaccccgtctctactaaaaataaaaaattagccgggcatgggggtgcatgcctgtaatcccagctactcgggaggctgaggcaggagaatcgcttgaacctgggaggcagaggttgtgagctaagatcgtgccatcctgcctgggcaatgagcaaaactccatctcaaaaaaaaaaaaaaaaaaaaatgcagtttgcttttaacagaacccacaacaattacataatccgaaaagatgtttcactattaaggttatgtaaaattctctttcagcgcattatctgattatagtattattttatgaatagattttattacagatggataatttaagagtaaaatcaaatattttaattttggaatttgaaaaataatgattcaagacaatattatatttataaaatacataaaatttgacccagtggaataattatttagacctaggataaaatatcttcttttaaaattttcttaaagtggagccacaggcagctaatttgaaagtacagtgaaacttcagccttctgtgaatgagatactgtgaacttagtatcctgagttacagagaattaaacaatacttttttgtttttgtttcaattcctgttgcaaatttgccaaattattttctagggttaatacatactaaacataatagaatctttctttgataaattagaacattatagtgtcctaggatcatctttctgattatcggtgatactgttagggatatgaagattataacattaacagtacctgagacattttttgtgtatatatgtcagatggcttgcatttttatcagttgttgtattctagaaaaaaatgaagtgaaaaattacttctgattgagatgttagtataccctacccttgtttagtttttaagaataatttttcaattatgaatactcattaatttttgaaggatttaatgaggtatgaacaaaactggtggttaccaaaactatccctattctcatgaaaaaaaaaaaagttctttgagttgaagacagaagtttcttgttgtgtaaggatcctcttgttgcagatgtcaacaatcttgtctgaaacatagttgggcaaaaaggggaatttactgtctcagataacctaaactcaggatgcaaggatgcagttgaaatcaaacacaactggaacctgagctgagaatgccaccaaaactctcttatctctcctcctctctccctttcagcttcattttctccaaatgcagaccagcttctttcttccatgtagccgggacatagatgcca

SEQ ID NO: 70529 - DNA, 1051 bp, Homo sapiens
cagtaagtgaataataataaaaggcaaatgtgatagaatgactgggatggaaggaccacatccagtgagagtgatttgggaatgcctctgaggagatgacatttgctttcagaattacgtaatgagaagggatcagttatacagagacatgtgggaaaaaattttccttgtagaggaacatgcaagtgcacggtcctaaacaggagtaagattgcagtatttgaggtgcagaaataaggacagtgtggccagagtacagtgagcaagatggtgaagtcacttgagaaacacaggtgctgtatcatgcaatgcgataataaagagctttaattgtattctcagtcatgggaaacatttgaaaggatttatgtaggctgattatatgatctgctttttgttttaaatattttttaaacattactttggttgatgtatggagaatgcattgaagagttaagaaaatggaaaagatggagatcagttaggctgttgcaataaatcagacaagtgataatgttagcttagcctaggatcagaggagtagaggtagagagaaatgactggatttggagaggatattttaaagtagaaataagaaggtagattaggtgtgaggataaaagaaaccatcgttgatgacttaggttttgttttgggtaactgagcgtcttgtgatatcatatgttgagattgtgaagactgaagaaggactttttgggatgaaggtgataggaattggttctgtttggtaatatttaatttgaagtggtgtcttagccgtgtgaactattaagctaattaagtaaacttaaattgctgccaattttgaaaaggaaacatttattttaaaaaaatacctagaatatttgtccaggaatctaaccaaatttatttatacctatgctttttccatttttaagtcttaagaaagaatcttgttgataatagtggattgtaacgataagatgcagcctgcaaatctggctatggctttaatagctataaaaagttatatttttcaaagaatatgaaaaattacgctttgtgttat

SEQ ID NO: 70530 - DNA, 1052 bp, Homo sapiens
ttatttaggtacataaagaaactctacggcaattaacttcttttttgtgggaaataagattgtgcagaacctagaccccctctctgggggaaaatattctaagttttagtatcatataatcaggcaactgagccaacagtcatacaatttaaaactgaaggtatatggatgatctaaaatgagttttccatagaaaggtcaagaatataagctctctgaaaaaaggtatacaacatatcacaaaagaatgcaaagctcaagttagagctggagttgtgagtagtttaaaaagatatgtattagaactaagctatttcacaatttattatcatactaacaaacaagcattcactagaaaaacctttatttttatctattacttaacaaaggccagttgaatcaatgaaccaaaatgtacacgagtagccgatggagatttaaataatttcatatatacccatccttcttaattattagccccaaaaggtcaccaaccacgtaggtaagagcccttggaaactttgttatttaccttcatttattctgagtataataatattttaaaaattacattgagaaatgccaaaattaaaggctgtaaatactcgtgctaagtaagtgttcctaagaatcctacttaaaaaattatatatcgaaaatcttcagctgggcgcggtggctcatgcctgtattcccagcactttgggaggccgaggtgggagtatcacctgaagtcaggtgaagtcatctgaagtcaccatggccaacacggtgaaaccccatctgtactaaaaaaaaatacaaatattagctgggcatggtgatgggcacctgtaatcccagctactcaggaggctgaggcacaagaatcactttaaaccgagaggcagggattgcagtgagccaaaatctcgccactgcactccagcctgggcaacaagagcgaaactccgtctcaaaaaaaaaaaaaaaaaaaaatcttcagttatgagtttaccttatcagctttcagctttctaaggaaggacggattgtcatatccttttgcttgc

SEQ ID NO: 70531 - DNA, 1055 bp, Homo sapiens
gtgttgggattaaaggcatgagccaccatgccctgccttgaatatcttacatagttttgtgacctaaggtaactgaacagagacttgataactggctataagtttgtgaagggctcttacatggaagaggcagtagactttctttggttgctataaagataaaattgtgatagaagttaccaggagttatgtaggttttatacttacaagtatggactttaacaaccagaccagtacagaaatgaaatggaaatacctttggagtattgagcactctgccttgatctttgttcagagacacatctcttcattcagtgaactctaggagcctatggattgtttgcttttattctttatctcattttaagattttaatatactatttatcatttgaaatgtctactccaggcaagcatcttcaggtttccttatgtgttataattcttatactattagtcattctagttgtccttgtctccctggttatcagtgcccctgttaaaaaggggtggtatttttcatgaactgtttgctagccagtgtatgtgttaagcaggtagtactgtcttctatatttaaccatatagaaccaactgctataacttctgttcttattttccacaattttagcaaagttatttaaaattgttcattgcctgtctccagaagacagacaccagcaccttgaatagtactgatacatagcatgcaaatttgagtgaatgaatttcacccgctgttgcatgccttcacaaaggtaacaatgattcagattgagattacttgaaacatgcaaaaacttttctaattttttgtttctatacaggaatttcggcagaaagtaatgttaggaactcctttcctagttatttggctggttgggtttatagcagacctaaatattgattcttggctcattaaagggctaatgtatggtggtgtttgggctacagtacagtttctttcaaagtaagtgtgttgtttttaactatattttaaactgtacatgaaataatataatttgtactcttgtataaaattaatgtttgtatgtt

SEQ ID NO: 70532 - DNA, 1129 bp, Homo sapiens
agaatttcccatctaatttccagtcctttagtatcttattttcacttgcatttcagaaaagaattctgaaaataattcacacagagatgagaatgactagtattataatatgctgagtggcttaaatctagttagtgaatctcattttagtatttctagagtctccaaggggtataaataggaagtcactaagacctcctgcctatatggatagttgattctgttcatgtttaataaatggattaatgtttgtttttccccaattttaagtattaaaaacacaactcttcagtttcactaagttggccagttcattctacttgaaaagatgtgctccaacttttgctggagtgttataggtaaggagaaataatgatgaaacagagaaaaatgtgaggcttggtttggattcatttgtcaaaattttgacacatctttggtgaatagtatgctggatgatagctactatatatactaaagtcagttattgactttaagagaataggagtgcgctaaaattctgaaactgaaaagtatatggaatgtaatttaaatttggggggaattaaaaggaacttcagaatcttgctgagtctttcagctgtgaactaatttttattgattactatgaaaaattgagcatcctgaactctggattctggtgaaaccaatgcttactatacaaaatgtgtgtcattttcatttaaataaatactcatttttacaatgaaatatagagctcatattttataaaacttgtgttttacagatcctttttcgatcattcaatgcatagtgcattgccccttgggatatatttggcaaccaaattctggatgtatgtgacgtggttcttctggttttggaatgatatcctttggttataaagatcataccaaaaacaaattttgtttgttatttgaatagatgtttaataatttgacattaggactgatctactcattcataatacattaaaatagtgttcctagaaaatttagtaaactaatataagtaatgtttttaaatatttaataggttgcttttgaaagctgtctttaataacagcatataaataatagtagctatcatttattgagtgtttaaaaggcattttttgactactcat

SEQ ID NO: 70533 - DNA, 1032 bp, Homo sapiens
aaaaatgaagagatttctcatgttcaaagttattaacatatactttatgtatatgcactgcaatctttaggcatctaccaaatattacagatatcatactcgtatatttaaaagattgcttttaactataggaaagtcaaaaaagaaaaattctcacttttgcctttttttgaacacactgaaattgatttcagaaaaaatataagcttgcttaaaacaaatagtttatatgttcacattttttctatctcataaaaacgtaagaaatatactaggcatttataaacacaagtaaattatcaaaaaacaatttaaataacactataaaaaatacagcaatgtcgctagagcaatacatttctgagacacaaaacaccaggtatactcaaataccatttgtaagattgtatgtagatacaagtattatacaagaatttcataagactttttgacattatcatgtgtacccactgtttacatttctcatgaagcacagatagaaaaagaacagcttcttgaatgaaatcattctatatttgtttggaaaataccagaacactcaatagccacttgacatacaggagaaacaaaagacggaagaaaagattagttattatcacctggcatattcaaaagtgacttatcttttccttttttctccaatcctctcttttcccccaactttttccaatcttattccacaaaatataccggtatagccagcagagagtaaataagaagtcaaactttcagctgtttattctggagaataaagtgtgcagaatgctgaggcttgacattactcaggggcagcacttttatttatcacaagttttgaaaaggtgccaacgtaacatgtaaataaataagtcaaactctcaggacctggattaaatttgcagggggtcagctcaatatatgactacatatttgaaaggtatattaaggaattaaatactgaatgaactttaaaaatgtctttccttgctctttaatgataaagaaattaggtatcttcaaatggtagactga

SEQ ID NO: 70534 - DNA, 2019 bp, Homo sapiens
gtctgcatgatttaaaatttataaagaagtcacattatttttacatgtagttataaacataatgcagaacagtttgtatttttttgactggtaggtgttttgtaaaattttatagattataagtttatatataatagtaattcatttatcattgcttctttagattccttaaccttaggcacatctcaactttttatttatccatcttccattccttgccaatagtgttgcacttttctacaattttggaaaatcttggaaatcagatccagggattattaaagcaacagaagagcaaaagaaaaaggtagcaaaataccaactaagtcacttgtatttaactgccagattatcagtatttacagcagacattagaggacagaggaattaactatcgtttagaatgtaaagaagttttaagctaaattgagattatgtatcttttatttggtgctcatccttggtgctcttgtgatgcctgtccataacacttccatgacattttataatttcgtgtttctctcccttacaagactgctgtgattgctttgaggggtgaatacggtgtcttaaacatctctgtaaatctccaggaaataatttgcattcagtagatgtttgctgaatgactatgtaaactagaaggttaataaattggttgatagtgcaggtacaccatcccagtagctaaaatatttgtatataccatccagggcatccctttcttataatgcaggtaattaggaaaccaatattataatctaacaatgttgtgtatttagagaactggactagaagcattttagattattttaagagctgttttatttagtctctaaaaacaggacaaattttgataagttattccagtccacaattgactaagacaatggcagattcttatggtctaatccccttttttctgggcagcatagagattgctaccctgtattcttcttgcaatgaaatagcagtaaataaaagattttatttctctttttgaactcaaaacatcagtaaattaaagatgaaaatcatgtttattgattcatagtggtggcaaaagagttggtgagcattgttcagttttgaattaaatattatttttttaattcacagacaatagttgaacttgcagagacaggaagtctggacctcagtatattctgcagtacctgtttggtagtattttcttctttgttcttccctcccttctcttcctcctgacagtggcatagcatagcgggtatggggtgtggggaaaaggaataattattttcaatgaacacattccctgcttcttggtataagaggaaagatggttaaaggatgtctgcttcccaaggcgcttattcctcgatggtaggccttgactgtacttttgattcggaggtgccgtttatttgtattcattctctttctcttttctcgcttaaaatgttaataaattaaaaactaagtaataaagtatttcagatcaaagatttataatgattccctaatagattgttttctttactacattttaagaaaatttatacttgtatttaaaagccacatgggaaaatccattagataactgttaagacaacatggcctctaaacaagttcaatttgagtaggtggttttttttgttttgttttgtatcagaatgtttatgtaactttgaacactgttttatcatagatttttaaagtggtcatcctcatccaggtcataggtaaagatatatatgaaattactagtatttattaatagagtcaggtatagcactattgagattgtttattattatagacattaattttctgtaggataatactcttatgtttaaattatttttcacttagtttttataattagtatttgtgaaaaatatatatactgccacagtgcttaaattatgtttttctacatggaaattgaaatattccaaagtcatacataaaactaaatgctcttttatacttatacactgcaagtgagctcatgtcttagcatctgattaataataaagt

SEQ ID NO: 70535 - DNA, 1038 bp, Homo sapiens
ttgtaaattgatggttcagttccattcttaagagcatattttctagagtagcctcattcttttattctttgtttttgcagttgaaattttattaaacaatagtgacttttggtttcattcatttggaaaccttgatataatcttgtttaaaaaatatagttttatttttttataattatattttgagaaaataaatagtcagcttttctctcttagtataatgcctttcataatcctttaacatgcctattaacagatacgaaaaccggtgaggtccaaacattgtggtgtgtgcaaccgctgtatagcaaaatttgatcatcattgcccatgggtgggtaactgtgtaggtaagttgtattagtaatttcttctgtatcattcatttaagttactttaggtaatgaataaagtataatattaaagtaggcaatagaaagtttattactccacgcttcattttctcagttatcttctggttgacaacacagcaactcagttgagagagggagggaaaaaaattacaaaattagtggctgataccttttctctgtcagttctatctggtgcctactcttgataaggaggcaaaattttttttttctagttaaactagagagatgaaggcggtaatatttgaaatgatattatgtgcagaggtagagaggaatgacagataagaacagtacacacattagtgttcaagaatggtatagtctaaggagagaaactacatggtttgagacatgccccggagattttatgaggtgacaggaaacattacaaagattgtttacctctgttgaagagaaacctttggattgtaaagtttataaaagtaaagataaaatagggctattttaaacctcacaaagaataggattagaggtcagaattgtgatttatttagttctttgggacttgaacaccattgtcatcattatatctttgtgtgtaattgcaagcattcttatttaagatttttattaaaacatttttcctgaaaaccactttataaaataatgaatgtatgtgtga

SEQ ID NO: 70536 - DNA, 1110 bp, Homo sapiens
caaagatgagaggatatatgaaagagatttttttgaaagagggcatataacataataggatggtgacatgagcttttttttccagacaaggtctcgctctgtcacccaggctggagtgcagtggctcaatcaaggctcactgcaacctcgacctcctggacccaagcaatcctcccacctcagccacctgagtagctgggactacaggcatgcgctaccacaccgggctaatttttgtattttttgtagagatggggtctctcttcctacgttgcccaggctggtctcaaactcctggcctcaactggcccacctgcctctgcctcccaaagttttgggattataggcaatgagccaccatgcccagccaaggtaggcctttcctaatacaaaatctcctgctgtaggagagttgctataaaatactgctgttgttggcaagaaagtattctcctcaggtgtgctgggccagaaattaggtcaagttctttgaccaaatcttcctattaatctttaactgaggtggtaacctcctttggttcattagggcaataacactgattatttttactatctgtggggcaggaagactagaaaatcatccttccaagacttgtatttaaacgaggatctaatacatctttatgccaagcaccaccaagccctgaggcatcgtaagtgacgtatccacttaaactctttccagactgcattctcaatgcaacaaaaatctatcatttcctttaaggtataaaacccacatgatggaataacaacttattcttaaaaaggtaacttctgatatttactaatattctctaataggcaataattataccttacttttcaaaatatttcaaattctctgcaaatttaattttaagtatattttcccaactgcttggtaagaaacagaactaagacaatcacttaatctataagctactatagtaaagcaagcacatgatgtggaaaatgttgatgtatttcacccagaagcttctcaaagcctattaaaccaatatgtttttcagaggacacaagtattaaaaggtggttaactgctaactgtttgcttacactgtatattggacataattgatagagctg

SEQ ID NO: 70537 - DNA, 1663 bp, Homo sapiens
ttcctaaccactcctgctcttcaaatattcattttatttttcaatttagttttcctttctacctcactcttttgccccttcctcttctcatattgtgaacttttgaattttagtacttatctcaacagaaattttaatctgttattcctgacttaaatacatccagttgagtatgtgtgagctcagattgatgatgacattaattttgtgtttttaatggtatttttattcacaaatactaatatttattcaaaagcctttttttaatttttaaaagctcattctcagagaggctgatagggaggttgtctgtgcaggaatagcgcctgtccatgcacagtgtcaagtaacctgtctttaaatattttccacatttaactggctacttttcacagtcaaatgataccacgtaaactagttctgatgatctcctgatggaaaaccaaaaacagacttcattgtttttatctttatcctagttttcttcaaattaatttttttatattaagtatttagaaagaataatggtttgtgcagcctggcatggtggctcacacctgtaatcccagcacttggaagccgaggtgggcggatcacttgagcccaggagtttgagatcagcctgggcaacatggttaaaccctatctctaaaaaaaaaaaaaaaaaaaaaaacccaacaaaaaaaagaaaattagccgggcatggtgcatgcgcctgtaatcccagctgctggtggggtgggggttttggggtggggggaggtggcgggggtggaatcacttgagcccacccaagagggagctgagaattcgccattgcattttagcctgggtgacagggcaaggtcctgtctcaaaaaaaaaaaaaaaaaacaagaataatggtttgctttttctttcctcttagatatcatgtttaggtattactacaaatgaaagaatgaatgccaggagatacaagcactttaaagtcacaacaacgtctattgaaagcccattcaagtatgtacatatttataaatttaatattttacctggtcataaaaattttcttactaaccagactcttttacttagtgatatgtaaaatagcttttaaacctttttaagatttctgtagaaatagcatcagttcaccataataacaacaaaacagaattcatcacattaactgtatataataaagttgtgatatctccttatatttttttctttttaattttaaatttgtattcagtctggtgcttagaaatagtagggtcctaagtatatgaaatatttaaaactttgagttttactgaagttattaccaactcttcagcttttgtggtgctgtcaattatggcatacttctggaaagcaagcagacctttaaataaaaacagagttagttgggtagttttgagaattctcccataggtacaaaaattatataaggcacaaaactgactgcttttcttttcttttttttagacagagtcttgctctgtcacccaggctggagtgcagtggcatgatctcggctcactgctacctccacctcctgggtttaagcacttctctgcctcagcctcctgagtagctgggattacaggcatgcaccacgcccagctagtttttgtatttttagtagagatggggtttcaccatcttggccaggctg

SEQ ID NO: 70538 - DNA, 1644 bp, Homo sapiens
taaaggtttttatcaaaaattacatatggagccaggcatgttggtgcatgtctgtagtcctagctacttgggaggctgaggtgagaggattgcttgagcccagagttcgaggccaggccgggcaacatagttaagacctcatctctaaaaataaaaataaaaatgcatataacacagaaagtatatgcacatttgaataaatttaaaatataattgtgtaagtctttaaattggcaaaagaaaaaatcattgttggcagagcagtggagaaacatgaaggcatatatattttatagagttatgaattggttccttcttgcaagtaacctgagtttttaagtttagaaaaaaatatatttaacacgaaaattatattgaattcatgtattaaatcatttgtactgactgacgtgttttctttttggggtgctgtttttagccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttc

SEQ ID NO: 70539 - DNA, 1095 bp, Homo sapiens
ttgttcaagatattgttacttgaactccagactaaaattatggatagagtattagtccaatttgaaaatattcctgtttaataccactgggttctcaaaccattaacaaccactggaacaacaggaaacagttccttaataatttttgccttttaaagtcccaaataaagaagttctctctgccacgcatatcttctcaagtaactgagatcaacgtttggtaggtttcattctgcagtatttttctttatatagtacattttgcaatatttttctttagtatctttagacatatttaaaacttggagattcatacagtccctgaggatcctaattaactacatggaattcaaaaattcttaaaaaatttattatctttatttaaaaaaaaattacacacacacacacatgcatacacacaggattggaaatttttttttttttttagaatactaacaccatcttttatttttccaaattcctacagtcttatgccacttgactcctagttaaccaggatataaatgtataatcttttcatatcataggtaccactatcatttcatcaatttcctgaagtaaattgagtgaaatcataagcacacacttaagagtcagtatttattctgattaatattttacaaaattttgacatttaatttatgtaaggagggctaatttattaaacactttacaggtttttctttccacagaataacacggtaagtagcaaaataatacttggcacagttataaataaagaaaatataaaataaaaacatccatagcttaagtacaatgatgctgttttacgcccattaatatcaaataaattcctggaaacaacaaaaatatgaatgaaaaaaaactccaaggaagtaattcatgttcagtgctgagaattaagttcctatttgctaaaagtatccaattaagttgataagaactattcccaaaggttcaccatcatacacaactttagaactgggtttatagttggttccacacacaggacctacaaaataattaaacagatggtatactgctgcatagctggctcctgaccatctgaccatttctgagttatagatttca

SEQ ID NO: 70540 - DNA, 1095 bp, Homo sapiens
accacaaatagccatcttttgccttcatgtcttgagcaaagcgtaagtatatggaagaaaacagacaaatacataccttacctggcctgactcatgcttgcaactcagcaggaccacgctgaacactatagggccagaatgtgtggacttgtctttgcagctttaagatatttagtacatgacacatttaacatcttaaataagttgagctcttttacacagcagtttaatttatgggggtttgttgagtgggtcttaagcagtgctagcaaagcttaatggacttgcactaactatccttcctccctttcctttgtaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttgatttgggtgttcattgtcttttaattaatcttttggaggagatgctctgatttcagttagtggaaagtcatttggttccctacctttgttaccccattacccagctgactcactaggttcatgtttgcattacagctgttgaaaaggatctctctttcaagcaggcaagtgtgccttaagagtaaaggttgcaggccgggcgcggtagcttacgcctgtaatcccagcactttgggaggccgagatgggcagatcacgaggtcaggagatcgagaccatcctggctaacacggtgaaacaccgtctctactaaaactacaaaaaaattagccaggcgtagtggcgggcgtctgtagtcccagctactcgggaggctgaggcaggagaatggcgtgaacccgggaggtggagcttgcagtgagccgagatcgtgccattgcactccagcctgggcaacagagcg

SEQ ID NO: 70541 - DNA, 1036 bp, Homo sapiens
ttttttttttttttaaatttagcagagacggggtttcgctatgttggtcaggctggtctcaaactcctgacctcaggtgatccacccacctcggcctccgaaagtgctgggattacaggcgtgagccaccatgcccagccagaaccaggcattttaaagtggtcgaggcagactaatttgttgagaagggagacgagaaaatgttggccctacatgacagtgagacaccctaggatctgtacttccagcttgccctttacagcaggccatactattcagaggctattcctgcatgctcagcaaacagttcaactggtaggaagggaacttgtagcagattctgtatggcctgactgacttgccaaagaggaaaacccaactgctggctgcactagtgggccttggggttagtgaagcatagaaacttaagccggagccatctggatgggcgtttgttgtggttacggcaaaagttccgtgcatgcagttgtacgagtcacagacacagctatttatgctacaatcgtgtaatttcagcaaacaaatataaaacttgttcttgcagggcaacacactttgttccctagaaagcgtgttatagcttatatatgttaaacgttaagaatttagtgttgttacaattaattaaacatgtaatgaaaacctccacccaagggtaagatcttcagctgagttcaaaaaaatatgtttattaaaaatgggcatattagggagggggacaaggcttgcctttcccctccccacgcttctttcttaactcctgtggattctaatggcatagcttgttttgtgcctggtgacctgtactattgtactgaatgcaggtcctttgtctggcaggaaaaaaaaaaaatcttgtgcacgacaagccagtttcctaatgaaagagttgttatttgggagaggagatgaggttattttggaggaacgcaggcctttgaaagatgtggttagagaggttcataaagaaacgaaaatctgcagctgtccctgggcttaaatagccctctaggga

SEQ ID NO: 70542 - DNA, 1053 bp, Homo sapiens
cttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaattgcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaa

SEQ ID NO: 70543 - DNA, 1662 bp, Homo sapiens
tttcttttttcagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattctggaagtagatctgaataggctaccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccaccttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattatatggaaaattggaacctggatgagaccttttcgttgaattctgaagagtaatgatgtgaaaattgatacagggcaagagatgattcttttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgtta

SEQ ID NO: 70544 - DNA, 1035 bp, Homo sapiens
ataaatgtgggattacaatcttggccacagctgtgaaggagcagggtgtgggctgtttggcctggtcagctgggggaaggtctcatcattcattgatttattgtggactcccgtttgaaagggccatgacaaatgtgagcttgaatgatatcctcatgatgacatatattgattttcgcctgttctgcttttctttcaggattaaatggtttcaatgtacttttatctggcagtcaaaccccccctactgtgggcccgtcctcaggtcagctgccgtctttcagtgtcccttgcatggtcttaccatctccacctctgggcccttttcctgttctctattctcctgcaatgccgggcccggtttcttctactcttggtgctctcccaaacacaggacctgtgaatttcagcttgcctggccttggatcaatagcccagcttctcgtcggccccacagctgtggttaatccaaagtcgtccacactcccttctgcagaccctcagcttcagagtcagccctcactaaacctaagtccagtgatgtcaaggtcacacagtgtcgtccaacaacctgagtcccccgtttacgtgggacatccagtctcagtagtaaaattacatcaggtgaggcctgaagtttcctgaagacactgtcactctgggaaggggtatgcctgtgtttagctttcattttagccacatgactgccggacagaggcactaggtcaggctccacctggcttccgttgtagacctagagttatctgctccttttataaagcactgagacatgaggtgagagatcctgtgctttaaagacaaaaatgtatgtttttagttgtcattctgtttcttataattagagggacctgttttaggcatagttcggggggatttttgaggaatgctaaatatttttattattttggtgatcttcaagcttttatttcactaggtcaataaaagaagctaccctaaattttaattatacagctataaaaacaatcaaaggaaacagaagtcttgatagtaact

SEQ ID NO: 70545 - DNA, 1060 bp, Homo sapiens
tcattatcgtgcctgtctcatgtgctaccaccccttctgagtatttcctgtactttgtatatatttaagtgtttctcccaaagccacttaagattcaggcaaggcccatccaaccccttctcactgggtggctagaatgctacaatttcaggtgaggagctgcctgtctttagtacagttgtactgttgaccttgagcatcctgtgtgcccaggagtgcagcctggcaggaagctctggggaatctttgtcattttcacagaccagctgccttgtggagctggcgccacagtctcctgcttggagaaactcagggcatgcttttgacgtgccatgtcagaattacatttactaagcttttaattacagcccattccctcccttggtgtttttgcaatcacagtgctccctgtttgtcgccaggtgcctcttgtaagaggtgtgaagttgtggaaatggaaggacacactgaccttcccttagccttcagatactgcaggtacataaatcctgggtgattttatgacagagccactggtctcctcatcccaacctgctgctttccacctgaggtttatatggcagccgagaaaagttacctgtcacataaactaaactgtcatggtgtcacaggcagcatgaccgtaatcgtgttttatatcttcaagcaaaggtacgacgcctctatgacatagccaatgttctgaccagcttggctctgataaagaaagtgcatgtaacagaagagcgaggtcgtaaaccagccttcaagtggatcgggcctgtggacttcagctcaagtggtaaggtggcgtggttttgctagcaggctgttttatttagaattctcagttccttttccaagtctcacatctactacacagtgagactgatctttttcccatgtcacatacaaaatagactagtgactccactcttggaacagttaacattagcctacaaattgtgcatgctggtttgcccacacatggtaggaaaggaaatactgagtgtttataatatgggagtttctgtaactactaatttgcagctctttgttc

SEQ ID NO: 70546 - DNA, 1019 bp, Homo sapiens
ttttatccttctacattaatctttccaagaagttgcttcaggaaaactaccgtatggattctattataggaagtataagtgtaaagcattgagtggtttaaaatatgcatctcagagtttatgcctactgtagagtaattttacaagccacaagaaaatctgcctcatttcttcctgagctgacttctgtgatgtgtatccagtaagcttctgccaatgacaagggtgatctttccatctgctgatagggctagatcattttggcaagctgcaagtatagtctttcttgtagaaaatcatatactttgatgcttttgtttcattccttgtgtagcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaagtaagaatcttcacctccatcaacttactagcacataaagggtgggatttcatgtgttgatattttctgcttccaagattaaaaatatatatattgtttttgacatacatactcctttcctgcattcatcaaggtttttggtgctgtgagaggtaagttagtcacctactagaattcagcttagagtcctgtcagtgccttttcctcggtggtttcagtagagtgaaaaacagaacactatcctgagaactccggtcagggagggtgtgaattattttgcatttctctttagtattgctgcatccaagacagaatgtctgagttttctttccccttttttccccaccccctgcatactcttctgaagggtggagatgaaaattgtctacaggtaagaaccagaagaatggccagggtaagggtggtgggacatggacagggagagagtttccaagtatcacacccagtgcatcctccttttctgtccatcttggatactgagccaaatgccctgggctgctggtag

SEQ ID NO: 70547 - DNA, 1072 bp, Homo sapiens
agccttttactttcttggggcttgaatggagcccctttcaaatgtgggttgaggagacaggatgctagtttaatgtatttacaaataaaaggataaggaagaatatgattggactgccttcattcactttcatcaacctttggtcgattgtaaaatataaaacagtttggtgacagaatgcaggccagtgcgtctgaaacttccacgtcattagaaatcacctagaatcttatgaaaaggcagattctgatacagctgatgcctgagcttctacatctcacaagctcttggtgatgctgattccacaggcctagcgagcgcactagtagctagactgtagcaacctgtaaatgactctcatttttcatttgtcaaacttttgactaatagactcagcctcaaattataaaggagaaaaaaatcagtccagagaagacaatagataaaacattcagggaattagattaggaaatgtattttaactagaatctaggatggtatggattgagatgtccccccagtttgccaacactggccattgccatttctccattaggatgttaactgtgacatcttccccctcccttctatctgccctctgtagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtatgtatcatcagattacctggaggtctgtctccagttacagtgggaaactggtttccttgggcaggctgaaggcttgaagtagagtgggcccctcaatcgggtgaagacagaggaacaggcagagcttcctttgtcatcgtcaaatttgttttcattatacatggaatttcagggagccttttagacctgaggaccaaatgaaaatgcagtcttttttaaccttaaaaaatatttctataataagtaatatttttataatagagttacattacaaattagtatctcatattttaaat

SEQ ID NO: 70548 - DNA, 1043 bp, Homo sapiens
tatttgggtgtagtggtgcatgtctgtggtcccagctacttgggaggctaaggcgagaagattgcacgtgcccaggagtttgaggctatagtgaattatgatcacaccactgtactcaggctgggcaacagagtgagaccctatcttttaaaaaaaaaaaaaaagtaagaaaaataaacctcagtagcaattcagtattgccaccatatctaagcttatgattagtggtctcttcttgttgaagaagctgtgggtcagtttgagtgacaaactcaaatggcaaatcacatctggtgggagttgtgttgcacattagtcctgtgaagtaaggtcacatatcagtttgcaggagtttggaaatctaaaaaaacgagtcctttaccatgggtagtttgagatgcactgctctggagaatgacgttagagagctctctaggttggcttaaaatgtgggattttgttggatgctcttccattaactggtcctgctactaagtgctgtattagcactggtgcacattgaactacagaagcattgttgctcttcactagtcaatgcaaacttgtaagtagtgttttaaaaaaggtgacacttagaaacaatatggactcaacccacattggccctcatagtcctcatctgttataaacatgcaacagtaacagatacgttgtgatttcttttacagagataccatgaaagataggtgtaaaaggagtagcagagtataatctacttctcattggagccactcttctattcccatgactacttttcgttagtcctatcctgatacttttcagccctaaacatatggtcctatttgtattttcaagtcttagtgaatggtgggaacaaagtatactcttagctgatacctgccctttctcattcttgctaaaagtttcttttttaaaataggaaaatatatttgttgatcgatcaaggatggccccgaagactccaataaaaaatgaaccaattgatttatcgaagcaaaaaaaatttactccagaaagaaatcccattactccagttaagt

SEQ ID NO: 70549 - DNA, 1028 bp, Homo sapiens
gggaggcgggaattgggatacagggcccactcccgccccggctgccagcctgccactcctcacgtcccccggctggcgagggctcgaggtgtttctgccggggaacccggtgcgcagagggtgtgccgggtgcagctctcactccggcccggcagtagaggggatttgcccttccccacaacttggagctttcattggagaagtttatttgggggatctgcttggaggcctgggaaggggctgcgctcagcgctgagtgggtttggtctagcgatcgggtttccttcccccgattcaaaacccctcaaagccgaattcctctcagttctttgcgccaaaattaactgacctgggagaccctgtacttttctgacagatttgcccaacacccttccgacttggtaactttattttgccatctagcttttcataaggagttactatttttgtagatttttttcttcccagattttcagtattactaagcacactttaggtgtttgagtttgttcgcgtgagttttagaaagttgagggtggctacaactcctggaaatgcccaggatgtgcttagagaagggggaatttcatattgacaaacaagtaacacatatgtagatatttttgtttgaggaaaaaatacctaattgcaaaatcattttctagtgtaattgtgcattacagatggaggtaaattgtttaacactaaaagacctgatcagccccaggcagcccagactagattttgcagttgaagatggggaaaatgcacaaaaggtaagcaaacataaacaccttagtttctaatatgttaaggatggtgatgttgaattcaattaagtgttccaacatgccatttgtatttgtatttaagcataataattaatattgataaacattatagaaacattcttttttaaaaatagagccatccaaaccattattgttggaattctactctcagatatagtgggaaaaataggcaaggttacatgtaatgttgtaaccaatttatataagtcaaaaata

SEQ ID NO: 70550 - DNA, 1003 bp, Homo sapiens
ataaagaaagaaaggttattgaacatgtgagatattaataattctcatggtttaaaatgttgactaatacaatgatacattgtagttgatattttagctaattacccttagatttaaacacttttggattttgaaaaccttaaatattcttcaaggatgttttgtaaaatgcctcagtcacaatgatcatcatgatatataattaataaagacactggtccatttcccaaaggggctaaacacagttttccaataacaaatcacattatagcagtttacactgacacagactgccccaaacttatgtatatttgagttttattaagtacattcagtacagtttgcatctgggcctctgttttatttgattaaaagaaaaaagttcaaattttatggctaaagagagcagacatatccatttgaatattccactgtcacctcaaaaataatatttttttcttttcaagcagtgcttttatttcttacaatctgtacaataaggtgacttgccttgaaagcatttcactttttctatccaaaaaagttataaaaatttgcaaagttaacttttataaattgatagtgttgtctctgactcacatcatcatattagagatgaatttccatagtgggagggaaagaaccttagatccaacatacccacaatagtattttagatcaagaaacaacagggtggggaacatcacacactggggcctgtcgtggggtgacgggagcggggaaggatagcattagtagatatacctaatgtaaatgacgagttaatgggtgcagcacaccaacaaggcacttgtatacatatgtaacaaacctgcacgttgtgcacatgtaccctagaacttgaagtataataaaataataataataataataatgtatcttaaactagactgttcaggatgctctcctcccttctacttttatcatcttcctcctcgctcctttttcttccaagcttcacagtttctgtccattgtaacca

SEQ ID NO: 70551 - DNA, 1020 bp, Homo sapiens
atgtggttacttgcccagcaactcaaaactagtaagttgtatagtcaggacgagaacccaggtaatctccagagcccattcccataaccagtacagagtaccctttccatgtgaagtggaatgtgaaaatctcctctgcttcttgcacacgattgtggttgaatgtaaggagcaccccttttaattgcattacagtatatcatccaaaccagcagagtccaatttctatacaaatttcagatgtgaaagaaatattctatatttatgctgtccaatatggtggttagtagccacatttgccttttgagcacttggtatgtggctagtgtgactgaggatccaactttattattttgataattttaatttaaataagcacacatggctgttgcacatgccagcacttattgggcaatgcagtttaagttctatatcaaagctcttcagtgttttctttattggcatgtgttacagctcctatttatatgtgagacactctcccatagctgtaggctgacaagacagagaaagtagtgactaaaagtttagatgctgaagagacaagtttacatcttggctgtggagcttagtatgttactctgagtttagagctgacttacccttaaattgggatgattattgaactacattatagaactatttaaaaaaaatttattttgacataatttcagatttcagacgttcagaatagagacaagaattgtacaaagaataactgcatgaacttcactgagaatctccaaaggtttctgaactctctctccaccccccctttctttctctctctctctctctctgtgtgtgtgtatatgtgtgtgtgtacactttattgttttcatgaacaatgtgagagagtaagttgctggcttactccttttcttttaggtgcatattttctaaaaataaaggcatgatctctcatcaggaaattaacattcactagtcttaatactattatctaatctacagacttaattcagatttcataggtttcccaat

SEQ ID NO: 70552 - DNA, 1019 bp, Homo sapiens
aaaccatccactcataaagtaaattttaagagttacctctatatgaaagaaatcgttatttgtgttagttataacattccttatacctggccacccaaaacaagaaaataatcaagttttcaattttcaatttttttatcataactctggatataaatataactaaaatgttttcagtaataactccatgcacaatgatcaaacaaatgctgtacttgttgtgggctggcatcaacaattatgaaagtggcttggtaaggccaggccagacctttgtaaccagttataccaggctactgttagacagccccagatagcccatccctctgcctcagggcttatggaaacagtggatgttggtaactgaacacttactccctgctgcatgcttcccatgtcatttcattcctgtgaagtgcattttcatatctatatttcataaatgaggagacagattctgaaaggcaaaccaacttgctcaaaataactagcttatatattttgagccagatgcagactaaagtctgtgtaatgctaaaacctgtgctcctagacattatgcaaactgtttcatgggcttacactgaaataatatctgatgaatttctctttgcataagagagtgagctccacaagtgtggtaggcagagcatcctcctatctcagaacctgacacagcgaaggtgctcaatgctggttgaaccaaagtgacaacttgtttatccagctctatcatagcagtaactttactaaaagttctctgttcccttactttttttcagaaaagttatccacgtccccaaacaaaacctacgtccctgtaacaaaaagcttttattttcaagagctgtatctttagccatttttttaattgtggtaaaatatatataacatcaaatttaccattttaaccatttgaaagtatacagctcagtggtattaagtacattcacactgttgtttgatcatcagcatcagccaccctcagaattttttcatcttcccaaagtgaaactccg

SEQ ID NO: 70553 - DNA, 1061 bp, Homo sapiens
caaagtgctggaattacaggcatgaaccactgcgcccagccctgacttgagttttttaaaagattattcttgctacagtggaaaaaaaaaaaaaagcaggggtagcaggctatagagaggcaagggtagaagagaaagcaggttgttgcaataatccggatgagagatttataagagaattattctataaggacactgaaaaactaaatgaagcatacaaggaatcagcttcttattcctcattaattagcaacttgttaatttgtctgtccacttttaagaagttcaagttgatctaagacacacacttagcacagttgtcagtaattaccattcttagcaggaagacttgtaagccagtagagatgaagatggtccaatacatcgaacactagaatgggaaacacaaaatctcagttcttgtccttgctctgctgctgagttaatggactgatacacaaactccgggtacttttgatataactttgaggtcataactaccaggcataaaccaaatacatatattatgggtgcaaactttcacttaaggaatattttatcaaaatgtttacataggagaaatgtgttctagagaagcagagaaagcaatgaacaacataaatcaaattcatatcttggcttttaacaccatcttcctctctggaagaataaacaacatgagacacatggcaaggctgataagtataggattgaaatgctccccatatacgagcctaactcatttacccatttccttttggtctttgcccaatgttagcacctccccaaccacactatttaaaattgcaatccattcatctcaccccatctttgccagtatttcctgtcccccatccttgctttatttcccaccatattacttagcaatatctgaaatatcatgtattttattattttgttttaaattgctctagcttcttccaaaataatgtaagctctctgaaggcaatatgttgggtctgtttatgctcatgcctagcacatatgaggcactaaatacatatttgatgaatgagtggattaatgacaaccaatttaac

SEQ ID NO: 70554 - DNA, 1046 bp, Homo sapiens
tctgacttccagaatatgatacctcccagtaagaaaaagctcttatttcttgttcttactcactctttattaataaatacaattccggtatgtaaacatattcctccgtattcctaataagggctttcctggaacactcacgttgaatcaccctcagatatgtcaatttccttgagtccagcaagaacagaccacttaaaatatttcaaatttgagggtaattaccgtgcacaactttggtatatctctgcagtgtttttatatctgtggaaatgtatttataatttatactgcagcaacaataaaaatctgtgaacaaaatggtgaagtcagtgattttaggatgatccaattctggtcattttgttataataacccagaactagaagaatcttcatatgataaaatggatgatctatgaattgtattttaggtggggggaactcaacttcaacttgtgtgttaaggggaattttttgtttgttggtttgtttaagaattaagaagtagccacctaccctggcttccacaaagctggacaccaaagggcaaattatgttatcagcatttcgttttttctttttccatctttggcttggctttcttcaggttttaacatctctcttaggcaggtgtcctctacatgttggttatctggcagctcaaggtttccattcaactagtggagcagctcagcataaagtgacttttcactttatgctgagtgcctaccatgtgacagcattgtactcaatgtggaaatacatcagtaaagaagactgcaaaatttctacccttctgttgccttttctagttctagcatttgtcacaatagtctcaagtctgagtactactaatactgacttgggtcatgtactcagctatagactaatcattttgccctggaggaatgaaatctcctgactcaccagacctgagacttatatccacccttaaagaagggaagaatcactaatactctaattaccctgattaacaatgaggaagcattatttttccagagaggaatttgagtgcttttacca

SEQ ID NO: 70555 - DNA, 1065 bp, Homo sapiens
atacaacctttaaggggtaattcaaggccccagatgagccagtgttggtttaaagtagcagctaggcagcactgcagcagtattagagactgcagcaatgatattcaccagcactgccatgcaccaccttctgtgggccagcctgagtatacataacaaagtttgttttccttttgactacaagatttttctagctttttaacttagtcatagaccactttatccagctaactgacaataacaattttaggggagttatgaatcttggtgtatgttttcacctaagacaccagtggcacattctattaatagctttatttcctttatttagtatattcatatacaacacattttcctgaattaaaaaacaacaacaacaacaacaacaatgggtaattgtataaccacagttggttgatgctcccttcagttggtaactctggcctaatacactgatttgttctaaatcctatgataaactgcatatacaaaaccagtttagtatataatgtggctctgataccatcttgaattataaattatagcatgctaccaccagtaagtttggtatcataattttaattttaattgtggctgacaattttggggggaataaacacgcataactagggcaatcagatttgaaaaaaatcaatgaatatacataaagcttgattgagcatccacaaatacatagaaaataaattatgcaaacaatcctaagaatgcatttccagtaactgattatacaatccttatctatgtagagtttggaaaaaaaaatctttttttgatagtagttttttccatatggaaatccagtggtcctgcccagaagcagtggctcatgcctgtaatcccgacactttgggaggccgaggctggcagatcacttgagggcaggagttcaagaccagcctggccaacatggtgaaaccctgtctctaccaaaaacacaagaattagctgggcatggtggtgggtgcctgtaatcccaactactagagaggctgaggcaggagaatcacttgaatctaggaggcggaggttgcagtgagctgagat

SEQ ID NO: 70556 - DNA, 1037 bp, Homo sapiens
accaggaatgaaatgtaacctcttttaaagatgaagaaaaactgaaaaaatgagattaagaaaatatgtgggtagtttacagctgctgatagaattgtgtgcacgcgtgcatgcatgcataaacacaaagtgaatctagaagggaaaaaattgagtttgatgaagtctaagatgaaaggttccatttcatgtaagattatgtgaccttggaaaaatttactggcttgctagtggaatacgtccttatatagggacttgaagagtttatctaaatagactgacttaaggatgcttttcctcttgttagacttgtatgacattactgagaagatttagagttctagaagtagagaagactgattagcttgtgcctgtgtatgaagaatgacaaattaagacaaaaggttatgtaaaccatttactaaaaaagtctaaatttttatattcctaggcccctacttatcttttacaaactttgaaggacctgaaattctttggacaccatcagatttagtttataagagttctgattttgaatcaagaaattattcatgtagttttaaaacacaattaaaattttcagtcaggctgaacttttgtgcacttcctcatttattcgagaaaccccaccactaatgtatttagaccttaatatgatggctttgagtcttaaatcattgtccacctaaaataatataccaaataaagatttttaaagtgctgcatatggtttctgtaagaggtacataattagattaccagcattatcctttagcttcaaaagtaaaactcatagtcaggattttactgatagtacaggaagaaaaaaaataaccactgttgaaaaataaatgaaaaaaattttattgagtattactttatacatgcaaattgaaagtgaatctatattaagttgactattccacaataaaaacctatgaaatgggaatgatcaaagctgtctaacacaatactaatgtgttcaataaattatccagatgtttttccacaaatatttggattacctgaattagctg

SEQ ID NO: 70557 - DNA, 1037 bp, Homo sapiens
ttacattaagccgaaaacataatactaatagacaactaacagtttgcttatcaggcacatcaactaaggcacctccccccatgctaagtttctcctggatatatggaagttgattgtttcccagtttaaaaacttgaactaatatctcctaagaaaatctgagtccatattgtttttattttacttagctagaatctcatagcatgttaaagtcatatccttatccccactaaaaataactatgtctatgtgagaggaatatagtatgtgggagctgtattaaatactattacaggtgttacagaatctttaaataaatggacatggaccaactttccatctagtagtgtacgatctatatagtgcatgtcagtagcacaaaatgcagtcttagcattagcctgtctaatctgaatagtttactcaaaagtacttctttgtgttaagtattcagccactgtttttagatctagttaataggttctatttaatttgctacaacatttactgaatggtggagtgaaaaaactgatgcatactgggaaatatctaccattttttaaagataatgttaattaggaaaagaacacttttaaggaatttatagcagtgatgaaatgaattcagttatatcagatacaccaaactgttgatggtatttaaatgtgacttcaagttagtatttctgtatatattattgattactggtttgtttttagatatgtaagtctgttctaatctacagttcacatatcgacagttactctggtaataatagaatgttagtgatgatcacttggtggatgttgattaagtgcctgtgttttgtttcctcctctggataccaaataggtgtatgctacttttttggtgaacttatttcttggaagatttggctatgctattcagggtttttattcttatgtttttcttctaaatttaagtagcatcctgctgctaccatattaaagctaaaatttaacttttgctgaagaatcagctaattcaggtaatccaaatatttgtggaaaaacatc

SEQ ID NO: 70558 - DNA, 1065 bp, Homo sapiens
tacacctttaaagatcagacagtggtaggagtgcatctagaacttgtacctgcaccttttgatgactaatttgacacaaggttgcaacctagggctcaataccatatatggcttgcatgggtagtttttttttttgcctcagttttagggaggggaagtggagtttgtttagctaaaaaactaacttatttatgatgattgaaaattggaagattcacaattttaaaattctgactttcggcttcctttgaaaaactgaaagatctgtaagagttggcctatacacttgttgtaagaacgaagagtcaagtaatggatgctcttttttggtggggcatattacatctaaagttgttttcagagcttgccctcatttcaaaattaattggttgtatgaattatttttaatgtgtattaagtgttttcatctctcctcaaatatttttaagtatttttaaagtgtcttttttttttcttaaggacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaat

SEQ ID NO: 70559 - DNA, 1050 bp, Homo sapiens
gggcaacatggcaaagccccatctgtactaaaaatatgaaaattacccaggcatggtggcatgcacctgtaattccagctacttgggaggctgaggcaggagaatcgcttgaacccaggaggtggaggttgcagtgagccaaggtgccattgcactccagcctgggtgacaagagtgaaacactgccatacatacatacacacacacacacacacacacacacacgaggttaaatcattgagtctattacattagttttgttaaagacttgtataaacatagctttactcaggagcatcctaatatctcctgtgcattctctgattccttttgtggtgggatctttgttccttcaccaaatgtcttaagggattcattggaaatcttcatgtatgtaagatattttaccaaattggggagatatatgccacttaggaagattataaataaacaattacttcctaattactggtttttaattgtatctaccaggaagtagtaagagaaagacaagaaaacctaagacttgtgagactgatgcaagataaagaggaaatgattggaaaactcaaagaagaaattgatttattaaatagagtaagtatttcaccatatttcaggtttggaggggttttttttggcaattggatgaaaatatataaatatgaagaaattattaattgcattattcactttgttcttttgttagtgaaataataattagtaagaggtatcattttcttccaaaaactgatttcctttgggcagttatcagtttagctcacttaattttattcttttggagatagactgatttatggatttgttctctgttttgttaaaatctgagggtgacaggcgctttgtcactaccatatgtaagggcactggcacagagttgcctcaagaaatatctaaaattggccaggcgctgtggctcacacctgtaatctcagcactttgggaggccgaggagggcggatcacgtgaagtcaggagttcgagaccagcctggccaacatggtaaaaccccgactctactaaaaatat

SEQ ID NO: 70560 - DNA, 1141 bp, Homo sapiens
gtaggtgggaattgaacaatgagaacacttggacacagggtgaggaacatcacactctgggacctgtcgtggggttgggggagaggggagggatagcgttaggagatacacctaatgtaaatgacgagttaacgggtgcagcacaccaacatggcacatgtatacatgtgtaacaaacctgcacattgtgcacatgtaccctacaacttaaagtataataataataaaaaataataaaaaacactccatctcagacagatgctttcttccatgtcctccattgtagaccttgtctttatcaagcttggtacccctttcagtatgttcctcctatctccaaatattccagtgcaccttcttggtttgcacaatggcttcagtgttttcttctctctgcacaactttttttttttgtccaattcctattgtcttcactgccatactgttatactttgctgtgatcagttccttagtgtctctacaaagaggtgtgtggttttttttgtttttgtttttgtttgtttatttgtttttgtctggagggggtgtgagttctcatgcagaaacctttagggcagtgtattggttaggaatgtattcagttgcaaggaacggataacccagcccatgatgtgtataatggatagagatttgtttctattttgtttttcttatgtagaaagtgtagagttagataatttctagtgttgcttctgttttttagcagccttctcttgtaagcttttccaatatgctgttacatgtgtaattctctttttttatatatctgcaattccaaattgtagccattctttaaattacaagattttttatagtcttttctaactctccaggtaaaaatactcttcctttatatgctcatagaatataaagctagaaactgggcctttatcactaagttatctatctatctatatatatgtattatctttcctactagattataaattccatttctttaatgcatcctttgttaccttctgcagaatgccttgtttaaggtagacgtagtttacttattgaatgaatgataaagaatgaataaacctttcctttaagaaaaccctgtcactgatgtttggagtttagggaaaagatttgttggcagtggtgtggatat

SEQ ID NO: 70561 - DNA, 1051 bp, Homo sapiens
gtatggcagatacaggaattctcttatttctcatgatttccgccaacttcttcctccagatgtatttatcccagttagaaaagattgcttaagaatttctaggatgcttgttatcaaaagaactgcactggttgctagcagaattttggagagaagttgtgattcatcaagtaatcctatactaaaagctgcctggaacgttagatacatactgtatccacagggatactatgtgtgatgaataggttcccagttcagtggatagcagtgttgccatgggaaagagcattcagaattttaacttcaggtatcacagttcaccttccagttcatctccaagatgatttgtctcatcttggtaactcattcattgttttatgaaacatttaccgagtgttttgtttcttcctttcttttttcttttaatatactggtaagggagtctagttgagggggcaggaggagggaaagttagtgttgtggggctgggtctcagaaaatgaaaacaaagacaaataaaatagcatcccagtgctctgggagtgcgtggctacctgcctcaacttttgctttctgttaatattaatctatgataatttaagaattccaactttaagctaatgatgttggagcctaggtgagggatttttgagtccatatgctggagaataagtgatgattgctttcacacagtagaagactagagatgagaccattctttattcttttccagatctcatacttttgcttctcctactgttcattaaatgattgacctctcctcccccttttaaagcaactccttgatttaaaatgccttttatgctattttattctttctgttctaggacctctatcaggtatttttgttattgtagttttatacattttaacattaactagagtgtttggtcatacctcttttttaaaaaagtaatttttttgatatcttatgtattttttcttccagatgatgcaccactactttccaaataaatttcttcatgattttgattggaattttaatttatgtgttaagagactgttgaca

SEQ ID NO: 70562 - DNA, 1053 bp, Homo sapiens
gtggcatcttagattgaatgaaatacattttttacattatatcccacctctccaggtccccttgtagcatctcaaatatttgtgattcttcaaaacaatcaggaaaggagttattatgtagctttctgtagtaaatcatatgacttttttttttttttttttttttttttttttgagacggagtctcgctcggttgccaggctggagtacagtggtgcgatctcggctcactgcaacctccaactccctggtccacgtgattctcctgcctcagcctcccaagaagctgggattacaggaacatgccactacgcccagctaagttttgtatttttagtagagacagggtttcaccatgttggccaggatggtctcgatctcctgatctcgtgatccgcccacctcggcctcccatagtgctgggattacaggcgtgagccaccgcgcctggccaatcatatgactttcttaatcctgttaatattctataaaatatctgctgtattggagagcttgttttatataagtaaaaatagagaataagctaattgtcataaaacagtaaatgtggtctcatagttaagagaataggctcttcggacagaatgtcttgagttcatatcacagctccatcacttgttagctgtgtaactttaagcaaatgtttaactgctttcaaatccataaagtagggataaaaatagtacctatctcatagggttgtgaaggttagaagagttttgctctgaaaagctcttagaacaatggctgtcacgtaggtgctatgtaattgttagctgctattgttattgttcctttgagttaatgaatagtgttttttcttaaacatttaaaaaaaataccaattgcctttctgtataagcaacaaaacctgagaattcaaggtaaaaatagaatttaatcttatctaatgaaagttaaaatgaacctaacatttaatgatgagtgtgttgtatggtaattagataaaattaggattaaatttttagtcctctgttcattttctttagtatgtaaccaccgccaatgtaa

SEQ ID NO: 70563 - DNA, 1027 bp, Homo sapiens
tacagattacctaaaattactttgtttccctcagaaatttaaagtttgtctgaggtgtctgagttcactgcactttgatgtgttgtttggaaactatcttagggttaggacatgtaaatgcaaacctgtttagaatctaagggaattttaaagcctagtttcagtttagacttcaggtaaagttgtattttctttaccttggatttttagttttactttatgtgaaaatgtttttgctaacaaaataaaaaagcaggaagctttctatctttgctcacagatttttttaaaaaagaatcattgacgaaagtttttgtttatttaaaactttctgaagcacagcactctttaccaattatttgataaagggaataggaaaacaactgaggtagagagaaatggaatgtttaccttctagtgtcctatttaaatcttccacttaggtgactggctcaacagtaacgtgttttgaacactgaagagaggtatgtaaatgaatacttcatggttgtaattgttaggcatataatttgatgcaaactatgtaatgagagaggcatatgattatcattctttaaaagacgctgcacaagagcatttttcagtaaatgtcaaagttgagacaaaattaacttgttttatgtagacattttgttttctgtctttcttataaaagtcttgttctgtcctcctgaaatgagatcaagaactttgggtccttttaaaataaagcaaaacccaatgatacgggattttggcaatttaaacaaatctaaaatttcaattacaaagaagagaaaccacataataagcacatttgtactgaaggaatattttcccttctaaacaactgatgtatgttaatgtttgatttgacacatctgaatcaatagtgttattgtcttaccatttgcttcatacgaacttgtgcaaatttatagagcagcatgacacatagcagaccaaaatccatgtttgttcacctagtaattatttagtccaatgtcagtgaaatattttttatttt

SEQ ID NO: 70564 - DNA, 1057 bp, Homo sapiens
ctgtctcaaaaaaacaaacaaacaaataaaaaaacaaacacaaaaacagaatttcttacagttggaatattaatttatttttttaactcaaagtagaaatgtgatttcaaatactttgttgttgtaggcagataaagctatgaccataaatacgtagaaaactatatttttaattgaattgaagttctatattattttattactttactggtgatggagaacataaatgtgaattcatgatacaacattttaaattcagaaaagaactctttgtcaaatactaaatccaattctttgcttataagccaggtttcactccctcacaaattaatttaaatcctcccaggaatgcacagtgtccctgccaaaggttttcacatggtgattgatgaaaagatttgctgaagaatatgcattctttttaaatacattttaggagcagtttaatatagaggttggaaaatgaaataaattcatgatgctccatattttgatcatgttttgtgattgaactttttccaaagaacttttgaaaaagacacattcccttcagaattacaaatctgaagcttcttcacaataaagctttaaaagtgacttgtattgaaagcttttctttaatctgctcacatccgcacatctcaggttgtggtctgtattgcagggtatatttagccaatgagtatctttgtattacttagtaaattaaatattttaattccactaatgctgttgaaaggtttttagggtcagttgtaaacttaattgctttcagcttttctttccttttttattaatgtggtaacatatacgtatataatataaaacttagcatcgaaccattttaagtgtagagttcagtggcattaagtatatttacattgttttgtaaccatcaccattatccatctccagaagtttttcatctttccaaactgaaactacgtatctagtaaacaataactcctaatttcccacccccctctggccaaccaccattctactttgtctatattaatttgactactctaggtactttgtagaagggagatcatac

SEQ ID NO: 70565 - DNA, 1436 bp, Homo sapiens
aaaagaagacatcctgtttctcctatctgcttcatcctttagtttgttgtaatattacatatcatgtaaccgttggaaactttgtgtacactcatgggagaatgaggagagaaaaggcaagtaagattttagcattctaaaaatagtttgaccttgcggatcctctgaaatggtcttggggactcacaggggtgcttggactatgatctattttattattggttgcaaaatggtggtattctaattcattcctttgtaatttattacctggaatattttatatagagaaatttcctttcatcagctgttttagttaccttgagatacaatttgtacaaataagatagcctagatgcttgattcttttcctttaaggagacagaagctttattgcattcattttactatgtgagaaagagatgagaagactacttttaagccccctttgtactaattgaaaccgcctccacttaacaagtgaaggaaggactccactaatacagttggcttcttaaattattaagatgcagtttgtatcttagaggttgcttattttagtactatatcaactaacactatataatctctttaagaaacttgcttgaggagtctaaaaaggattggaagctttcaagttatctgatgatactttcacctatttccttgtgaaaatgcaaagttaacaagataatgtctgcgattagcttaaaatgcttatttattgtgagatatattactattaactccatggaagagaaaaatcaggctctgttacgggatattgagttttgctgcagtttgattttataaaactcaactaatttgcttccagaattgcttcaaaaacttgagcgctcttgaggcaagacagggagttgtaagctgtcataaatgatacaacccagagactaagacttggaatggaatgaagtctggagagaggagatgtatatcagagtagtgtaagtaataggttaattaggcataatgaaatttcagttcttgttcttaaacacaaatgaaaggggaagttcatcttaattccttacttgtatatacttgagatgaaatgtgaagtcagttttcctctatgtaacaatttttattttaattgacttacggaatttttatgatacaatagaaatacgttgagacaagtttattgagccaactatctatacatcttaaaatatttggcagtttaaatagtcatttaatgtgggttagatgtgggaaggatgtgagttgaaggatggaaggaagctggaccaaatagcataatctgtcagcaaaataaatcttttctagttagacttaatctcttgttgtttttggacctgatgaaaattgttttagagattggaacttaatagaatagttatggtttgaagatatctgttttagttatgtatttgtagactataagaaaagtaaat

SEQ ID NO: 70566 - DNA, 1167 bp, Homo sapiens
gagaaaccctgtctctactaaaaatacaaaattagccaggcgtggtggcacatgcctgtaatcccaggtactcaagaggctgaggcaagagaatcacttgaacccgggggacagaggttgtggtgagccgagatcgtgcctttgcactccagcctgggcaacaagagcaaaactccgtctcaaaaaaaaaaaaaacaaggaaaaatcaaatgaacaaaaggaaataagatagtattatcaaccctatgtgtgaacatgttaactagcttcagttatttttaatttatggctcatcttactttattgatttcctccaatttttattgttttgaggcaatactggatatcatttcatttgtagatagtatgaatttattaaagataaggactcttatttttaaaagattactccattccactattacatgtaaataataattcattaatatcaaatgtccaatcagtgcccaaaaattttcatgggtatctcatatatgtcttttatattttgtccaaataagatctatacattatagttgcttgcaatgtctcttaacttgtaatctttacattcttcctgtattattttttcacagtttatctgttgaataaagcttgttgtttctcacagtctagattttgctgaatgcatcccccgtggtcttgtttaatgtaatcttgtaaactatttcctataatttggtaaatttagatttaaactagaggtttgatcagatccattcattattattattattattttgacaaggatacattatatgtggtattttgtacttccatccgaaggagtaaaagtctagtcagttctttttctatgtcagcaatcactggtaaattgcctagatcagctgtcaactcaaaatattaatatctgagacaggtgtcagtcaatttagaaaatttattttgccaaggttaaggatgcacctgtgacacagcctctggaggtcctgacaacatgtgcccaaggtggtcggggcacagtttggttttgtacatctagggagacatatgagacatcatgtaagatgtacttggttccatccagaaaggcaggacaacttgaagaggggaaggggcttctaggtcagaggcaggtttgccctaagcagttcccagcttcacttttcccttcagcttagtgat

SEQ ID NO: 70567 - DNA, 1010 bp, Homo sapiens
tcatttgatttttttctttttttaaagaacacttgagaattactcaactaagtttagattatctagatgtttgttagagttgctttcgttggaggacttgaaaatgaagtatgtataatttaagatggttattagaagaggagtttttttaaatatatttcttagttatttaaggtctgcagatacgaaaatcatatgtcccaaaccaataatcaagatataagataatatggcaagttgaaaagatagaacagtgtatcttgaaatttgcatagtcctgagaatagacatggccctactctgtaatatggcttattccctccatgcagggaaagttctgaggcctctctaattcttaaatctattttgcaaattactttttaagttctattaacatcattgtacaagaaaccctcaatttaatattgttggtcttatatccctaatctttacataatctgcactgtgtggggaatcttctgcatagctcatgccagtaacttttagggctattttttaaatatcaccaagactgaagtcattcaagccaaaatgtgaagactaaaatctttgatgtatctgaacagaaaaagataagtgaaattatttaaaaatgtacttcattcttcctttccctagctttgtttgttttgaactgttttcttcataacagcacacagttggaagtgcatgtgtgtaaatatgtttgtatttgattgggatgagagtatttccttccaataggaataccccaacttgttgtctggattcctctccttatatttgtattctctatacaggggtccccagctcctgggccgtagacccgtactggtccatgacttgttaggaaccaggccacacagcaggaggtgagcagtgggcaagcgagcaaagcttcacctgtatttacagccattccccatcgcttgcattactgcctgggctctgcctcctgacagatgagcggcacccttagattctcataggaacacgaaccctcttttgaa

SEQ ID NO: 70568 - DNA, 1224 bp, Homo sapiens
cagctactcgggaggctgagggaggagaatagcgtgaacctgggaggcggagcttgcagtgagccaagatcacaccactgcactccagcctgggagacagagcaagactccgtctcaaaaaaagaaatatgattaatttgactcacttaataatggttgtggtaattgagaaatttgacatctaacttgatatttgataatattaagtaatcatttttcattattttcgttgtggtagtggtttagtgtgtgctgtagaagaattgttttagagatatatattggtatatttagagaagaaatgcctgggatttgcttccaaataatataggacagatagtggtgggaaagtaatagaaatataaatgaaatttgtacttgttgaaattgcagtaatgaacaaattaggattattttattttctctactgctgtacatgtttgaaatacagaaaaaaattagaatcttttttttttttttggtgatacattcaagttaataaaactgattctcgttgaggggtatggatgtgatctaatacacacaataaacttgatgataagtaccttggagaggataaaacagggagataggctatagagagtagaggctgcaaagtggtggtagcactttagggctggcaaggaaagcctctatatggagcaaggtatttagttgagatccaaactttggaaggagccagttaggtaaaaatcaggggaaggagctggggtaaaaatgttctaggtaggagaatcggaagagattgtggggagaaagaaaacaaaacaaaagttctaggtggagggaacagacattacagaggttttgaggcaggaaacttcaagtattcaacttaaagcaaaagttgggtaggtgagaagagataaagaccaggtcatggtagagtttggagtttaagtgcagttgggagctgcttgttggttgaagcagaggaagtacttgatctaatttttgtttcagaaagatcagtttaggttgtaggtaaagaatgggctctgtgtacgggaaggagagggcagaccactacagcaatacaggagagagtgaccaggtgggaggtaggggccatggagagacgggattgcgtatggaatatgttttagaggtagagctgacagcactttctgtgagaagcagagcaatcaaaatgataattaggttttcctttagagcaattgggtggatgctgatgccattaac

SEQ ID NO: 70569 - DNA, 1090 bp, Homo sapiens
agggggccatgggccgggcacagtggctttcacctgttatctcagcagattgggagacttaggcaggaggattgcttgagcccaggaattttaggctgccgttagctatgataatgccactgcacttcagcctgggtgacagagtgagaccttgtctctaaccaccatcctgtgcctcccacccccgccaaaaaaaaaaaaaaaataccctaaagggagccattaattaaggaagtcaataaaggctttacataacatgaggtggtattatgctttaggtctcagttggtaagaaagattctccaagtgaagaggggaacagggtaacatttcaggtagagcaaatagcacgtgcaaaggcacagaactgggaagtaatagaaataataactttatattgcatgcctgctgtatgtccagaactgcacagaaggctttccatgggttacatctaatcttcacattaactcatgaggtaggtttttatttttatcattttacaagatgaggaagttgagcctcaaagaagttatgacttgcccaaaggccatcctggcagaacttggctttgactccagatctgtttgggtgccagtgcccacacattggttatcattgttggaaataagcaggatatgttctaacagaggaaatggtgatgttcagaaaattcatgatggggagtgaatggagaacagttaaagaggattgatatggaccaattgtgttggattttaatgccatgccaaagaattcagactttattctgctgttcagtattgttgactgggtacttccttcctctgtccatatctgtttatgcaacaactctcacaggttttggaaagaaaacagttttgtctgcctaatttgaaatcattaaaaggattgtcttgttcggaggcagatattcaagagtagtaaacaacacaaaatactgtgaaaataacatatagtagaataaatcaaaatttccatatgcattaaaaagaaactagaggataggatctaaacaaagttgtaccaagtgatttcttttgatgacaaaaataattatataatgaataaatttgagtgtttgggggtagag

SEQ ID NO: 70570 - DNA, 2402 bp, Homo sapiens
tcccgggttcaagcaattctcctgcgtcagtctcccaagtagctgggactgcaggtgtgcaccaccatgcctggctaatttttgtatttttagtagagatggtgtttcgccatgttggccaggctgctctcaaacttccagcctcaagtgatctacccgcctcagcctcccaaagtgcttggattacaggtgggagctaccgtaccaagcctatctatgctatttattatttctgcattttttttttagcacctatgatgtgtgccagaaaataattatgccatttaatagcaaggttgatataatgttttataagtataaaattattggcaaatattagggtttgacattttctctgtgctttttttccttttttaaaaattgagatataattcacatacaataaaatttacccttttaaagtgtacagttcagtggttttttagtattcacacggtgtgctcttaagtgcttttatattttcatctttatttttcattatgttcttagaacctctggtccctaaattttagctttcctttcagtaaagtgatatggtattcaaattatgagaagccattaacttaaaataatttaatatcagcctttcccactttacagagaaaatgaaattatggtaggatctcctcaattttaagtttcttaaaacttgggcacctactaccatttgtttgcagtggagtttagtataataggtatttattaggtttgtgcaaaagtaatcacagtttttgccattgaaagtaatggcaccagcctaatagttggattacttttgcaaaaacctaacaatttaactgagtgtaatactttcaccttaataaaacttttacatatctttcatggagatctgcaaagctctgtcatctaaacatttgggaacattgattcagagttaaaaaaaaaaaaaaaaggagtttccactgcttaccactttagttacagtactagaatcagtgtcctaaaagatgtttctggggggaccatctctaccagtatcacttttgccatttatttaaaatcagatttctggaatccaccccagtctgggttagggatgttatctgagagtctgcattttaacttgagtgattttggtacacactaaagtttgggaagaactaacttaaataccctgtactagtttactgatccgtcaaatgaaatgaatgctggttatctaacaggattgttacatgaattaaataaaatgatgtttgtgaaaatgttataaaaatgcccaaatcagaaattgtagttactgtataggttaatttcctatgaggttgttaaacattttcatttttttcttccaatttaaaactgtgcatattttaacagacaggttgagctacttggaaattcaaagtactttaaacatttatgtaatgtcacatacttagtgcaaaatgctctgtctgctttgcctcttttccagaatttagacaagtctagactacagaaacacctcaaatagttaatgcgtaattagaactttactttcactcatttttaatttttacatatctttaagtgaaagcatatacttgtgtttataaatgtatttgataattagcaactcaaacttttaaagcattgtgtttgccatcttatcaaactactatcaagtgcaaacatttttcccattgattacaaatcttacatgttagacctataggcatccttgactggcaattgattttgaacatatttggttaactgctgagtcaactttctgtttagatcttaggcaaatgtgttatagccatatacctacatgtatagaattgagcctcagccacctgttacattctccttaggctatgtaaaaatacacagggcaccatggctgaacgacattgtaggaatatttaaattctaaaagcagcaaaatcacacacttcaaaggtaaaaagagctccagcaagttcaaatcttagcatgtcagttgactagtaaaatgtttattctgtgatagtttttggagattttgtccagcaaaattttgtgggtcacagtgtatttttcaatgatagtctcatttattttaagtagttgaagaaatagggcagttgtattctgaaaattaatattttgttaggttttgctgaagtgaacagataggagagaatttatattgtggattacaattctgtggcagctgaaactttgttttcaggctcttcataataaattctgtggggccaggtgccatagctcacacctctaatgctaccactttgagaagctaaggtgggagaatcaattgagcccaggaggtcgagcctgcagtgagccgtgactgctcaactgcactacagcctgggtgacaaagtgagaccctggctcagaaaaactcaaacaaaacaaaactctagggg

SEQ ID NO: 70571 - DNA, 1030 bp, Homo sapiens
ccattgagtagggttgtgtgaatgggttaatggagatgggtgccatagaaaatgtaatctttgaataggtagaggtggcactgaagttttggtttaagtataaaagttaacatatacagtatttaaaacttctgttttaaaatagtggttggctaaagtggtttagctttagtggttggctaaagtgctttatgtactgaagttcacagcaatctcatgtggtagttacactgtttatcactatttccagaggagaaaatgaagacttagagcttaaatgattcaagatcacatagaaagtaactgatagagcaatattttaaacatttttgtgtattttgtgtgtatgtatatatctagggaaaggggagtttttaaaaattaacctacttttcattattcagcatatttccctagatttttacataactttttattaaagattatcttaagtaatttaaacatctgaatgaggaaaacagtaaaggtatggaattgaatagaatttcaggtcaaatttgtggactcagagattgcctctgaccctctaacctatagagtggcaaaattttgaacaccaggctctcggcaaaacgtaaatttatttttggctagtggtcagaaaatgtgaatctttgattttacctaagtgatatattgtttttctatcaagatggggtcatgacacctactccatagtttgaactcgtgttggtgaaagggaagataaaggagcatttaacatatagaaagcacttttaagtgaacacaggttaggtcataattatttagtatgtttattgaacattatatataggacaagttccacttagtaaactttataaatccaggtggattaagaaatgccttttgttattcccattatgctccagactgtctacctttctgtgtgatgagtcaggagagaaactaataatgactcagagttggagaaaatttgattcgtgaatggggtagatatagtgtaaacactgagactgtttagtgtaaaacctgggctattagccca

SEQ ID NO: 70572 - DNA, 1349 bp, Homo sapiens
cagcaaaactgtcctctgcggtttgctacttgcacaaaagatctgttattcattaaattgctttagaaggaattcgtaagagtggtaatcaaatttctaggtgttttttttttttttttttttagttaaaaatatgaagattaaggggaaattgaagacaaggctttggaaaagctacattcctcaacttgatttttaaaagtagctgatgatccaaataaaagaatttgtcattttcaatcttttcctcattgttcatctgacagcggtcttattttgggaaatatcttggcagatgttaaacttcactttttttctggctgcatgtgctaaaattatttttcaagtactttttttttttttaaacaagggtaatgtttactgggggaagtaagtagagtgtatcttgtgagatcctaagaaacatcttttgttaatacccctgctttgagtaagagaacatagtgctgagaatgtagatgacttcccactacaatggagtctaatactctggaatgtttttcgtttgggtgttggcaactcctaaatttaatcttccctgaaaacaaacaaaccaagggtacctttttttttgtctgtagagtttgaacctttttattgaatagggaattgaggactgctttcttttagtggtaactatgtctctgtccgtttcaagctgcaggacccaacaaaacagtaatgcttcactacagtatctaattaacagacatacttcttgagcgcctcctcctcatattttcttatttttcaaaacaacttatgtatttcagattattttaatagtggtaaaatatatgatgcaaaactttaaagctgagccattttcatgtgtttatattgttgcttttttagaattgtgccatttctcctggtagtttcaacattgagaataccagttgctgtggagtttcttgtgtaatatttaatttagcacccctgttttaaaaagtcatacatattttgcaaatttttcgggtatgaaaataagtaaaaagatgaaaatgaccaatctctttatattcaaaagtagactttattttatctaatgtcgagtaagactcttattttcagacatgattcccaaccaagtctgtattagtagattaacatgtagttcatatgtagagatctggttttaatggtggataaacattaagttccttcaaggaagtacttatgaaacatctgtgtgatacatttattgtgactttcattacctcactttactagttatagagtgtatatataatactgttataaaggtatctgacagcagctaaagataccagaattgactagaagatagttataggcaaggaaccagg

SEQ ID NO: 70573 - DNA, 1093 bp, Homo sapiens
caccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagaggtgagccgggcgggggccgcagccggaccgggccggggcgggcagctgcctcccggtgtcttcctcctgggagctacccggggcgcagagtttacctcccctggctcgtacttgtcccttcaccgagttaggcaggcagggggtgatggagttttactctgaacaaatgcttcctgggaagttccccaaactcagagtaggacacgtgcttttcaggcttcctggccaggtctcagatccaggatccttttttaccgtggtagaaagacaacttatggctccaggacttgcccacctggacttggctgacttggccacctggacttggctgtttatgcttgatcagttagaaaaattgattaatggtgacgacattctctagggtctcacgtgcccatgtgaagttaccagtttatttctcctttcttaccaatgtttaataacatctgtaaagaaaatgttgccttagcaatatccaagacagctttatcttacagtgagctcaagatgagtatatccaaatgaatacgtgcactattttatatataaatcagctgtttataagttgtgctcctaaacacacagtgtttttctgagtgatacttaggacaatagggatgatttagtaacccacaattctgttcgctaagacgatctctttttgagtactgtgtctgaaaaacatgtggtagggtttttgtttgttttgggttgtttgcagtttggagcattttcgaaacgttacaggtagca

SEQ ID NO: 70574 - DNA, 1031 bp, Homo sapiens
agatgcatctgacttaaacttttataatatatatactatacacatgctctagtagtatactagtttatgtgagtgagtatgctattactttcctcaacagtgaaaaacaaatagaggtacagagtaggagaagcctcacacaaagataacctggcagtacaagttagtgcactagtattcaatattgtccaaattttgcctatatctaaacattatttttacaatttctaaaaattaaagcattttagcaaaatttgaatttaaatttggtaaaatccattaaataactttgcaaaccctacggggacactgatctgtaaacctttgacatggtcctttggattcaatcacatctagataataaatctcagcttcatttgataaaagtcaattacatatatccaaagcatcttgttttaaaaaacatgttattgtttcttcttaaaataccttaaagcaaaattttggaataatttacttggttaccataaacacctaattttttactcagaccagtaagggagaaaggtttaagaggtggatttcagaggacttccttgtcccattggaaagagcaaagtaaacctctgtaactatgctgccacatctgtcctaaaggactccagggacactgacctgctactcatatgaatctgctttgtttatgaaccctagttgctgttaccagagaaggaaagatagggaaaagtggcaggatgtttataggcgtcatatgcaaaatgtgtttgccatagaaaagacaggtggtgtgggctagaaaatgttgtaatcaatacttgataatagctaataattattaagaaaatattataatttgttggaatgtcaggattatcactaactgtggatacttaaagtttacgtaatgcttctcaaaatatcatgaggtcatctgggccatttgtcagccttcggggtcagactaaccttgttacataatgctcttctgcataagaatgttataatctgtgatttgtccttttggctgaagctttagtcctgcgtatctc

SEQ ID NO: 70575 - DNA, 2644 bp, Homo sapiens
aatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgcagaatctgagaactagtttttttatgataataagtgggtaaaaattaataacagtgagtttcagggtagttgctttgtagcacaagatttcgcttccataaacattgttttttttttttttcttaaagtaaacctgtgctttttcttatctgcaaacataggcttagcgatacatataaaggtaatattccattgaaacatacagtttactttaatattagatcattttccaatttagatttgtccaaggttcgacctgctaacacatctataaataagaggcacttttagccaggcatggttgggaggcccaggcgggaggatcacctgaggtcaggggtttgagaccagcctggccaacagggcgaaaccccgtttctactaaaaataaaaaatgagccaggtatgatggtgcaatcgcctgtagtcccagctactcaggaggctgagacaggagaatcacttgaaccagggaggcagaggttgtagtgagccaagattgtgccactgcacttcagcctgggcaacagagtgagactccgtctcaaa

SEQ ID NO: 70576 - DNA, 1003 bp, Homo sapiens
gaataacatggtacttaaaagacgatcagtaggattctgtctactttttaaaatcacataccctaaaaacattaacatttacagtaaatgtactgcttgactaaatatcagcattatttattaatctgggaaagagtgtcttggaaatagtttcagtgtgattaaactaaatttaaatggtttgtatctgaaaggtgaccggcaagagtcagtatcttctgggcggtatgacctaaccagttttacagctcatcaattactgctgcttgctttttgcataacaccccagaatgcttatcatttaagggagaataaaacagtacactgcaataatgtgttgtgtgttggctttgcctgtcactctttgaaacaagtttaaaataaacgctgcagttgcttttctattacattcactgcattaatgctacacataatgtcaacctaaatacaaagctataaagtcagttggataaataatggctagtacacattgtgagtggaggaaatgagcttctcttacattcctctgaaattgcaaagtacacatattttaggcatgtttgcttcttgcttttctgcttctgtcactgtaatatgattgcatctttgtgtgagttttgtttttcttctctgtacagtcttcagtcttgagtattgattcactctaagttttacatgaactcaaaaagtagtttgaatatgttatgtagcatcttcccagaaagtcaaagctttaaattaagagcttgtactctaaggataaagatcttcatatttatttttgtcaaattttggaaagctctttacatatcactggcatcacatcttttctacactgctcctgattggacctttaattctgaagtatcactatttcacagtatagaagaagacttaagaatataataattatataactaacattggtaccttaaatcgatctaggaacgaagagctctagaaagaagaatatctgaaatggaagaagagctcaaagtaagta

SEQ ID NO: 70577 - DNA, 1639 bp, Homo sapiens
cctagagtgtgagccaagaccaagatagctgtgggagaagataaaaaggccagtttactggtctggctgcatggatacagagtcattcaacctgctgatgaatatatttcaatcaaggtcctggaatctgaccattctgattagccactcctgatggtgtaggaaaggaaagaatttgagcttcagaaggaaagctacagtttttttttgtttttcttccacatactcactcaccctcacgcccaactaaactatgaaagttcctggggaaaagtgatagagaacataaaatgagagctctggttaccattctatttctaaacattcattgcactctttattattttaatacaaatcctgttttctctttgctttactcacgaacctgtgttttactccacttgaatattgtgatttaatacctattaaaagagaattactgtggtcacccctgaacttttttgcacttatctcttttataatttcttactttgttgcagagacaagaaagatttgctgatagatcactgttggaaatggaaaaaagggtaagtgtcccacttattaaataattatttttttctttcttgttttaggtaaacaatggtaggttttttgtttttattttgttattatggatgacagttttaattagtttaaatatttattgagttaatgtattttgcagcaacttctttatagaattctatggggtttctctaggtatgaaatgaccttgttaaataaaatttaatttaccacataattcttttaatgaatttaaaaaaactgtcttgccttgattctgaaatgtactatacacattttgatagtgaatttgatatttttgaaatgccgtttatctcttatggcctgtacctaaaacgttttaatcataaatacatttattttaattctttataaacctaaaatactttcgttcttgaaataaagtttctaaatctggaacatcaaattttcaaattctttttaaagttaatttaataattttttaaaattttgagtttaaatatttaacttaagtaggctattttaaacaaaaaaaagattacaagaaaatccttatgccacttgatgtctttctgcaagtttttattgattgtaatacattcacttgtatttctcttcacttattgttgctcaaaggtctaggagtagtcataggaataactgtacaagtttagcctcatcagttgaaaatgtataaatgatccaaaagttaaaggaaaagtgcccaaagattgtttgtagtgtagctgagcagtagctagacttggtagggtttcgaccagagaagaaatgacatgctggtagctatgatcaaagagtaaatacttaggagctattgatataaaaacatttttcttccattctattttaaaataaccaatttgcccttttcaccaaaaaaaagagaaatggttaaaaaaaaagaatataaaaatagtgttataatgtctgtcatttgctagttgtaccttgcaatagctaccattttattatgctttctgcaagttttaaaaattagtgttctgagtcatgttttcaaaatggacataataattgctaaaatattgttttaataaatttaatattattatatcctgttagaatattt

SEQ ID NO: 70578 - DNA, 1025 bp, Homo sapiens
ataaatacagctggtactccgtctcatttttgggaatgcaagagagagtgatgggcagaaaatctcacggactccaaataaagatcacagtgactccttagccctagctgcagttgctgtgcaggtatgtggtccctctttatcagataactgaatcttttttaagataacctgaaaagtccaatttttctgtgaagtcttgatttttgaatactggaactaattttaagactttatatgggacaaacacacttgcataacgaacagtctctgctttgcaaccatgaaggattttttaaatgtatcctttatagctcatatgctacattaagctgttttaatattgcaaagtaatcaatgagaaattttaaagtaataggagagcagaaaagtaatttgttcttttaccctaatttttatagctttatgaacaaattctagctgaaaatgaaaagctgaaggcacagctacatgatacaaatatggaactaacagatcttaaattacagttggaaaaggccacccaggtttgtacccttttctttttgttactctcaaggtaatggttgtgatttatcccatctaaaaatggtattaaaattttttctaatactctaaatagaagtttgataattggtaatagaagataatgctgtttatggatgatttactttttctggagtaaatttaaaaaatagtcatagtcaaaagtcaacttataaaaagccttttaataccaatgttgtggtatgtcaaggttttaaatgtttatttccagaataccaaatgtagcaagtcattaaaacattaaaagcatctatacagaatcatcttatagccatataaaaaattttataatagtttttgtttactacaaatattttatgtttgttcaagtaaaggttattttatattatagtgctggaagaagataattttaatcataactccttttgtaagttccttctatgcagcagtctagagaagataaatttggacaataaaattgggatggccaagcaaaa

SEQ ID NO: 70579 - DNA, 1109 bp, Homo sapiens
tttgattaagtattcagaatcttctcttgtagccctgctttagacaaaagagaaccagtgaagacacttttaaaaaagtgtcatctagctcaacccttaatcctagcacttggggaggctgaggcaggagcatcacttgagtccaggagttgaagaccagcatggacaacatcaagactccatctctaccaaaaaaaaaaaaaatttcttaattatccaggcataactgtatgctcctctatttctagctgctggggaggctgagtcagaaggatcacttgagctcccaggagctcaaggttatagtgagctatggttgtgccactgcactcctcactggatacagtgagaccctgtgtctttaaaaaaaaaaaaaaaaagtgtcacctaattcaaaattatccatcttttcagagaacctccactatatccttgattttgatctccattccatttctcttatcattgttaaccacagccctgtaagaccagtaataaatttctgtctactgatgattctattgaattgaaatgcagagccaatggcatctttcagaaaaggtaacctgaatttcagaaccagataataagagaattctcctttaccagtaagatatgtttttcctgcttaggacaaacccattacttgtcactttggatatactttatttcatcaaatctaagacattactcattttaaaacaccattgtgttacctactactgaaaaaaaggaaaggtgctaccaattaaactataatgcatcatcaattgtaagccattttctggttttggaaatattaaaatgtgggaggaagtgtacaatttaaaatattaatcattatatgaaaccagttttggcttttaaacatggaaattttgactctcttcctcaattaatggaaattagtagtattaaaaaaataggctgggtgcagtggctcattcctgtagtctcccagcactttgggaggctgaggcatgtgaattgcttgagcccaggagttcaagaccagcctgggcaacatggtgaaaccccatccctaccaaaagtacagaattaggcatggtggcatatgcctgtagtcccagcaacccaggaggctgagg

SEQ ID NO: 70580 - DNA, 1918 bp, Homo sapiens
agacagggcctatcactgaactgttgcagccattttgctaccaacatgggccatgtgtcatctcacctaaacctagtaactgctataccatgagaaaaaggaagaatggatgtagataaataaataaggtgcaatgtatgtgcatagatcaatattttctatattcacatagatattatgtgtccagaaaaggttggttagataacagtggttatctagagaatggagggatgaggaattacacaggaactttgtataccattatgtgaactttacaataccatagtcagaaagatatttctgaatatctttctatatattttaatcttttttatctttaaaaagatatttttactttggaaaattaatcttaaaatttggggaacaagggcgttatgctaaatgaaataagcaagttacaaaaagacaagaactgtgtgattccacttattttatttgggtatcatagaaacagaaagtagaacctttgttgccagagctaggaagaggaggacaaaggaagttgttcattggatatagagttttatttttgcaagatgaaaaagttctagcgatcttttgcacaacaatatgaatataattaaaaatactgaactatatactctaaaaaatggtttacatggtaaattttatattacgtggtttttaccacaattcttaaaagtttttaaataatgctaggccgggcatggtggctcacacctataagcccaacactctgggaggctgaggtgggaggactgcttgagcccaggagttcaagaccaacctgggcaacatagggagacactgtctccacagtaaatttaagaaattagtcggatgtgatggtgcatgcctgtagtcccagctaactaggaggctgaggcagaaggatcagttgggccaggaggtcgaggctgtagtgagctgtgatcatatcactgcactccagcctgggaaacagagcgacacctcatctcaaaaatagtaataataatcagtgataacaccatgatttttaaagataatggaatttgagtgatttctcactagactttttattgttaaaatttaaatcagtgaatgtaagtgcagactataaggtaagatgtattatttttgtttgatatgtagacattttagttcaggaatggccattttactgaatttgattatcttgaaaattgaaatttattctttaaaattgttagttgttgttaaaccaaagaataaatcaataaaagaaaacattaccttaaaaaacaatgtaaggagcaaagttaaaattggttttgcagaggaaatttacagactttagtaaaacatttttagtccaaaatagactttaaacaatcccaaaagtaacctagtaattttacagtatctccaaagataaatataatgggaaatcactaatatttaaattaagaagtttaacaaaccattctgaataaattatagaatcagtgagtatttcaatagaaaaagaaaaggctaaatttgactactgaaaaagactactttggcccccagtaagactgttttaccttattaatcatttcacgatttagataagactttctggaacttcagtgtagcataccacttgcttgagaaaattaaatttcctgtcacctaattgctgaccttaaaggtatatagctagatttcgagaaagtaaattttaaacaaaatatgtatatactgttatgcataaagaaccttaggtgttcattcgtttgcttctattgatactacattaaatttacttataatcataggttaatagtttaatgaaagcataaaaatttagtatgcctatgtttttctctttctttccagacggattccatttctaggtatgttttatttattttttaactgacatttttttcttatttttatctttgttaaa

SEQ ID NO: 70581 - DNA, 1019 bp, Homo sapiens
atatgaaaacaatagcacaaaaatatgggaaagtattaaatggagttgaagagttttagtatcttcgcattgtccatgctgtggacaaaatatatattcaacttgatgaatcaagagtgcatatgtctatttaaaaaagtttaaaaagagagggaaaatcatacataaatgacaaagaagggaagaacagatggggaaatcggaaaatagttttctatttttcttttgatttttaatatagaaaagttaaacatatactttatagaagtaacataatagtataatgagccctacccccagtattcattttttcagctaaattcccactccatctcccaactcccatattatttagaagaaaatcctagacatctcattctatctacaaatgtctcaatgtatattctgagagagaaggactcccaaaaataattttaaaaaataaattttgaaattattactaaaatttcctaaaatataaattggcaatctgtttttagagtgatgaaaatgaacaagaacaacaatcagacacagaagagggatccaataagaaagaaactcaggtaaataccattactttttgtattgagaagtattcatattttttaataattacttttaaattgcgttttattatgtttattcatgcaaagcagttattgcatactctacctacatgctgggtatgcaatatcagtgtttgcctggggatcaggattaaaaggactgggaagggtcacaaaataatgttttggaggtgatgaaaatgttctgagtcttgatcctagcagtggttttatggatatacagaactgccaaaactcaccaaattgtacactctaagtggatgtaatttaatgtatgtcatttaaccttcggagttaaaagaaaaagcaaaaaaagaaatagtacccttggccaaaggaaaatatctaaaggataatcagaagtagtggaaatccagaagtagtaggctcagattttatttctgtagattttatttcaaagttatgttc

SEQ ID NO: 70582 - DNA, 1103 bp, Homo sapiens
ccttaatatactttttctgtctttatacttttcacttcttgaaatctaacctgttcttcaaggtcaaatcttgaaaaatttatcgaaatctcttttaagccttaacaatcatcatgcatgtgtatatagatacatatacacacatatatatacacacacacagacatatatataaacataaatatttataatatacaaacagtacagatactggctattcttctctagtttgaacttgtggggaacatttatatgcatagagtatccagtacctatcgttgtgcttgctaatggtgattcttcatagaatgaatgtaacttgctgtttccatttgcaaaccaattttaaacatgcatatttgacttttaatgcatttgtatgtaatatatctatttctaaaatattccttgaaacaagctttaatgcatctcataattatattgatctttttgtgtgtgcagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgaggtaacagtatatcaaaagcacatttaagtcaaatggtatgaatagtccttatgatccttaacatacaagagatttatataccaacaaaccatatgcaaaatactgtaaaggattttagctggaaatttgaattactttggcgtgattagtatactactttttctttgaaatgaatttttaagtatttttatgtttttaattgtgtttaatgtttcaaatgggttttgatcttaatgtttcacagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagaggtaagaataccaaattttgaaaacact

SEQ ID NO: 70583 - DNA, 1022 bp, Homo sapiens
ttagattatcacttttgggggatgttttcagggctggagaagaggaccttcctcagttaaaaacagacaaaaaatttactccttatccattctgcttaattgggctaaatgaaatccttctatttttttcaatagagctaaaatttttaatcttcagttctctaaatcctttttaaaaatgtggttccatcttaaaattaaattacattattttaaaaaatgtagttaggaagttaaaatgtgatgttaaaatataattattaaaatataactagttccaatctaaaaagaaattataagattgcattattgaatttcaaagaccattttctgaagacttttccttaaaacttactaagatattaaacctgtatgttttattcatatgcattgatagatatttacattcacaggtattgtatttacaactaacgatttttcaatttactactgtagatcatacctcactcctgttagggatgaagagtctgaatcccaaagaaaagcaagatctagacaagcaagacaatctagaagatcaacacaggtatagttaatgtaattaatatataaaacttacataagtagcatataaaatatatatacacacactgacataaaacaagttacctttctctttttcactttgttgtgaaaatattgatgtcagtatatagtgtgagtaaatccttaaaaggtaaaggttgctgtagttattctagtaattctagtgtgaataaatccttaaaaggtaaaggttgctcatagccttttgtatggttacactgctactattgtatttcatctaattagcatatgcctttgtgtctttttgagtattttttaaatccttattcctaatacagtgtctggcccagagtatttggttagaataaattaatcatatgatgtctaataagtatttaaaagttctatgaatatttggaaatcgggggcagagaataggctcgtatattaggtataaacaactaatatgcaagtatgaagaaaatgtcattcag

SEQ ID NO: 70584 - DNA, 1032 bp, Homo sapiens
tgggaagtactgagttaagccaagttaatataggttatatctctgattgtatcacagacctttcaatattttattgtgattttcctagagaaggttagaatgtatagcatttccctaatttatgcaatcattttctataacaagcccctcttatatcccagaattaatgtttcttaaattttaataacaagattattagttattctcttattccttttgaattacttgtcccaggaaactcactataataattataaaaacatagtatctgttatatctaaataaaattaaagtcaaagtataatagtgatggaattttcatcttaatataagtatgttggatgtcccattcaagtaaaactccctcttgtaaatttcttgacttagctacaaatgtaattatgtggaaacagcaagaagaaccagttttctgaactaattttaagcaataagtaagagttaattgatgaaattgaggcaactaagatcttgcgtgagaaattacctggtcatcttagggttaattgtctaaggaggtgaatgctaagaatagtgtcatatattctagttttagagaaacagattccaaaaatttcagggttgtagaaagaaatatgatttccttatatatataaaaagaatgagggctctctaaaaggagttttgaaaaaatggtagatgattctaaggatgtttgaagatacgctatactcgctgaactgagagctttaaaggacacagagaaaaggcataaaactgacagtaaattcagaggtttgttatgattgtatgaatagtgttaggctaaaaaaatgaattacaaattgagaagaatgttaaagctaacaaaagaaagaggcttttttttttttttttttttttttttttttttttttttttgagacagagttttgctctagttgcccaggctggagtgcaatggcgcaatctcagctcactgcaatctccacctcccaggttcaagcagttctcctgcctcagcctcctgagtagctaggattacaggcatgc

SEQ ID NO: 70585 - DNA, 3829 bp, Homo sapiens
aatttaaataatatttgttttgactattttgatgtatttgagagcattgattatcaaggttctaaatagcttatataatataaatgcttgagacctctcagtgaacaatatttgaaagtttatttctctggaagaaataaagatatttcagcttatgacacagtattaatctgttagagaagttttagaaaaagtcattaaaatctggagaaatttttttcctttcttagtaaaatattatctgattccaggctaaaagagaaagaaaactaatttgaacaggctgattattgattgacattaattttagagttcagctaggaattgttgaaatactgtaaactatgatagctatgtaattataattattgaataaccttttcttaatacttttagcattgcctatagtcagtacccaaattaatttttacttatttttttccctgttgtgtaggagaaagatagtaaaggaactaggcttgcatatgttgcacctacaataccaagacgactagccagtacatctgacattgaagagaaagaaaacaggtgagtttattttgatttgctttatgcattcactataaaatctttattatctagcattagagttaatacatgagcattgtaattatgtgcggatatgtattgtgggaagagatggaggatattcctgaaggagaaaataccaggtacatagtcctgaggaggtgcaggcttggtatgttcatgaaataatagcaaagaagatgtggctggaacagagtaaggggaaagtgggaggagataaggtcatgaactagtatgagttctctaaatatttggaacatttaggaaaggggaaagaagaaggaaagcccttacttaatcattttagtttgttttaaatatttttgtttaaatattgtttaaatattttagtttcttcctgtttttcagcttatagaattttatttttttaatttaattatttttatttttatttttattttttttgagacagagtctcgctctgtcacccacgctggagtgcagtggcgcaatctcggctcactgcaacctccacctctcaggttcaagtagttctctgcctcagcctctcaagtggctgggattacaggcacctgccaccctgctcagctaatttttttatttttagtagagacagggtttcaccatcttggccaggctggtcttgaactcttgaccttgtgatccacctgtctcggcctctcaaagtgctgggttacaggtgtgaaccactgcacccggccaataactttttaatatacttttaatcatgttataatatctaatttttttatttttttcccctaagatctcataagcagtcttctatgttaatatatatttttaataagcattttttttgtcggcacataacatactataaagtagatcttctgcggttaaagtaagcatctcccctactttatattttgtgatcaaaaagcatatttctataaatatctgaattttcccccatacttaggggaaaaattataccttagggtatataatcttagtactgaaattactttatcttcttgattagtattcctaagtgtcctcccaaaggtttttactagtttcagcttatactaatatttactagtgtaccgctttcttaatcctattttaaaattatgtaccagaatctgaagggtgttcttttaacagagattcttcaagtttgcgaacaagtagttcatatacaaggagaaaatgggaagatgatcttaaaaaaaatagctcagttaatgaaggatcaacgtatcataaaaggtaataatactattcttaagcggtttttatgtattcatttataaaaatatgaggcaatttgtttggagccctcagtttaacatcattttaaacaaatatgtgtttttattaaatacgagtttttgttgtttaaaacttactctaaacacaggatatatatttaaagataggtgataatttgttatgcctattatataattaagcttcaaatattatgaaatgttttttggattgttacatatttaaaaggaactcctttagaaggaactccttgactagaacaacttaaacaggccagtgtcttaatggatctagttgtcattgttgatctggaaagatttggcttgccctagaactcagagctatggaaatgccttcagttggaatgttggtagtatcatattgaagaggaaaaaaaagccctataaacaatttctttactaaaagcaaccaaaaagaataagatgtgaacaagtatcatgtaggcattggttacttccgaggtatctgacccattgctgaaataatttccttcaaaaaaatgtcaacgtcttgttttccctgggtaatacaaaaccaaagtgtgtttttcaggctcagcctggcatgaccatatggtgtggaatagtttcaaaaatatgaaatatcagatcatctttgtcttgttgagaaagttgggaggaggcactaaaatgatacactaccgaattaagtgaaatcttctaaactctagcaagttgtagatgcaactcttggtgctggagctggtggtgtatttaggaacacagtttttaaattttttttctagccttgtaatttatataatgtatagacattaactatagaatacacatacaaacacatcctatatagatatgactcttttgtttagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcaggtaagtcacagatacattttgtgctcaggtctactgtgtgcttatgtatgtgcatgcgtttttgtttagaagattgtggggctctggattttttcatttatcttgttaaatttatttgcagacaaaaattggttccaaaatgaggcaattatgcatgtctgggggaaattttaagttcctgaactatgaactttccttgaattagactgcttaaaatgtaaatttctctctttgacaactctgggtgagctttttggttcataatttaaggatgtctcaccttgcgttttaaaaaaatccatccctgtagtcatgtgttttcagctgctagaaagtgctttcattgtttagctgttttccttttctcttttttgtgttgctgcttatgatgctatagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcaggtgtgtaaaggtcataacagtactgctgatatatcttgcccagtgatgaaagttgttttttgttttaaaaaagatcttgtgaggttgatggccatctctccagtagactaataaatgaaataccctgtcagctcagaactatgtaaatttatacaactagcaattatttatatttaggctttgcgactcacctctgacagaattaatgtttttttgtttaaagtcagtgagcaagacagttgttttcttaaacattttagtttctaaggtggtttatttcaaaaaaaattttttgatgaagaactgaaaacaccacacacttagggaaaattagatgcaacatgacaaaaacaggttttatcattcttctcattgtttcctcccattat

SEQ ID NO: 70586 - DNA, 1723 bp, Homo sapiens
atagaatttctagaagtgaagttgatgaagtgatctaaagataacagaggttgcatttttagggttgttggaaagcccttaaaatagcataaatatttgtacataaaattagtttttattatagttgaaatagttaatgtttggtggggaaatcagtaaatttaaggctgtgatgttaaaaaaaaaagtattataattggaaaaatatcagttactagtttttgttgattatattggacacaaaattttttaaccagagtatatacatggattaaaaacaaaattcatgtgcagtagtttgttcagtcacatgctatattatctactctgtatgccttttaattgctttagaagtttattagatttttttcagattatctcatgctaaaattagaacttgttcccagtgacttttaaagattggatcattacccaattattggggttaattataaaattattttcaaatgaagaaaatattttttgttcataacttcccttttctgttttcatgctttcaatctttgtctctttacctgtcttattttaattggctttagtatgatttcattgctcctatcatgcctgtggtggaatcagtagatcctgcatcatggaggcagggcttgcgcaaaactggcattgttcttgtgcccagtaagggtgaaaaatctatggtgaggcatttctatgtgcaagaatttatattaggttacaacataacaagtttaatataaattggttccaaagatgcatggttttaagtccttatggtgtgctcatttctgttttctgtatttgcatcataatttttctgtgtgatataaagtgtgtagtgtgttttcttaagtctaacccctaggaaggtagtctatttctttaaaatttttagatctttacattttttactaagacattaacctatgtagtaaaagtgttttatcctgaaactgtaaaccataattttaaatatattatctgtaaacttattgtttccaatttaaggactgatcagctttacaaattcttttttcttttcctaaaaaataaaataaacacagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggtaatctatttcacagtctggtttctatgaaaactgttatgatttcttttccaggaacatcaaatctggtagattttctgctagttatctttagatctaggtatcaagttaattaaccttaatgaattacataagacaaatgtaatttatacagaattataaatactggaaagatcagatgtatttgcctaaaacataaattatgggactatactccgttaaaggaatctattaccttacttgagaatttataatagaactgtattaaggagcaggcttattttgtttattatgattcaagaaactttctgaagtttaaaaaacataggaacacatttattctagaatgttagtatactcataagttacatttattcagtatctgaaaaaaaataccagatttttcatctaccatattacaagcaactttgtcttaatgagtaaat

SEQ ID NO: 70587 - DNA, 1011 bp, Homo sapiens
agccaccatgcccagccgaagagggagtcttcttatcaatactgtatgacttttaaaacctgttattttcagtgattcttatactcctgtatctaatttagcatattagtattttttaaaattttttcaagtttatctgtaactttagtgacctaacattaaatttccttaaacaggttgttaatttctaattgcatcttaaaaggttttgcaattatctgtttttaggttcccagtcatgactccacttctaatatttagataaagttatcaagttctccagcttcctaccccagtacataaactatgtatgtgtgcacttgtgttcatggcaagacagatcacaaaaatggaagcacacgaaacagttttacatgcttattttcttttaataacttggggtaactatggtgaaagatagatgtgtttactttaattccttaacccttccgctgaaattaaagaactgtttctgtagcaatatcaagctgatgatttgtggagatgttatctataaaaccatcagtttgattttgtgcttaaaattgttaactaacaagtttatataagcctctctggtcaaaataaattttgttgggatctctaaagcagattatctattcttctatatgggtgtacattccaataaaatgtaaatggcattttctttacttgatggtaaaaattcagaatttttatggaattaagtgttctggttaattgaattcaatgtaatagctaataatttaacaaaagactgctatgtgctgtgggtatataaagtagtccaatcgaaacgtacagatgtagcatgatttaaaaggagaagaaattatatttgacttaaggtagtagaatcaggacattttagataaatcttaaagtaggtagtactccacctgagagaagaagggcttgtaaaccttgttgaaagggagagaagaaaaacaatatgagcaagtggggataatatggaatactttcgcaggaaaaatgaattgttccatttga

SEQ ID NO: 70588 - DNA, 1513 bp, Homo sapiens
gttagtttcatttctttctcttctttctgttctctgtctgttctccatccctctcatctcttctctccaccgaagcagtgttttccagttagtgtgttaatctttttaagactttacgttttcctgcttctctggaacctatctttcttttaacccaaattaacgattaagagtttttgtttgtttatgtttgacctactagtctcttttcaaagatttctcttcacccgtccttttttttatctttttttatcatttccctctctgtccacacatacctttttttttaaccaaacccttgaaaaattgattgcagtaatcataacacttcatgcctaaatatgtcagtatgtatctcctagtacaaggctattcttcattctcaaaataatcacacttaggaaatttaactttggtataatactattatgttattaataactaatatacccagattttcccaattgtcctttgagtatttctgtttgttttttaaaatcaggggtccacttggattgtacattgtgtttagttgcctttgaacttcttattttgttgctcgtttgacattatgtgcatgagtttaaggactgattggtttttaaatcctcacagcatttctgttgtgttgtcagtcttgccaatatttggatttggctttaggtggtcaaaatatagatctttttgaaatcataaactgcagaataaaaaaaaaaatccctgctgttagtaataatccttctctcaaacttcccaaggaaggcagtaatgtaaattattagtggtagaaacgtgttggtttcattggtacatagtttgaatattgagaaactatgaatgacttatcttaccttatatattccaaaactgagggcttcttgaattcagttagaactcatgttcatatgataataattatgtatgcttcagttaagaaattctctaaaagcagtttgtctgcaaaattttgaagactgttaatcatcctataactagcgtcactataaactgctttaattaaagtttattttacttctaagacccccatgtacttcttcagtgaatactaaattcattcctgcatcttttgatctgtttagactataatgttatcagaaattccatctccctggaatacctaggcaagaaactggctatctttttttttttttttctttttgaggcagtcttgctctgtcacccaggctggagtgcaatggcacgatcttggctcattgcaacatctgcctcccgggtttaagcgattctcctgtctcagcctactgagtaacagggatcacaggcacctccaccacacctgactaattatatttttagtagagatgggttttcaccatgttagggtattctcgaactcctgaccttgtgatccgcccacccaaagtactggggttacaggcgtgagccactgcacccagcactggctctctatcttttgggtatttggctaagtaatccctttcctactacagtcaaatgattacggtaaact

SEQ ID NO: 70589 - DNA, 1004 bp, Homo sapiens
tactgttaaggttttagttacattgcattcatgcattcaagttttaaatcttaaatttctttttattttcttcattttaaaagtacagaagtcagattctatttgtgcattttattgtcagaagctttgttgtgtatctttattatcttaactatttatttcagcatatatatagagacaagtctagaagctccctgaaaaactgacttgcgaaaaggaatcacagtggggaaagacttttagttaacaaaaccttaaacaaaaatggaatataaaatgattttttcccagccattgagaccaaatatatatggaatcttgactcttaattgtttgtctttaatagataagacaaaacccctggcttctgtaactaatgccaacacttctagtacacaagcagctcctgtagctgttacaacacctactgtgtcatcaggtcaagcaacacctacatcacctattaaaaaggtaagccaaaattgtatttgctgaaaatacatgtattctatttatgtaccacttggactaactcattaaagtaattctgaatttttatagtctgttccaaaaatatgtaagatttcagaatataaatatgtatttatgtttctcagttgaatgagatttcttctgaatcatgtttttttatcctttttgcaattgatattactgttgatattacagttggtagttaacaaatattacatacagttgatagttaataaatggcagaaagataaaaatttttgtaatattaaaatcagtgattgtattagttttttttttctattgaacttttattttgagaagctcaggttttatatcctttatctctattaagtagaggtgtgcatgttgataatttcacacacgggtaaattacaaatactactaccacaagtcaatgagagaactaaaatctaaattttttaaactcatagtacaaagcactaggcaggcaactttggtatgtcagtaggagcatgatctctgaggtcaga

SEQ ID NO: 70590 - DNA, 1099 bp, Homo sapiens
gactttttcagtaaagttggagggatgtaaaaaatccatcttagccctgcatggagctttttaattgtctagtctatttcattctttattcaagctctttccttttcaggtaaaacttaatttatttatttctttgttttgtcttatttaatgtctgaaaaactactttgttattattttaaactctgcatcttagtaatagtatcttaatagttttcttattttcctttgcataactttgtacaaagctccatagtgaaaaacgggacaagaaatctccactaattgaatcaacagcaaatatggacaataatcagtcacagaagacctttaaaaagtgagtaaaatattcaagtacatttgttatttttgttaatgagttggcatagtggccacaggcatgattattgtggatctgggaagaatgaatatattttaaccttttgtatttctaatcatttgaacactgttttcctttaacagcaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacaggtaaaattaaaagataaatgcattttcgttgaattttgtggcagtgtaaaataagacaagatgagacgtaatttttaaatttttcagactgatttgctacttgtttagatacctgccacactactaaattatctttcagtgaatgctagaaacttacatatagttgtgaatttattattatttaattatctggaggctgttgttcacctctgcattttgccgacctatatttaaagaagttgcagaggcttctaagactccttaggtacagataggttgtgagtgggttctcagcaattgagaaatgctcctgttccttctgaggtccaaacgtccaggatgccggtcccaacagcatcccaaattttccctaagaaatagtaaagtaggaatggagtaaaaactctttcctgtgagggtgtgggggaatttgctttgttttgagaaattttaaagat

SEQ ID NO: 70591 - DNA, 1165 bp, Homo sapiens
ctactgaatcagtattctagtgaaacatacacaatatattgtatgcatgagaaaaatcattttattggcatctggccaacaattgtctaattcctatgctatacaatttatcataattttgctatcagagaaggagtgcatgtaaaattattttgccttatatccttttttaaaaaattactatagtagcagctccttatgtcactctaaattttatttactccttatctgtcattcgatatttcagtagatctttatgtgatagtaaaagaattgtgagccaggctttgtggtatgcacctgtaatcccagctacatgggaggctgaggtagaaggatcgcttgagtccaggagttcaaggctgcagtgagtcatggttgtggcactgcacagcagtgggcaacagaaggagaccctgctcaaaaaaaaaaaaaaaaaaaaaacccgaaacaattgtgcctcatatttacatagaatttaaaggttttcagccttttttacacatattacctaatgcaattcttttaacgaccctgtgaaattaagttttttggattcaggaacatgatcagagaagtcaagtatattttcctaaaaccctgaaattgttttatctttttattctgctaagttcctctataacttcttttcgttttagtttcctcatcttttctttttcaagatactattaagctataaaaatataaattttaatcaaaatatttttcttttaaaaatcaagattttaaagactgctttttatagtgaggagctacataatgtctatagcattctaaaggactttgtgccataaatatatccaaatacaaggctttttttttcatttgagaagttctattttaagaccttgatttttaaaattttaatttcataactttgcatgtatgaattagactgtttttattgtctgcattttaaattgtcatacatcatgttcagtcaaaataaattactttgtcttaattatgtaagcctgcctatgtgaatttatattgtcattggataccttccttagtacttacagattgaagattattactaaattgttttaaaaatgatattaaagatgtgcacttaaggtactaccagagtttagatgaattatttagtactagaaaacatgatttgggaaaataatgtata

SEQ ID NO: 70592 - DNA, 1008 bp, Homo sapiens
ttaggaattcagaagctaagaaaacgttgcattcctatgtgaatgttttctgccacccctttgagttggaacacacgtagaagtgcgtttctaattctttagctgatggtcttttagcttgcttatagaattctttaagtgacatgaataatgaggtcttacagcaggtgatgacagtaaatataactataaagttttatgccaaaggggatcattgagatgcaacatcatctagtcttctagttttgtagatgagaaaatagttcagttgagtgaggtaaatgatgtacttaataccacaattacgtagaaggagggagggagaaaatgtcatacaagcgtttttcacaaaatcatgaaaagattcaggttatcaagtttcttgttaaactagacttctctcctctactcctttttagatacactatcagtcaatagccagtcaccagtattcctgctagtctcttcctactctgtgttggtaggtaataagtatcatggagaactcaaaacacgtctcctctagtgggtttgattacctttccatagaatgttccttgtatattgcattttataggataatatcataggttatgtagcagagattcataaaatgacctcatctttattcaaaacagggctaattcttttgctgtttttggagtagagttctaaatatcttattttcattaactgatttaaaaatatattttatataagaaatgtgcaggcatgaaaatcataggaattggtaaaagtcttaaggaaagtaaaaaaatttgggggaatgattggtttgtacttatatacaaatacaaaaatctttgggttgaatttttagttaaaactttcaataatttactttctctgttgtttttcatcataatagttgttttgtaatcagcattagaagacaaataaatattgatactattcaagtaaaaggccagctaattttagcttcgcaagtcgtgttacctctcttttcatgtagaaattccccttcag

SEQ ID NO: 70593 - DNA, 1655 bp, Homo sapiens
cctgttgacagggtgtaggaaaaggcactcttactagtagaaatgacaattgagcaaattcaatcaaagtaacagttattctttagttccctgattctacctctaggaatttgtttttttacagatattcccactcacatgggaagtaagatacgtgctagcagcattgtttataataggaataagagaatgttttaataaattatggtatatgctttcactggcatattctgaaacaaaacaagaatgagaaatctccttacatactgttatagaaagaacactagggtatattatgaaatgtcaaaatcaaggatccaagtatgtatcatttgtatttattgtaaaaaaaattaaaattgtatttgcttatatatgcatgaaatcattgtgtaaggatccaataaaaattaatagtatggttattttgaggtagggcaagctagttggctaaaagtcagcggtgagagagtgatgtccctatgtatcctttcattctttttttttttaactttgtgaacatattacttatgaaagttaaaacatatatgaaataaaaatcaatagaaaagatgtttcaaatgtaaccttcttcacattttctctccctcccaaacacacacaactcctttcaatttgattttgatgcttttcagttttgtactcccattgcatgtctattcatagaacctatgcttgagagttggttgttgtttcacttccagtaaaagctccttgaatatagatactgtctttttttatgttgaaaaaatttacctctttttttctcgccacacagacttctaagtacttaaaaatgttgctcagcatatttaacattattattgttcatatttcctaatggggaacagcgtttttctcttacattccagtattgtttctgcctctattaataaggtttctgataatatatatcagtggagatatttctttggacttatatctttcagcttttctttagataatggctcttaaatgttggtctgcaggcaggtgataggcaatgatatgaaaatcatatgggggacttattaagaatatagatcagcagggcccatctctccatatgctgattgagtagtactggggtgagctgggcaatctatttttaaaaaacaagcccttcagatggttccgttacggaggcaggattagaaacagctgtattagatattgttaggaaataccagatttgttcttaaataaataaagggggattatacattagctgtcactaccacctcctgtaggtaaaaagaaggtccttctcaagctcaacatcttggaaagtgaggtaaaggttaactagatttcatgagttgtatttagtgttcgttcacctgtttgtgtggggctatgctatgtgcagtttatagacccatccttgctgtctgtgagcttaatgtctaaataaaataaaggttgttgtcaatatgtagttagaagggcatactaacataatttatgcaactctttgcattgtattaaaatgtgtttctgttttagcttgttgatgactggagtatctgctttctactgctcagaaaaatagatccgactccttggaatatgttttttgctttgttttgttcttaaaagattgtcattttcctttgaaaattttcagctcctta

SEQ ID NO: 70594 - DNA, 1041 bp, Homo sapiens
gattcaaagtcagggcgggatttgtaggagatgaggcctgaaaagataggtcagagccagatagtgaaggatatctatttttgtagacattggatagatgcagcaaatatctccaagcaataaattaatttgattggatttggtttttagtataaagctgatggcaacttggaggatgaaatagaatgtaggatatatggtgacacgcattccttgaagaagattctcaaattagtccaggtgaaagatgataagagccaaaacctgttacatttgaaatgaagaacaaggctgtcttgaggaaatattgaagtaaaattagaacagtttggtaaagaattgaatgcagatatgaaggaagaattaagcctaacttactaaagtttccagttgaagaagtgatgattagatgagttcatgtaggaaagtgtgagataagacagaaccagactgagggacttcatgagtatatattgggtttgtagtactaaaggacatctagatgacagtggttggtgcattgttagaacttaggatatgtaaagatgtgaaaagtaaatctaggagaaccataaggagggggagttctgggaactagtagatgagatgaccctggagacgaaaagctaagtgctaacaatgataatagtagtaatgacaatagctaactgttattaaatgcttattatatgccaggcattgagccaagagcttcacatgcatttcttcatttcatcctcatagcagttctgtgaggtttatactactgttaccccatttccagatgagaaaattgaggcttagtgatttacccaagatcatacaggtaggaagtggtagtgctataggtctgtcctaaacagtaagacagatatcttgagcccacattctgtaccactgtaccatactgcattttatttaaaatgtctccctagaaaatacttcatgatgttcatttgatacatataatgggaatgcataaatttatatagcatatcttaattccaaagaaacaaaagtataggggcatctctaacagat

SEQ ID NO: 70595 - DNA, 1596 bp, Homo sapiens
atgaaaaaagctgtgtagatatgttacacaacaatgtgaatgtacttaagaactgtacacttaaaaatagttaagacctgtaatcccagctaaggggggaggatcgctttagctcgtgtgttccaggctgcagtgatctgatcacatcactgtgctccagcctgggtgacagagtgagaccctttctgaaaacaaaaaaaaaagttaagatggtaaattttatttttatgtttattttactacaattaaaaatttatgtatgtgtgattacttctgcagtacctttgggcaggactcacacacacacacacacacacacacacacacacacacacaaagtgccacatgtgatttttgttatagtccattaggcagtgatcaaacaggtattattagagctgtgttttactgaggtcaaatgatagaggaatggtatgaaatattgatgtagagggccaactcctgctgaaatgtgcttcatcagaaaatagaaactaaggattagaaaggaatagaaggtaaataaattccatgaaaggagatttttattccttgggattaggaaaattcctaatgactgcgggtttgttttgttttgttttcgtttgttttgagacagactggagtgcagtgacacaatcatggctcactatagcctcaacctcccagaccctagcgatcctcccaccttagcctcttgaggagctgggactgtaggcgcatgccacctcacctggctaatttttgtattttaagtagagatgcagttttactgtgttggtcaggctgatcttgaactcttgaactcaagcagtccacctatcttggcctcccaaagttctgatattacaggcatgagcgaccgcatctagccaactgtgggtttgtttaaaaaaaaaactatcttaagcatgaaaactgagaaaataaatacctaaaatagaattgaggtgttataaaaagtgattaaatataactagagcctaaaaaaaacaagaaatgcaatagaaaagtggttataaactggagcctgaataaacacacagaagagctttcaacagccatgttctagacaagtgttttagagtcataggatcttctagaattgagtaaactaaagaataagtataaagcatcacaacctagcaagaacttccctgcccattttgctgtgatgagtgctcagataacagtttcctgtcaaacaatggtaattctttaaagtaaacatttaaggctcctattttttatctgatattagcagttgttatgaactagaaaaggcatggagttgtactgaaaatttcttgcatttggtttccttctgtataagggaaattgctagcgtaactgtaagcggggctgattttagttttaatgattcatttagaactgattaatgtgccagcaaatgttctatgtgctgggtgttaacaataaaaaaagcaagacaatccttcttaaggatttcacagtctagcagaagtgtcaaacgaagagcttcacaatacagtgtgctatgtattaaaatatataggaacagaatgttgtgagagaatagaaaaagctgtagtgaggaaaggtttcagagtgatg

SEQ ID NO: 70596 - DNA, 1103 bp, Homo sapiens
gagactttctaattattattaaaaattaacatttttgtattggtaaagcaacgtgtgtacattatagaaaaattaggaaatataaatttaaaaaagaaacatgctctagatggttttgttttttgtttttttggcttgatctcagctcactgcaagctccacctcccgggttcttgccattctcctgcctcagcctcctgagtagctgggactacaggcgcccaccaccacgcccggctaattttttgtatttttagtagagacagggtttcaccgtgttaggatggtcttgatctgacctcgtgatccgcctgccttggcctcccaaagtgctgggattacaggcgtgagccactgcgcctggcctgatagttttttaaaatttaaataatgtatatactgccctttattgctgctttatataggaactttcctcattggttatgcatttagttttatttcaatgataatatcttttgcttaactatttttcctttggttttacaggtttttgattggtcaaggagcacatgtaggggctgtcaacagtgaaggagatacacctttagatattgcggaggaggaggcaatggaagagctacttcaaaatgaagttaatcggcaaggtaaaataaaaagcaacctaaatggaaaaatgttttagaaagaatgtgatacttttccagcaaaaatatttgttgacattgaagggcaatcataatttcatgaaaaaaatgaattcagcttgcaaaacaatagtacagtatgtttctgttttctaaaatattctccactctatcttttaagtatttttaaagttaaaagaaatgttagaagcagcaggatcaggcataaaattatgtggaagtaaaagttttggagcaaaataaagtaggcaaaggggatagaaagtgcacagggtaagtggcacattgcaaagttaaatagtgtggtcaagaaggctcactgataaggggtcatttaagctgagatgtgaatacaatgagggaatgagtcatgatgatctggggaaagagcattccagacaaggggagcaatgaatacaagaatgggaggttgtcttgtatatgcagagaagcagc

SEQ ID NO: 70597 - DNA, 1022 bp, Homo sapiens
tgaagacatcatccaaagaaatagactagtcttcactaaaggatggataaataaatatgcatttatgtcttgtatgattaaataaatgcattatttatgcatatgtgttatattttatgattacctatttcagtcagcctatttggttaaccaagcaaatactggttctgattgcattaaacagaagggccttattggagccataatttcttggagagaaggcattagtggaatatggagagggtagcagataagactgggcaagtcagctggggttacaacgtaaaggatttgtatgccaggctgagtttgtcctttgatggtgatgcagttttagggaagtgatgacctttcagactgtttttttggaagattcttgacaaattagagaggttgggcaagaaaactagggcagtggcagtgagattggaagtagagcagatctgaaagaaatttggagaatagaattgataagtcttggtgtgatttactggatctaagtactaaggtaggaagaaaaatcaaaggtggtgctaatgatgataaatagctaacgtttaccaagtgcttactgtgtttttttttttactgttctaagtcctttagataacataatttcagtcatataaaaatgtactacttcccacaggtccttatgcataaacctccaaaactgcaaaaaatgaaaacataaattttaagtttgttgtaggcacatttggcaacagataatgacctgcactgatgggaggctatttgtagtctttatctcacttaactgtaaatgtgtggtttgttttttttttgcagaaataattttgtgtttggttatagagtgctatcccagacctggtgggagtgttacataatccataatattatctttctaaaatatgaaaaacttttacttttcttctgctggtggaaatgtaaattagatcagccattgtggaaagcaatttggtgatttctcaaaaccttaaaacagttaccatttgacccagcaatcccattattggtta

SEQ ID NO: 70598 - DNA, 1008 bp, Homo sapiens
ccatgcccagctgattttttttgtatttttagtagaggtgggatttcaccatgttagccaggatggtctcaatctcctgaccttgtgatctgcccgccttggcctcccactgttgtttttcactggaattattgcagttgcctccttgtaggcataactgtcatctttcccacacctattttttttcacagtagccgcagtgatcgttttaaattattttgcgttgtagccataatgatcattttaaattattttgtgttgggtaacatgacagttttattgaaagcctatcagtggatttatgctgcattcagggtagaagccagagttctggtggcctacagaggtatgctttggtgccttgtcacctctctgactccatcctccactcttttctaggctttgtgctaaacctacactggtcccttggttgagcctttgaacagactaggcatcttgcctcatggcctttccatctatttgctggttcttctgtctggaattcaataatgctgttatttttggtgctttgaaaacagaaatttcaggaatttcagaaattcttgaacctcacctccccccagcaagaaatattatagtataggagttaagagctcaggctcaggagttaggcaactctgtttaaatcttaattctgttaagtaattctcgtcaactttgaatgaattaccagcttccctaagcctccatttctttatccataaaatggaaatattaatacttgtacctaatttataagattgtgaagattaaatgagatcatgtgtataagacacttggcacaatatgtggcaagtatttctattcagtaaatattaactgaattagttgttattgtttataatataatttttggttaccacttttcagtgaaaaataggtaagctcttgggtttcccagattatttaacaaaggaaactatcattttgtctcttggttttagggcaaacttatctagaagagaggagcagaggagaatgaagtag

SEQ ID NO: 70599 - DNA, 1032 bp, Homo sapiens
tatgtgtacctaagcaaggacccttaacaatttagtgtcattagcatgtttgatggagtatagtcaagatagcagcagatttatttacagagaatatttatattataaaagctacaaagtaggaattttattctattgatgtattatttggagtgttaattcgtattttttccaatcttgctttctgttttgtttttaggcttgcattgatgacaatgttgatatggtgaagtttctggtagaaaatggagcaaatattaatcaacctgataatgaaggctggataccactacatgcagcagcttcctgtggatatcttgatattgcagagtaagccagttctgtgttttcattttattctaatactgtttgacagacctgaatgtttattgaagtgataaagataaatgagtgaactcttatattactttaattcatgaaaattattctttccaagaaagaaaataagtggttattgggaatccatatattctcagaatcagatcttctttttgtctccccaccctctttggcctttggtacttcgtattaacattagtaattgtacacattctctgtctccatcttttttcttttgagtacagctagagcattttcaaatgattgagggttaatacttagcagtctaactcattcctttataatcataaatttggcaactgggttacattgctatagggagaatatgatacatagttctccagtgagcctgtttacttagtttttctgaagattgtcttttttaaaaaatacattttttagaaaattcaatgagaaatagtcattgtattctctactacctttaatgtgtgggtacacactaagaacatctgattttttaaagcatttaacagtggaagtatagatatcttgaaaaataattttttcattaaattatttttcttattactatctatccacacagtaaacagttttgttgtctctctgctcatatatgaaagcttatcaatgaataaatattgaatatgggaattctactctgtaaatatc

SEQ ID NO: 70600 - DNA, 1030 bp, Homo sapiens
gtttcttatgtcgacttaaaagtatatacatttaaaatcaaaattagcagtgtttcatttattggagaatagctatttctgtgtgttaatgtctttcaaagagccagtgtaatcaccttcttcaaatggagaaactttaaaaattaccaatttgtcatgaaagtcttttatcttaagtgtcaaaggattactcaaaagatggcagataagaccctattctggatcttgcttacctcaccgtatttggctttgcgtctttatataccagacctgtttttcacttgttcttatgttaaactcaaatatatgaatcacctccaggaaatattccctgacgaccaccattccttcttagttctccttttctcagctctcataaaaaccagtggacgtgtctgaaattgtcttaccatattccttttgatataatcatctatttttgtatttgtcttctgtactagatggtgtcttgaactttctatttctagctgtttactgactaaggtatcacaaatgtctgttttccaagcacaatatcctgatcataatttaatcttacccctttccttactgttttcaaaatcacttctctacactctttccctgaatgatttcaagtcccattgttttattacctcaatgcagataattcccaaattgacattttcttcccacatttattttcacagctccagatctatatggttagataggtgtacagacacctataaattcagcatatccaaaacaaataaaattgtcatctttcttttcccagtctgctgcttgaatctgtggtgtttatcttcatgaatgtcttcttcctgcatcttaactcttcatatctttcattaaaccttgaacatttcctcctaagcttccttaatacagtttcatgagtacaggcataccttagagatactgtgggtttggttccagactaccacaaaaaagtgagtcacacaattttttttggtttctcagtgcatataaaagttgtgtttatgctataccgtagtctattaaatgt

SEQ ID NO: 70601 - DNA, 1052 bp, Homo sapiens
tcacaattgccatagtgtttattctgtatctttttagagataatccatatgtgaacaaatacacacacacaaaatatatcacattggtcagagactactcgtgttttacatttgttcttttcactttgcaaaatatccaggaatttgtttcatattagtccataaattagttctttattgatggacatttaaattgtttccagttttacacttaccagaacttagcaaataattctgtacatgtcattttgcacatgtgattgtatctgcagaataaattcctagaatgaaattgcactgtcaagggatatgtgcctttgaattttgatagatagaaccaaattgttttggggtgttattttaccttttgctgctgctgtttagttgtgtagcctattggttaggggtacagatgctgaagccagactgctgggttaaaatcctgaattttgccagttatcatctgttaaatggtagtaatagttctcacttactgggttgttgtgaagattaaatgaattagtatatgtaaactacctggaacagttccatggcacgtataaaagtgctatgtaagtaagggttagtgtttatttaggacatggattctgtaaaatgtggcttcactctgccatttttactaggaagaacttcttataattctattttccattttccccttgcttctatgtaactgcattttatttctttccctcctgcctcttcaagctactgcttctcaaccctctgttgtttcccctttcttaaatactcatgccctctgggttctgatgtagctttctctgatcactttttacacatgctgcttgtgccttgttatttattcctctagctttggttactgtgggtatcagtggttcacaatctaatgtattttacaagttagatgggcaacttctttaaagaggaaatttctgggcaccaccttcagagattttgatttctcctctcccccaaatattggttaagtactttagttaaatccatagcatttatcatagctctttttgttgttgtgtgtttagttacgt

SEQ ID NO: 70602 - DNA, 1118 bp, Homo sapiens
aaaaaattgttttaaccttcaccatttctttatccttaatgacatagatcaggtttctcctagaagccttgctcttacttaggctactccctaatctctgagctcctacaaaatacagcatttgctgtattattttgttttcacattgagtctgttaaaatcatatatttaataaggctcggtattagtcatgattcatttttttgtattcccagcatatagtaccttacagatgatagtaattgttgacaaaatctgaacagagtagcagtgctggtgaagggcattgatgtcaaactgtggttttctgaaagctattctctggaagaggaagtttattactataataaaatagaggcttggggtatacctttatgtcttatgtatacagtctgttctcttaagatgaaatagctgtatcagaaaatagtgttccatttggatcagacataactattccattgagctttatacattgctgttttgtaagctgagctgcttctatttccctccccttttttggttctatagtacttaaaaattacatcatacagtgatttactagtatattttaattttgaagtcatgagtaggcagaattgtaaataaaatgtaaataatacaaagataaagtattagcatataatctttctacattttcttagagtttctcctgtttttttttccaggaaccctgaaattatctgcaggagttgcttcatgtgattgctctttttaattatctccatgtgaagaaaacattgccaataatgttagcttgctttttctcagcagtagtcagttttgacattacttgcctatgggctagccctctacattttacagggcataatttcttaataaacttttccccccatattggaaactttatgacttaaaaatatctgggaaataatcattactcatagaactgacacagaagttgtagaatccacacacgtaagcataaagacttttattttactagggagaagtcctcacgtgatttttttgtactcttattttaggctctttaaaaaaaattttggcaaattaagagttgcagattagtatggaagataaaaagttgtcagatagttttaagaggagacagctga

SEQ ID NO: 70603 - DNA, 1064 bp, Homo sapiens
cccaaaatagaagtttcttgattttgtctttatagccttctcacctaacatagtacctgggacattgattgctagatattcaggaaatgtttaatggtatgaaggattctcttcacagtaacctgtttcaaggacttcatcttcgggccttgaagagaatggacacttggaaattctcctcctgatttatttggtgcatggatacccagatgaatagttaaactgagatttttaatagatggacaatccttctatactatggtttatgacatgtcattgattgctgcattgattttggtacatctggggtgactatttaggagccttctcctcttaaaattcgttgtgtatacaccccaaagtcatgtaattacgttacagagaattaccattctgatggtgtgaagatacaccttgggaaatactttaaaatcctggacagaaactgaaatatatatctgaaagatatgttcatgggtattaggtttaaggatgttaaagctatagccttgaaaagctttgttcatgatttaagttccctgccatttgtttcaaaggcacatttacggaaatgtgtattttgtgtgtatttattcagcaaatatttgtgtgcctattacgtggtggaccctagaatccatcaatgaattcacaaagcagacaaaaatccctgcactggtggagtttacatggagcttatttgctgcctctgtatgtttctatatgcatgtgtgtagatatgacatcattataggacaggcagcataataaattgttataaggatgttttgtattttagtagaggactgataaaattggagggccattgctaactcttcattatctgttaccttatttcacagatctgcattttgaatttttttgccctggcttatccaaacaggaaaggcaaagaagttttattaaacaattgaatgaaagttgtatttattgttctagcaggtgcaaagcattctgctgtaaatattgcagggtggaaaggatggctaacacacagttcataacttcaggaagcatatagtttaatagagacaagacaaata

SEQ ID NO: 70604 - DNA, 1639 bp, Homo sapiens
ttaagttcatactgtaacagattctagtaacagttgtgggaattaatatctgagtcttcagaaggatctatttgggaattaacatctttgagacttcagagggaactatttggttggaatagtaaatagtaaacacttatataatagtatttaaggatataacagacatgccttaggcggttacattatcacattaatcatatgaggtattattcattttattattccattagacctgtgaagaaaatgaggtacagatgtgactgtagggtcacaacaaagcttataaattacagggctgggagttgaacctgagaagtttgactgaacagtgttctcacaaacgctatgccatagtgcctctggactacttgaatcaccaggttccatcctcatggtatccttaagaatacctgggtcttaattataggacaattgataggccacaacaaatctggtaggtcagttatctcctaaagctaccccaatggggtgttccagaaacttcctggatgcatccagggtacaccaaggtcttactcttgccagctaatgtgttctgttgctccagggctcactgttgataatcatgggtggtatataacaagaaattgagaatcctgtaggcatatggttatttaatcagcctttgattttaaataactttatctgaacactgttaacatataatgactaaaatctaacaccaaactagctggtcacaggtcttctgttagtattttatatttccattaacttctttaaaatgttcctatatcagaagacattgtgtaaaagccttattaaatgcttctgtttcattttcaatttaactatattagattatatacctgcttttctcctagcttctgctttcatattaagtcatttcttccattactgaaatcttgtttgtttttattggataatctgattccaagtttagaacttctatgttttaaaggactgtggatgacagggagataaaaaatgaaaagactacaagaaaagcagttcctagtttcagcaaaaaattcaaaggcatttgggtcttctattattaactgctcttttcctattttggaataaaattaaagctagagtctagtttaggtatggtagttatcatagatgcttccactactacaaacagtgtgttctttgaagatctgaaataattaaatacagtgctttggatcctcgccctgttttaaatagaaatgaattttcagaaaggattctactctttaattactgtggaagacactgtaagagttaacattgtttaaagaaagccttatatgggaaagatcaattgttagttagtatcctaactaaacgttttcaaccccagatacccattcttatgaagaaatctgttcttcagaaatttagtgtatgtagcaagccgtctgatttttccttaggctaataatggaggtcactccattaaaagtactgtgaaccactattatataccacagaatacagtatagcagtcttccaatttttaaagaaacatagatacatagattaatatatagaggctaggtcttgctttgtctcccaacctggagtacagcagcaggatcataattcaatataatcttgaactccttggctcaagcaacactcctgc

SEQ ID NO: 70605 - DNA, 1452 bp, Homo sapiens
ctattttttctatttttagtagagatggggtttcaccatgttggtcaggctggtctcgatctcgtgacctcgtgatccacccgcctcggcctcccaaagtgctgggattacaggcatgagccactgtgcccggcctaaactcttaactctgtataacatggcatctttttcccttttcaacccatccttgacatttagagccagtctttatatgtgggaatactatataagtttttctcgctttaaaaacactcaaatgtaaaaaatgttaattgcaggacagtatgtatggtatgagccctttggggggttatttacatagggaaaaaatctggtaaagtacctcaactgttaacagtggttgtctctgggagggaaatacagattttgaattatgttacttttggatcttttacaacaagcagaaaaaaaaaaagaaaaatctcaattggagaaaaatgcctaaatggctattcccagtaatattttatggattaaatatagaaacattgatataactaatgaattttagtttgctagtgtttggccactcaaagaagctggtgttgatggttcagtatttatttctgtattatacttgccttttctctgaaccttttatttcatgaggaatgactgcttgacgatgtgatgaacaccttgggagagtattctaagcaaataatggaattctggatatggttagatgtattttgtagctttttgcaagtggactacagaaagttcagagaaaagctaagtataattaccaaaaaggcaagtcatttttgaaggacaaaggggttttaaaggataaaatttgggttttagaattttaaacaatccaataggagataatgtgaagaaagaattagaaaagcagttttatacagtatgctcttttgccccattctttatgaatgtataaagcatttgtcgatgaatatctgtcttaagaatgaattgaaaaaacagccccaagtctcttagaattaggaatgttgaagcccatagttacgtgaattttgtgaaaatatttttgaaggcagtgaaaagaggacttttaaaatttataaaccagaacaagaataggaagatggaaggcaactgatggaatggcttttaatttacatacacatttgttgtttataggtacatttgttgtttataggtacatttgttgtttataggtacatttgtttaaaatggtcttctactctacactggcaaaattctaatatccactattaaacagatagttctggaagagactgtgttgaacactagatgtcaatttgagttttctgaaaacaagttatgttgacctatctttacttcctttttggtcaaggtttagaaacataactgggggaaatgttgcaaacagtatagcttgattttttttgtaaagcacatggaaaggctcttgttatgtctttacggttaacatga

SEQ ID NO: 70606 - DNA, 1051 bp, Homo sapiens
gataacccattaattcattaaccctttaatccatgagtggattaatccatttatgagagaagagccctcctgatgcagtcacctcccaaagtccccagctatcaacagtgccacattagggatcaggtttcagcatgagttttgggagggatatttaaatcacagcagatatggagaaattggaaccctcatgcactgctggtggtaatagtaagatggtatagccactttcaaaacagtctggcattttctcaaaaggttaaacagagttaccgtatgacccagcagttctactcttaggtgtatactcaagagaattgaacatgtgtccacacagaaatgtgtatagtaatgttcatggcagcattattgatgatagccaaagatgaaaacacaaatgtcttatcagctgatgaataaagtgatatgttttgtccctggaatcagcggaatattattcagtagcaaaaaggggatgctgataattgctacaaagatgaatcttaaacatgctaagtgaaagaagccagtcacaaaagaccacatggtgtatgattccatttatatgaaatgtccagaataggcaaatctgtgtatgaagcaagaaggcagataaatggttgccagaaactagaggtgttgaggggagttggtgaataactgctaatgggtacaactttttagggtgacaaaaatgtaaaattgtgctgacagttgcacaactctgtgaatctgtttatttgtacactttaaatgggttattttatggtatgtgaatggtatctcaaacatttaaaaaagtgaacgtatatatttatcagtgtttactactaaaaattgaggcactgacagagccagagtaattatcttctatcagtcccccagcctcagcctaggcttggtattagtcactataattatgatggtgaacagaacagccagacattgcccctgccctaacacagcttgtagtctactggagtgtatagataatacacagacaattataaatttacatcagttatgtgtaatgatatgtaatggtaataca

SEQ ID NO: 70607 - DNA, 2076 bp, Homo sapiens
tgccatttaaatgattgtttatacaaaatactttttaaaaaattttttacttttaagttctggtatacatgtgcagaacgtgcaggtgtgttacatgggtatacttatgctatggtagtttgctgcacttaccgactcatatctaggttttaagccctgcatgcattaggtatttgtcctaatgctctccctacccttgcccctgagcccccgacaggccccagtgtgtgatggtcctccctgtgtccatgtgttctcattgttcaacttccacttatgagtgagaacctgaggtgtttggttttctgttcctgtattagtttgctgagaatgatggcttccagcttcatccatgtccctgcaaaggacatgaactcattcttttttatgactgtattccatggtgtgtatgtgctacattttctttatccagttcatcattgatggggatttgggttagttctaagtctgcaaaaggcatttttaataaagtttctagtatattgaaaatggaaaactaaccgtgaaagtactcatgttgacacatctgttaaattgatgcgataatgttatcccctatatgtcacccacaggcagatttttgttttatttattgttttttttgttttgttttgagatggggtcttgctctgttacccaggctgggagtgcagtggtgtgaacacagctcactgcagcttcgactgcctggccttagtgattctcccacctcagccttttgagtagctgagactacaggcgtgtgcccaccacaactggctgacttttaaaatcattattattagtagtagagacaaggttttgctgtgttgcccaggctggtttcaaactcctgggctcaagcaatcctcctgccttggcatcccaaagtgcttggattacagccatgcactaccatgcctggctgaggaaaattgttttattgctttattactctgtgtgtgtgtgtttgtgagaataaaattagttgtatttcactcagagaagcaattggggaagacaaggtaaaaagtgttcttccttttttctttatgtaaggtttagttctaatgtttgaaaattttgaagttattaaaatattaaacaatatctgtattcatttatatgatgctgttattcatttaaattagtgaataactcattcatgcaagaaacatagagagatcaccatttatcatatgtccagcacagtactaatctctaaaaacagtggtccctggctacatgtagtatacaatctagttgaggtggcagcatgagccgatgattacaatgtaaataagtggtagagtagagatacaaggtgaaattaaaggctttattaggcgggcttaacccagagtatcaatggaagacatccctgagaaagctctgtaagttataggtaacttatcagcagatgttttgagccttttatgaccctattcactactggtttgtcttctgaatgtacctgtttagtgtacctttttgtcagtttctttcttgaagatgaatgttgccaaggttctcatatgtctattattcttttttgtgttatttatgtagtttcaactttctttttatatgatctgtcctccttcttacatgatccatatcttattttttatatcagtcttccatttactaagctagaatctcagggtctttttctgttttctcctcacttgcatacagtacatctcctctaccatgcacacacctaaaaaaaaatcatcttttgtatattcatttaacatatattaaaggtctcttctgtgccagacactactaagtgctgagaagacacatttttgagcaaaaatataccaacagtaccctcatagagtcgacagtaaaatgaaattagccatttgggaaatgcaaatcaaacccacaatgagatactagttcacacctactaggatggctttaataaaaaagagaacaagtaatgactaggatgttgtattagtcctgttttcttttgcttataacggaataccagaaactggattatttaaaaagatttacttattacagctatggcggctaagaagtccaaggttgtagggt

SEQ ID NO: 70608 - DNA, 1058 bp, Homo sapiens
aatgacattcagtagaaaccatggaaagaagtgaaagcattcctcagctgtcacttttttagtagtctatttaaatgttatgtatattaagtgagatattctgcagagagagcttcacttaataaaaagctttactttaacttgatgatttaactcacatttgagctgaaattactattttcttagtttaacatgacctctaacaataaaatcataagattgtacaaagctcatgtcattttcttgaatactgcatagtgcagaggagaatacattttgtgagatgtcacttggcaccctcttaaagattaataaccatgtgggaaagtatattttcatggactgttacacacacacacacacacacgtacacgtatgcactcaacctttacttgtaataaacatcccaaattatatatattttattagccttcaaaattgttttagatggttataaacttatttgaatatttatattcttgcatggaacacttctagagcttttctgttggagtttcagctccagaacatttttttaaaatatcctcagtgttgagagtttttttttctttcaggagagtttttaaattttgaaaatgatatcattcgaagatgcatctggtgaataaaggtggatcatgtagtcatcatggttaataaatatccgtgattacatgatattttctaaaaagcttattcttaactggaatatgatcataaatgtcaccttggatttaagttaactctttacgttgtgtggatttgagtatgcttcagaatttgtaaacctaaagtactgttcatttgtgttctagattttgatgaaacaagtcaatgttatagtttgtgaacatagtcttttttgtatatgtttgtgttttctgcaaaagatttcggtgctgcctggcacagtagctcatgcctgtaatcccagcactttgggaggccgaggtgggaggattgcttgagcccaggagttcaaaactggcttgggcaacaaagtgagaccttgtctctacaaaaaatttaaaaattagctgagcatggcgacacgcatc

SEQ ID NO: 70609 - DNA, 1716 bp, Homo sapiens
tctgtgccagtgacttccaagtcagtttacagttccctcatttctgcaaagctccaagcctcatttccattttttggggttatgtattgatttgaaatgaaatattaaatgtattgtaattttatatttaataatgtcttttaagtagtaatatagtaaatacaagttcaccccctttgccatagaatggcaactactgtattcacgttaacctttgtgatttcttcaaaggatttcttattgttcaaatatagattttcatagttgcaattcagtattataattttacgtttatccgttaacattagagatacttatctttagactttaccagcatcctttttaactaattattttaaaagtattattaatttggtggtaagacaattttacatcgtcaggaatttctttaaattcaacctaaaacaggtctatctttcttcatcaagtctactcttctcattgatgttcctgtttctgttaatgatgtattaatctttagaatcaagttaaacattttagttattgtttactcattccccttgtctatgcataatccagtctgtcttctagctcagtcttttctttacaattaccttggcatcagttcttttctttgccactttttactggcaacctagttcatacctttattattttattttattttatttttttgagatggagttttgctcttgttgcccaggctggagtgcaatggcgctatcttggctcactgaaacctccacctcccggattcgagcgattctcctggctcagcttcccaagtagctgggattacagacgtgtgccaccatgcccagctaattttgtatttttagtagagatgcggtttctctatgttgatcagactggtctcgaactcctgacctcaggtgatccacctgcctcggcctcccaaagtgctgggattacaggcgtgagccaccgcacctagccttatttttatccctagagtatagtaatagcttaattgtttttcctgcctctattctctcccttatttaatctagcatgcatattgctgtcatattaatctttgaacagtatcattttgatggtgttattcctctctctaaatttggatatagtacattttatcatttagcttatggttgatacatctccattgtgttgtatcctttatagaaattggttaacttgcttacgtttcaactagatctttacattttttatttccatgcctttagccatgccttttatcctctctccctcgtttgccaattaaaattctagtcattgttcaagattcacattctcttttctggggtgttcactgtaccttatattctgcctctcctgcaataaaaacactttttactgaatagtgtttgtgtttgtcttcccttgtagcctctgaggacctaatcttccacaatttttgtatttccagagcctagcacatagtagatgctcactaaaggtttattgaatttttatctttttacctcatcaataggaagttttagagttatttttatgttgtgagatatatttttgaaaccttcgcatcagatacttagcgtattgttcttgcacataatggaatttgtgtgattatgaaacaaattaaaaactttgttgtagatttcaatatattttaatatcttgagattttaaaaaaatctttttttttttttgagatggagtctcattctgtcacccaggctggag

SEQ ID NO: 70610 - DNA, 1111 bp, Homo sapiens
atgctttgtgcatattaaagttttatagtagtctgattgggatctctcaatgttagccaaataaggagaaactattggcaatccagagataatgttgccttgcctttaacaggccaaaagcaacacaaccacgtagagttatgcataaaaagcaatttttaagtgacggtaataggtgacaaaacataggctttttctattttcttagcgggcaacttggaataactgtaatagaaaatgactttgcagcgatagcttccccttaacaatgaaaagacttgtaagctatctcaaagttgccttggttgtgtgtggaagatgcatagccttattttgaataatgttgtagtaaaaacttgtttgggaggttgaaactcaaggctttatatttcatgaatattaacttgatgccttttaaaaaaaaggtgtgtagtgacatttttccttgtcctgcttactgtttaagggagtgatgaccattttaaattttgtgtaatggaattctcttatcagacttggagtatagcctttgtttacaaagttgactggatatattgaaatgattgacacattgcaggacaaatatggaattaaaaatgtggcacccagtaaaaatatagcagggtgtctagcgctttctcaatttcattaatttagattctctaatgcatagcaaactttttatttgggtgaagtttatttaaggcatatcataactcgtaaaattttaaaaccatggtgttgagaatgaaggaaacttttggcattaaaaatgataatgtaattatataagatgaatcttcaaatttctttcaagtgtactttacacgttttagtgtgaaacagattttgaaagacgattattactgtaggaggtcaggataattggataatggttcgcatcaatatgttttattcaaattgtcaaatagaaatttaaagttactattgttgtggaggaacccagttgtattggcttagaggaagacgaaaagttttgatatttacattattgtgatactggtttagggaggaagagaaaatacatttaactgccttcttaagatctttttttctcctctcaatattcacacgttacaagaattgtcag

SEQ ID NO: 70611 - DNA, 1348 bp, Homo sapiens
accccacttttaaaaggttattaattctgacatgcccaagttcatctgagttccttagaaagatcaaccagcagcacctacttcacgacctatcctccattccattcaaataacgcggccaataggaaaatcctccgccctgagccaacgactcggcgtagctgagacagcacgggaggcagatctgccctgtagagccttgcggttccactgctggcctccggattcccgggagcccccagcccgacaggacaaccttccttccccgcttcctcctttccaggtctgtcccagcccccgctgcctgggccacacccgcttccctctggtggcccagccaccaccgccgcagttcgcgggagcgctcttcctggggcgggcacaggcccagggcgcatgcgcactggtcgaagggcgcctcccagtccggatctcgcgaagttacgttagattggccgccggtgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggtctgtgcgccccgccgccggctctcctgaccgtgagggttctcgtcggcctcctgctcgggcctgccctcagttctccacctcttgaggctgggggcggcgggagactccctgctgcggggtgagggggcggtttccccagagggcgggagggagagctggtggaagggagggcgctgggcttgaggccccccttcagaacagttgctggtggagttgggaaccgggtgatttccggggcataggggaaaaggaactgtggtcgtttggggccccagggccattcgtggataagtctgggatttggggtcgagacaaggaggggtgtagtggggttgtgcctgggccccggtgtcagtggtatattcggaggggtggatgctgaaggaagaaaactaacaaggggc

SEQ ID NO: 70612 - DNA, 1051 bp, Homo sapiens
tagtaaatatgttaagaaaattaaaatcacagaatgaaaaagtgatagcaatcatataaaaatgttgaattagaatgcatttatgttatcataaattatgataaaattttaatatattagagtaaaagcctatcttgatctgttaaaagcttgaattttagaaaaaatataaaactgattttattattatttaaaaatattgggtcttgactgctcaagatctcctacatatgtctagcatgagcatcgttttacttcgctagaatatttcaagagcagtctgaaaatgtaatttgtaattacaggcttagtagacctaatttgatgaaattttctcttaccttggtttacttaatttataaaaatattaattttcaagtttatcattagtaaaaaatactttaataaggagggttttaaaaaattaaatatttcaaagacagtatttgatggaaatcgtataataccactcttagatcaaaatctcttaaattctaaaagatgattttactctaagtgtgcatacctgtgtatgtgtatgttaaaatgttacaggatacaaaacatgttggtacataataacagcatcaccttttaccatagtaatttaacttcttaaaagcatcctgagttctcaagaatttaaggaaagttaagtaacttgctaatgctcacttgccatgcagagatagcagatctaggatgaaaaaacagacttactatgcttgagagtgtatcagtttctcattgtgtcacgtttcctccccaattaatcctatcttatcctcataataccagtgttacagatttaaaaacgagctgtgcatacataaatatatacatacacatatatgtttgttagccttttatatttataaaagtgggttttattttgttttttagccctggagtttattcatttgttaatgcatttgtttcttctttattttgttcattcatccaatatttactgaatgacctctatggaccaggcactattccaggtgcaagatgagagtccagatagagtttaactctaaaaaacaatgtt

SEQ ID NO: 70613 - DNA, 1048 bp, Homo sapiens
tgtttgactccctggatctctatttctgttcttatagagaaatggaattgtactatccatccatattatttggtagctcattttttttcacttgtaagaagtgttttttccatttttctaattcattatttttaatgtatacagaatatttaacatattgggtgaatatataaatatttcctaatcctttcatattggcatttagatggtttctctttatttgcttttataaatcggcagatagacttgcatctttgggcttggcattccaaggatatatttttttttcctctctctctctctctgtctctctctctgtgtgtgtgtgtgtgtgtgtgtgtgtttctctttccttccttctggtaaattcttagcagatttcaatgtatattatccagccattctccaaaaaaataataaatattgtaagttcccaccatctttttccttatgaaatatttgaagaataaagataataacttagaggacactcaacactgaattctgtgaaatcttagtattttgtcacattagtttcagatctttttatcataagcagtaaaacattacagacacaattgacgctccctgtgtatctctcccaattacatggtatttacagaaacaatcttagaataatttgtaaggctcgatggaaaggaaaagttctttttggacattctcaaatgattgattgtattccctctttttaataggagctcatattcaacatctctccatggacatgagctaagtgttgagcagaatgagttaatgaatatgctctctgccttctgggagcctcgactgtagaggagcatttcatcagaacattgcagcatgttgttttgcatgagttataagctgaaagagaaagaaatggatagttaagataaagatgtaatatgaaaaaatgaaaaaatgtatagtcctaaagttctcaggtttagaaaacattaatttcaatccttgtctattgctctcctgtcttcctcccatttctccttaaccagagcaacattaacaccaggtcagctagttggggtcc

SEQ ID NO: 70614 - DNA, 1047 bp, Homo sapiens
ttattaatgcacagatccatttttatgttccacagaacctcagattcaacatgctccaaacccagtcatcatctacctccaattcacaacctaagtgtgctctaactccttacttaggcaccttaagggtccttatagttggtgctttcttccttctctaaattcagtcctcagtgggccacactttttgtacctcttaaataattctcaaatctctctactcttctgtttttcttggcacctgaccctgaaattctttgctgcatctcctaacatttctggtgttgtaaatatgtcacattatatgcttgaataatacgacactgtttggtgtgtcccagcaaactccattctttttccttcattaatgttcatctctctacctataatgtttttcctcaatgtctttgtctggttaatttcccatcccagccaaaagtttatctctttcaggaactcttttctgaaccctaagtacatttgttctgtgtgccttactcttatcatttatcatattgtaattaaattgtctgtttatgtgcctgttccccaacctaatctataagctccttgagaaaaggagcagatctcaataatgcaaaaccctctgaactgccaaagtactaggcccataaaaaaggcttttaaagtaaatggagaagtaaatatatgtgcattttgatgtagaaagaacaataaacttgaaataggaagatcagatttgtactgtgacccaactacacatcaccagtttgagtcagaacttcagatttccatgctacaaaaagtgtttaatactaacacctcatagggtaacttgtgatgattaaagaatatgaggcaaataaaaactaattaatgtataaaaaattaaatatggaattacttgcatttgttttatccagaatgctaaaagatgatcatttctatacatatatgtgaataatcattaggataattagagtaatttactaggaatattgacaaaataatcctacacatttttgagaatgggggaataattgtcagttattaatatatttgtta

SEQ ID NO: 70615 - DNA, 1020 bp, Homo sapiens
tcccttctctattatcttcttcttcagattttttaacatgctcaacatattctgttacatcaacattatgcttaatggcattctatactaattgatagccacttgatctatggcacaaggtattctctagttatttttaaaagattatattgtactttggtaatatggtaaagctttccagaattgaacacacattttttaaacaaaaaataattttttgctcattttcttgttcatatgtatgtctaaatttacaacttttatgtgttttcttttatacatacagtttataacttttaacttttctaatgaatgggcttttctaggggttttaagttcaattaccttcttcaaagccttttacctatttttgaagactattttttttttacttaataatgtaggtaataatgtaggaaaggtagtcaccataatacacaatacacttaaatgacaggcacacaaaacatgactctgttggaagaaaagttgatatatgatgacaagttaattttatattttctttccagactcacaggcaatttaagtgtttttgtttcctcatacatatagattcattgtcctgctttttgatttggatacagacttttgagtacacgtgattgcactcaattgaaacatgtcttcagatggagtcacttcagctagggtggatgtggcagagtgcattactgttccaactctttactccctctccagtagtagaattacatccacactctgccatctatctttgaagtgccctcctactattgggataactgtagctctccatcacttggttctaggtttaaaaggaccttgctttggctagatattagaaaatgtaatgtaaaccaaggcttgaaaagcatttgtgtaattgggtcttctttcttggcctctacattgacatgagaagaacatgcaaggccagcattctgtactgttcccaggaggagaatcataaatgcatggatcagatccaacccagccaaactgactgcagatcagtccact

SEQ ID NO: 70616 - DNA, 1027 bp, Homo sapiens
gacgctgacttcctcagcgcagccagcactgtctccggtggcaagtcgaccagctcctcccacacggattctgtgtagaaatccacggtatgtgcattggaaatggacagggcatccctcaggaactgcagcagtccctgcaacttggcacgcagcgtgggcaggtccggggtcaccgggagagggcaagaagccgccatgacgctcaccctccgaggctgtaggtggcgcaaacatggccgtgaggcgccagctcggcccaaattagcacaggcaggctcagtagagctccgagccggattccttctgagcgattgattgcttcggcttggtgacgtattttgtgggcgtccgtcgtggtcttctgatgacgcagttagtcggctgcaatggcgccggtgaggcggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggtatgtaagaaggcaaccatttgcaaatcctcaggcttgctaagttttaggatataagattcgctgaagcttggaagaaggatttaggaaccagacccggtcctacttggggcaagggaattcattcctgagcccgctaaagctgtgagcttcgcagagctctagataggaagacggagcagtgttgctattatttaaacgtcttttctgacgtaaccctgtatttcatcagaacttttttcctatatttttcctgagaaactgagcagagagagtctatgaccctgtgaactcttgcgcatgtggtaaggtaaaggatagagaggaggacagggccagaaacactgctccgaattcttccttattacaaatacccgaggccctccagccttcgctttaatttgtgtttgtcattttgtattgctgtctgtaaggtctcttagatcccacttggaatatataaatgttaaattcagtcttccga

SEQ ID NO: 70617 - DNA, 1103 bp, Homo sapiens
caattaccaaagatttaagtcaaaagtcaactgctgtggaaggcaaagccttaaaatgtttaagtttgcattgaataaaagtaaatttccattttagaaaacatgttcaattcaactcaacctattgagcattgtctatcagagttttattgataagggagaaaaatcaactatgaagctatggcagtagtactggagagcattaacaaggtttgaaatacagtagtgatgtgggagggggttttcaaatgaaggacatttttacatcagagttgatgggtggcttagcatgtggattgatggcacaagaagcatttcaggtaatgtaaaggcttttagctttgccagtgggtgagtgataaggctattaaacaagttagaaaatagaacaagggaaaggttttgggagcatgaaaatgttcagttgagttttgaaccttttgaattgaagacatctgtaggacatttatgcaggaatgaatacaaaatacttctgtgtcattgtgaagattataattaagaggacactgttgatttcttcttgaaactctgggccatgagacagatctaggctgtgtgataatgatgttagtgaccttttcccaaccctgtaacaacaaaatctcaaatttagtacataattgcgttttactttatgtcacattctaaatgttttaaatcacctttttctcatcctgagattataaacattccctgggctattgaagtccttgtagtggcctcagtgattgctattaccatggagccttaggagaatttattttccttttatagttgatgatgctacaaactgtactgagggattgctgtcattcatgcaattcattcatgccttgtgcaaagtattgttgctttacaactgggcataaagcataggtttactttgtttcagcaaatagatatcataataagattttacaaagatatttctttttcagagacattaattattttatatgtaaaatgactttttaatttcttaaaactttttttttgactcagggtcttgctctgttgcccaggctggagtgcagtgtcatgatgagggttcactacagcttcgactttgcaggctcaagcaa

SEQ ID NO: 70618 - DNA, 1785 bp, Homo sapiens
tcagcctcccaagtagctgggacaatgcttttctttactgctgtcctgcttgattttctttgtttgtccactgtacttaacaactgtggcatgctaatggaatgtgggaattaagaccaaggtcttaattcatactaccttggattcatccacctagtgtctgtacaaactttgatacattacagccttcctacgtctcagttgtttcctctgtaaatgaggataagagcattatgtctacttataaaactgtcacatgaaaggtaaagtgcttagcacagtgcctggcacatagtatacatacagtaaatgttagaataatagggatgaattattgtaagacctaacagtactctgttttccttaaagtgctgtataacattcaagtaggatgacagacatttatttttatttactaattataaatattatacattcagtgattgttttactttatttttatttttaaaatattatatgtttttctgccttgagatttttataatccaaggtgtatatatatgactcttctatctttgtccttgtacactggtcccttgtatacaaacaaacaattgaaaaaaataaactgagatatatcctggtctcatatttgtagaaaataatctctcctgcctctttccttcccttcttcccttatgaccaattagcctatcttttaagaacccatcttataacttgtcttatcagaaacctctgtggactagtggtatggggtacataaaaagtaagagtaagtaaagatgataagtaaagcatgtataaagcagaacagggacttccagtagagggagatgtaggccaaacaatcaagccatataatatgcaggtgcgataggcagcaaatttaaagttttcccttcataaaaaatctaagtactaattaatttactaaatataagttaagtaacactggaatttctgttttgctggttgccaaatccaaagcgattatacaagtacctagggaagaactgtgaggaatatatgtatgtattgctattgtcccataactttctcacataactgtttcagagatggaatgaagactagatcataaacagctctctctctctctctctctctgtcttcctccctccctcccccctccctctctctgaatctttaaaaatagcaagtaatggaagttacaggctggataacttgaaaacaaataaagtacagcagctatatttccataattcaaaaatattttttcatggagttctagactatctgagtaaaactagggttagaccaaaataccataaactgttagactgaattagaaaactacccttttttaaaaaaaaatattgttgtaaagataatattgtaactcagatctttaaatttctgaaattgctgagacctgtacttaaaggaaattaacagcatttaattcatgttggattggatttttttcaagttttttctgtaggatagttaagttgattttaacgtttacatttccaacagaaatatcacaattctttcttttggcaacattgtccaatagctaactattataatggtccctttgcacttggagatttaatactcttattctatcacactctacaaaattgctgccttggagcttggggatgttgagactccccttaaacctgagaatttcacttaatagttgactgagttttccagtttgtatcatggctaaatattttgatgtggattttattacttttggctgagttagtaaattcagtttataaaatatccatagaaatttacatcattcac

SEQ ID NO: 70619 - DNA, 1780 bp, Homo sapiens
ggacagttcgtaaatttaataaatacatcactattcagattttaaccaacctaccttccttccttcctccctccctccctccctccctccctctctctctcccttcctccctccctcctttccttcctccctcccttccttcctcccttttctctctctctgtctctgtctctttctttccataaaaaaggcctgattgtaatttggagtttcaatttttaattgcataaaatattaagagaaaactgggtgttccatatagctaatcgtttaaatagtaaatataaatggagccattagatatattgccaaaattcacaacaaaatgaaaatattggcatttgttatacaaattaagtgttcatttgttgtttattaatatcacactaattaaccattaattattgctgaagactttttctgtcttcacttttttaggtatgactgattttcccaaaatattttgtgaaacttctcagaagttggtgagtgtggaagcctttgctctggctgcgaaatactattctgtacaaaacttgggaatatgtactccttttgaacagttgcttgtagcccttcgaggaaatcaaaaccagagaattggtatgtctatttatgtgtgtgtatgtgtgctttttaggtacttagaagcaatactttgttcatatatgtgtatctttccaaaatattattaatttattgttagaccttaatatataagccctgacaaattaactattgtttagaagtgtaggttttccccttgtactatattaaacagaacaacttgtagatgtccacatttttttcttgtaacttcttgtaactcttgtaacttctactgcagatagttcctgcccctcaaacacagatcacagtgagctactacaaattccaaaatctacattatttttgttgcagcaggctaatgttctctatgggaagagggtgggaagagtggaaggggacatttggggatgtggggagaagcatgagtgtcagaaagtggggatggtacaaattaaaaaaacaaatatgataatgtggtagattaaaactcagccatatctataataatattcaatgtaaattgtttctacatgccaattaaaaggcagagatcagaaggctgtggttaaaaaaaaaaactcagattcttttatcttacacaaacctctttcatatctcttatttgatccttatttttccccacctttttattttgaaaatttccaaacctacagaaaagttacaagaatagtacaatagaccctgtatacttttcacctagattcaccatgtgttcacattttgccacatttgttgtagttctcttctacacacacacgcgcacacacacacacacactctttttctgaatcttttgaacataagttatagatattttagcattttactctcaaatacttcactctgtatctcaaaataacaagggcattttcctacacatctcatagtttattggcacactcaggagtttaactctgatacagtaatattgtgtaataagcagtctctattcaagtttctttactttttccaagaatatcttttagagccatttttttttcttcatgcaggaattagtctaggctcatacctggcatttagttgtcatgtctatttagtcttttcaatcttaaatcgtttcttacccttgcttttgtttttcctgacagtgatacttttgatatctataggcaggtttattttattgtttccccaacattagattcaggttatgcatttttgataggag

SEQ ID NO: 70620 - DNA, 1189 bp, Homo sapiens
cattataaattattttatcaagcataaagttttgcagcagagggaacctgtcatacacagtgagaaactccactgggaagctcctatcacagtgtttgccaaaccaacacaatgttttccctcagcacctgggttttgccattgtatagtcatgcataaaaataccaggacagttgtatctggactgattcattaataaaaaatgttttaatgtagatatgactccattaaagtaatatacatgtcttttaaaattgggtgtttattttcttctttatatacatcacactttatatacatataccttgagatcacatttccagcctgcgtttttaaccaaaggataagtgaaatactagtacattgatcatataaaggaattagcagtggagatgagaagtagaaaaaaaggatattgtaaatcgggctatatatacctggtgtattaggcagggtgatcatacacatacatgtaattagatttactaagaatgggctgacacaattatggaggctgacaagttccacagtatgctctctacaggctggagacccaggaaagccagtggtgtacattcctgtgtgagactaaacgcctgagaatcaggaatgccactggtgtaagtcacagtccaaaggcaagagaagacggatgtctcagcttatgcagtgaggtagtgagggaaagaattcaacctttctctaactttttgtcctactcagaccctcaatgggtttgatgatgcccacccatactagggagggcagtctgctttattcagacctcattcaattcaaacactcatttcttcccaaaactccttcacgggccatccagaaataatgtttaaccagatatccgggcatcccatggctcagtcaagttgacacatgaaattaaccgtcacacttggcgtggcccagtaggaaacaaatcagagataataaatttaatcattgtattgtaatcattaccattttactattaccaactctctccgtttgtattttctgggaaacaaaacttcatacatagagtctatatctcagtgatttaaattgaagttacagtctggtgaaggcagaaagaaagtagcagtaggggctcagtccatatttatggaatgaattagttaattgccatgaacatataatcatcgtgctgtgattttctttaaatgtcttgaat

SEQ ID NO: 70621 - DNA, 1013 bp, Homo sapiens
gaacatacccccccatcccttttaagtacgtgacctggaatttgcacatataatttctgcccacattcaactggccacaacctactcatgtagctatcctagtagttgcatggaaatctgagaattgcagcctctagtctcagcagttgagttctctgttagtactaggaataaggagagaacggatgggtaaagggaggagtagctgttttattggttagtaataaaccagtttgaataaaatagcacacccctgtctctctagccctttactttttacagcgagatctgtatttctctttttatttgtcaggaaaaaaataaaatacttattgtaaccctttcatttagcaataatcatgtctcacttaaatcataaaagcttcagtaaaacccaaaccagtctttgaagtcatcttggaaatagaagaagtagcccagagtccctaggacttggataggctgcaagggctctatgagtcctatgcaattgtaactgaaattgtttgttaatgtacatttatatagcatgagtgtttaagagcatgagttctggattcagattgcctgagtttaaattccagctctgccttgtgcttgatttgtaagtaaggcaattgacttaacctgtctgtctgtgctcagtttccctatctggaacatgagaataatagtatacctacttcacagaattgttctaggaactgaagctagttaatacatttaaaggacttacaatagtgtctcaatgttaagtgctgtgtaaatactagcatttttattgatacataatatttgtacatatttacagggtatatgtgatattttgataaatgcacagaatgtgtaatgatcaagccagggtattcaggatatccatcacttcaagcatttatcatttctgtgtattgggaacatttcaaatctcttctagctgtttttaaatatacaatatattgttgttaactatagctaccttgctgtgctatcgaatattaaaacttatttcttca

SEQ ID NO: 70622 - DNA, 1028 bp, Homo sapiens
gacctcagacaatctttgtatttctttacttagggtagttatttctttcttgttgtgactcctagctgttattatctttattccacctccattaagacaaatctacattctcttctttttcacacatatccttcctgactcttaaatgctccagagctgacttggttggtcttgaaagtatttctcatttttaactggtaaggactctatttgggcattagcttattgttcattgattataacttttctttcttattcactactgtttcttttatggtttctttttttttttttttcagaattactttcacaatgagaattagcctcagggtaacactttcgctcgtaatggaaaaattattaagtcatcctctgtgtttagcaacaaaggtttctgacagtcacgtgtggttccaacattctggtatttattttatttctgttttttttgtttcttgtgcttatatatgtctacatttttttcagctgcctactgaatcactcttctatcgtgctgttcttcaggatattattaaagattgttatggcatcaccaaatggtatgaggattttattttaataagaataactatgttatattgtaagtaaagtgacttttagtcttcaggtgaatttatgcagggtcactgttattagtagaagcaactttgaatttgagcataatgtcaataacaagtacacaacaactgtatcttaggttaattatcattaaagtgggggctctaatgattccttcttgtcctgaaagcttgttgtaatgataaaataatctatgtaaaatgtactttagaatttttgaagtattaaaatattaaatagttcagtgacgatattatatgagcaagagtcatatttagaatgtttcataaacagcataacactttaattagaacagatattgatcataaacaactattatagcataaacacttaactctaattagaacagatattgatcacaaacaactattatagcccttcaggtctctgctagtagaatactagca

SEQ ID NO: 70623 - DNA, 1037 bp, Homo sapiens
tcctctctaacctttcatatctgctttctctcctctatcaccaggttttcatcagctcttactatctaatatattaatagtacatgttttatttatttgtgttgttgatcatctcccatctcaaatgattttttgtttcctttcgttcaccaagtaatagaaccaaagaacctgactccagagtattttagaaaagcttttgaaagaggataaatcagactttgattattctgtaactgttctccagattgttgtcctaaagtgcaatgattctgtgaaaatacctgggaagaaaagaatttcttaaaagtgaatgcttcatgcagtatcctcctctttaagacttaagtgcgtatttatattttaaagactcctaatagtttggtgagagacagcagcgtgtcaccattaagaacataagcacaggagctctactgcctggtttctaatcccagtatccccactgcatcatatcactgtggtcgtggtcatattattttatatctttttgcctaagttttcccatctgtaaattggggttaatagcagtacctacctcaaaagggtgttttgaaaatgaagctaaaatctaaaaagtacttacaacaatgcctggaacatactgattgatttttattattattagaagaaatctctttacctctgttgaaaccatgcttacttgttcatacaatctttcttctccgaactgtgtatagacaattaaacactgttttgtggagcccactctgaaaaacacaggaaaatcatgaaaataattattctgatttttagggtctcatttgggatttaagtgattatttgcctatcaactccaaaggaaatgacaataacaaaataaatattttgtcataattttctttaatatcacaaatattgatagggaactataaaatactttcaagaattcttctgaaatattaatatgtttaaatgttaatattttcttttaactacagtaaacagtttatcttaggaacacagtgtgacatcttttctctttggtgaatggtttt

SEQ ID NO: 70624 - DNA, 1019 bp, Homo sapiens
gaaaaaattataatgaactactacgagaagtataagcctcgaatgaatgagctggaagcttttaatatggtaaatctcagagttaagcatattaaattggatatgttgctagacttgaatagggtcctattaaattttattatgggctaagcaatctatgttgtttttctcttactgtagaaaaactgttttggatcatttcctatttcaggactatattaggtgtcagtaatgtaataaagagaacacatggtagatttctcttaaaaaagtattataaatgcacaaaaagtttcagagtcctttgaacacatattggtcccaatgcagttatttcacaagcattccttttaatgaacttcattcttagtacccctttaaaagctttctatcacatatgactgcttgttggagtctacctcacagtcacttaaaggacattcttttcctattattaaagaaaaccttttgatctctgaaatattcattttctgaagatgtacctggattttggagattcagcctatataaacttctgtagatacatttatttaaacataagtttaaggaaataagctagtcttttttttttaagtaccaccaacctacctatctaatttttttattttagttgaaagttgtactggctccctgtatagagactttgattcttctggatcgactttgttacctgaaagagcaggtaaattatgttattttaaaatacacaacaaatatcttattaaatacagtaatatagagccacttatatctaggataagagtctttcacataaaactagtaagaaaatttttctcattatattttcatagtttaaatgttcattccatccctttttaaacatataaacatatgtacaacagatgttttcagcaaagctgctataataaagtttacattcttttaattgtatggtaattactatacataggcagtgaacataaactgctatatatgaaatattgtatagctgaaatttataaaggctagacataaaa

SEQ ID NO: 70625 - DNA, 1045 bp, Homo sapiens
gctgcagggggcacactccgcagtggctctgaagcttccctctttaaggctcaaagtgcgtcttggaggaactggttcagcacctgatggtttaggcgacacgtaaacattaacacctaaatcaaacaccggggacgtgaggcgcgctgggcgggccgagggagtttccgctcctagtttgcagcaggttctctcccttgcttctcggctgttggcagacgcttgagtttcttagcggaaatcccggcaatttgggaaactgtttaatgaacgtattaaattaaagtcttaggtattccttgatgcaacaaagcacattaagtgattttacgtctggttgggaggaagcctctcctcgatccctgatagatcctccctgtcccgtttccttttattgatgggacacttttatttcccgaagttaaaacacacgtttgatagttgccaaaattgtgaaaagggagatcgttctctgctttaactttcccttttaacgtgtatagacttttactttgagccaaaataatgctgctgatggtctctcccgccgccctagcctccttcaccaatccattgggcagcactttataaaagcctcggctttctcatttctgtttgggagttgtacattagatgttagtggttcttttgtactaattggagaagaagacgcccctagagactgaagttgtcttctgcacttaggttagtttgggtggctaatgagacctgaactgtgttgtcaaagaaactgcatcgatttctggaaaatgtcaccgttgtgttggtgtctcttcctatcttttaaacgttattagtgttcagaaagtgatgaaaagcccctatatccattagggaaaattccaatttgtgtccttccggtgtcttaatctgattacaattaaaacagatgcataattaaaatatattagggataacagcacgcctggctaaacttattaaccgtcctggggtgtttcatgctccattgaaattaaaccatccaaaaagtgagcacagatttactttgacagcttttcagcag

SEQ ID NO: 70626 - DNA, 1126 bp, Homo sapiens
tttacccttaaggctctttgaaaaatctgtggctgacaaacctactttcttataactttattatactcatctgaagtgcttttaacacagcaactttcatctgttaacctttctggttctctcttaggagcagagtattgtatcagctttggatacttattttaatggcttcacaaaagtgacaagtgtggcagcctccaaggaaaggaacggtgggttattgaatgtaaagacctctcctctataaatagctgtcctcatttaggagctcagttttttaaaaaagtggagggatatttcagcaggactgcataccttctttttttcattgggtgaaaaaggcataatattttgaataattgctggtgtaattacatacagtgctaaatgtttctttgaagatatgatttgtatgtgcttttgaggaataaacttacattcaataattcacaaattatgaatattactacatatgagcttctttgtatatgtagtgcatagtacaactacagcactgcttaccttgttaacaagcatcccacaaaacattgtgcattcttacctgtactttagcaggtactgtaaagggtttgaatctgagagtctaatgatagatctatacaaatgctgataggttgacctctggcaggtggaattccacttgaatttatcacttgattgttaccttttaattattttactcatgtttatttttattgatactcatatttaaaaactttcattgggagtctgttagcttcttttccaaaacactcactcctaagattcatgattggtactttggcctggccttattttgggtctgtacttactggtgcttcattcatacatgcagaagctttggaatgcctcttccaaatgtctctttcctacttgttcaggacagtcgtttttcttggatgtctgaactctttgagttgactagatttgcctcaacttgtcatagggattcaagatttttgcctcaggtttttggccgtattttcaagacagttaggtccaaaaagatgcagctcttctaaatttctgtctcaccctcttcctctctttttctcctctgtgtttacctttccagttatatttgtcagttgttttgatactcaag

SEQ ID NO: 70627 - DNA, 1057 bp, Homo sapiens
ggacacttgtcattacagaaccattccgaagaaggggttctcaaagtggggctggcagctgaaattagcctatagtggttcctctgggacatttctcatggttttgtaaattggtttttggctacttctgcattcctatcttcagctttaagaaactaggcctgttgccttcagttgtaaaatgtctcaaggtaaaatagttgggttcaaatgttttttcaagtatatttcctttagaacaagttcctcctctcctgccccaaataattaactatacaactgttctcccaaagcaatggaaaagatctcattttgacaaagcaagctgtttatgacaaattttccaactagaaatttgcagaagaaaagttctcaaatgatgaagaagcttaatcaggcaaaaagacatttttatttgcagaaataggccctttagagggaggcaattatttatagctgataggaaaaactggtatacctgaattcgtttggtaaacttcatttaaaataggaaggttattcttgttattctagtgaaagaaaaaaaatatggtactgaattatgttacagatttatattaaagaaacaaagttttatacattaaaccactcttacagggatatatactgatttaactaaagaaaatgaatttgagatttaataaaaatcttttaaagataccagtgtgcagcttgaaatcaactatagtgtaccatgaatatctatttgaaatacccagttgaaatgaccacattaagattgcttcctttcacctctctatttaagtttaaatttactttttttcttttataaacagtggtgttttttggcttttgttccatattgaacagaggatgaaatcagtatttcaaaacctcttgtatgtcatcaggataaatagtgtagtatttctaggagggaattattggttggccacttttcaatacactcctggcatgatgttgaggatgcctgtggctggcaaggagttttagacctggccctctgataacttgcctccctgctttcatatggacaattgactttttaaaagtc

SEQ ID NO: 70628 - DNA, 1027 bp, Homo sapiens
attcggcttcatctatctttatttttcatgtaatctgtcaggcaccatgttagtggaatgtcttgtaaataatgaatcgtatagcctctggtctcaaggatctcataaacctactggacagatattatgtattttggtttcctacatgacatccaagttcatgaatcttttgaattctttccatacaacccaggatgcaagcttctggtaagacaaatggatatttattaagatcctgtaagaaacaaggcagaaaattaaagtcattaggagtatagaaataaaagatttcttgggctttcacctctgtaaacttgaggagtttggctaagtcagtagttggaagcgtagtaaggtcagaagtcaccgtcaacttccgttaaatcccaaagcttacaattatttaacagaggatcacctacgctaacagaatgttgggattttgtttgtttggggttttggtaaataattatatacattcaggggtcttagtactgggtagcttatataagtccaaaaatatgattgttagccttgccttttgattaataaaatgggggaaatatgttgttaaaaaaaaaaacgaaaaagggcaagaaactatttgaaaaccaggcattgggttgaattggaagtgaatacacttcaaaaggtctgaggagaaaatattagaaaccactgatttggataatgtctaatagctcttttaactcttagtcttttacctaaatatccttgatatttacagcatagtaaaatctggttttccaaggattctgatgaaagaaaagaaaaaaaatgaaaacagatggacaatctgagaagtaactagtgattgatggtaaatgtgaacaatgcttcagaaaggaaatgaaatgtctgcagcagatagaagtgtgtaaattttgccttcactttagagctagaatcactatgagtggtagcatttcagaatcagaagaatggaaagctcagttgattatcattacacataggagtaaaaggaaaggttcacatttttattgac

SEQ ID NO: 70629 - DNA, 1039 bp, Homo sapiens
agtatgaaatgctatctcgttgttttatgttttcttgatgattagtacttttgaacgtcttttcacatgttttcttgtcatgtagttatgaatcttgaataaagcaaaaagctctagattttggcttgtttgtcttgtccaattcccaatggcctggttgaaaaaacattttatttgggtctagaaaactcagcaaagaatgatgtcacagatgtttctcacctctgctgtgttttagctgtaagtagatcaagaaaggaaagcaagactagaactaattgctcatcaagaaaggatttacaaatataagtggttctgatacacatttaaattagattacatttaacgacaggttttgtaaatgaagttaatttgaaagggcacacagtcattgggtttaatctgtaaacagctatcatccttcctcctccatccagtttctggtaaataaaagttactcttctagaagagtatttacttgcatgttgcccatgctgtctgtcagtggcagctgctgggtcggtttataaggggatgctacctggttagggacgaagctcatatttttgcagttttcctatggaccagaaaatattgacaaaggagaaggaaataagattttctgcttgcttttgcccttataatagtttaaattgtttttttaattttgtttttttctttctgaattaaattatggtttagccacttgaactactaaaattaaaaaataaaactagaaataagacttctttattatagttgctgctgaataggaactgtgtctcccattatgcagtgaacctattgtctgaaaaagacccactacatccaacagttaactgagataatttctaaaaataatggagtaagagcataactgactaatttagcaaactccttgacaaaaattccaagttcattttgatgagagaaggcaaaaatagagattaaaatatgcacgctatttaaatatttatggaaaagtcagtgtcttgccctgactaaatttctgagatttctttaataatatgtgtgacta

SEQ ID NO: 70630 - DNA, 1029 bp, Homo sapiens
aaattagcagggtgtggtggtgcatgcctgtaatcccagctacttgtgaggctgaggcaggagaatcgcttgaacctgggaggcagaggttgcagtgagccaagatcgtgccattgcacaccagcctgggcaacaagagcaaaactccatcacaaaaagaatcacacacatacacacacacgtatgtatgtgtatatatgtatgtgtatctctatatatatgtgggtaagcttcttatatataaacctaatacatagtttgtgctacgcattgtttgtctcttaaaatgtttttagtggtagttaaatgatatgttcaggtttgatgaataagtgtagcttcttgttttacttgaccccaataaatagaattccccagtgaatcttatcctttgcttatttcacgtcaaatatgtgcatagcacctctttgacggtggctcagagtatgtttgctgacaactggaggagttaaagtgggtggttctctgtttttataaccttcttttcctgccttggggacacacgttacccagaatcacactggcttctcctgagtatgctaaactcttttaatttagactgcttctactttagaaactaatactcacacatttgtatttacactatgagaaaacaaaatccttgccctcgtagacttacattctcatgggagacatgggaagcaaacaatttttttacttgcttggtgtctctcacctgagtttaaaaatctggacacagctccactttgtagatttgatgcttttttgtttttttttaatttggtataaaagctgtactgtgattgtgagacacagcctcagcacaaagaactgaatgtcttcatccctattggtccaggtgggctcctattctcttggtctcttgcagccttacttgttctgtggctcctcagagcagatataagcagtagcaatgctagtgcttcaggaacaagggtaaagattgtgttaacagatagaaactgtttgtttttctttctttctttctttctttttttttttttt

SEQ ID NO: 70631 - DNA, 1013 bp, Homo sapiens
tgctgtatttggggtttgctttaaatagggacagtgaacttcataaataatcaagatttttagggagctaggtttagcaacacattgagtcacatctcttctgtcttctgtttatccctgctcagctgtgccatggagtagcacagctggctttaaaatatccaacatcaggtgtcactgtcttgcttttattagacccctaggctaaaatcaccttgatcacttgttcctgctgttctcgagggctgctacagtgagaatttctctctcttggtcttttcatcatctttttgaatgagcggctctcttaagccaataagatagaaatatataccctgttgaccttgtggcttttcttttctgttaaagaagcattcaggcagataccagatatatgaggcggtcctttcagctgctcatcttttccactcatcacttttgccctcctaccctcaggagccaggtcattctccgtaggtgagctgtgtaaaatctattttatagacgtatataaggagaaaataatttatttctgcagtcttcatattgtcatgccagtatgctagctgaaaacataatggcttttttttttttttttgaggagaagttttctggttttttagcaaaagagactgaccatgtgtaaacattctttaaactgtttcctcactgtggttttactgtgtggagggctaaattttaaaagtaaatataatgttataacaatttgcttattaccagcaagtttttaatattgaccaatgttttatgtattgggtggcttaatggttttaactggagaaaactgattaggaagacagttattcacttctgtttgctgaactggaaggaagtcataaaaaaagaaaacttcagaagctgacttttttcaaagaagatatgagaagtttagatataacttgtgaaatttaggtctctctcatgagattgccaaaggcacagttaaattctctgggaggcccaattgattattgtgtaaagctgtttaaatt

SEQ ID NO: 70632 - DNA, 1049 bp, Homo sapiens
atgactttcactgtatacatggctttaactctatttaatagaatgttcctgtgaagctgaaaagtaagtggatcctgtttttgacttagtggtagagcttgcagtttaaataattccactgggaatctattaggaagcaaatgagagcctcctccagagatctttgagagaggcttaaggaagcattcctctgttatttgttgtgctatgttcatctggttctaagtcaagataaatattgcttcatttgtatagttgttttcttttgcaatttgctcatgagtgaaatctctttaaaacgttaacatttgattaaatatacttgaatgcttacaaagagtttttcatataatttatcttgtttatctttatagcaacattaagggactggtagatatttatgttcctcttggtgagttcattgaagagcaatctgaggctttatataggttaggaaatacactttttatattttgggaatccagcctgtacagtgcttattatcaccatttctgcagttatgaggttactcttgaagacaagaaaatatttattaatgaattttcaaattgctccttatttgtatatttctctctgcttaatgctaccaacatttccactctttggcatcaagtgttgataattcttttactgtcttctgtgaatatctcaaaaccacatgcaaatgcattgcaaaatgcacagtcagattttacatcttgcaaaggatgcaggattccatgaagtcagggaaagtggctcagtaagatctgcattaacatataaacccctaggcaaattggtatggcaggattggatcaggcaattatcaccatagataatgacaagagaagcccttcaagagtctgattgaaatatcaaaggattacgtgagactcttgggaaatcaaaacccttgactatttttggcagaaacagtgtttttgttcagattttactgtaagttgtatgaagtaagatttgtgtggtcctgttatcacttaagaaatataaattttaccttattttatatttataaaagaatatga

SEQ ID NO: 70633 - DNA, 1014 bp, Homo sapiens
aaaatgaccaagaagctgtcataagaatttaaaggaacatttaccctcatctttaaaatgtatcttaaaagagagataagattctaattacaaattttgaacagtttattttctctctatgaaaaatttccaagaatgatacaaaagcacttttatgtgaagaggatacactggaacattgaggtcttgatctcattttagtaactctctgatgtgattaattcataagcactgagttgtagctcattccttctggcaaaattccagcacttgattgttaccttataaacttttaataagagtaattttaaaaactgcacttgactcttgctttatgaaaagctggaaatgtaaaaagttaaaaatgcttgacaatttttctgagctctagtcagaaacagtggctatgcccttttatagatgacagcccaaaggcgagtttgtaaaacgataaataaattgtaaagatctatcgagtggcaacttggatggtttaatgcctatgggttagaaacccaggagttaatgtttaaagtgatttggataaatgtgaacatgtttaaatctttagtattattcctttaagccaaatgtgaacgatagttattttgacaaagtttgggttacctcgatagcctgatttttacagaagtaccgtgtatctcaaattgttaactgatgaatgggtggtgctgctggattatttcctgtgttttgtgtttttcttagttttaatttctttgttattcaagttatactatcacctcgtccaaagttgggtctcaggattagattaataaactaaccaagtaaatttgggaagtatgactaacttacataaagaaaataattggggttatttttttgtattattattttaaaatatgtaatcagcacttttgagaagctctcattttgttgaatctctaggcagacctttgtggttaagcatcatcctggaaattttttctgacagtcatttgaccaggtctttctgtttatactcagtgtcaa

SEQ ID NO: 70634 - DNA, 1086 bp, Homo sapiens
ctaagccttcctgaagatcctcccttgcctcttgtctccttctcatataaaaaggggttggctggaggcaaaccttcccttttgttgccattgatctgacactaggatattttgtagtccagtgagtagaaatgtgtcccagctgtaagattctgattgtggatttttcttcagtaggttactgatctttctttatgcctaaattcacattcttctaagtggaggatttacatttatgatttcatctgggtttaaaatctggccggaagcatggttatgtgtttaatgcaaatccgggggaagagtgcttcctactaagttgtcatttcatgaagaatttagcttacttattttctccaccatttgaaggatcctcaagggggtgatttttttctcaagggtacaagcttctgcagtaaatgaagtgaaggaatggaggagcaactgggaagggtggggaggaggaggatcaaagcagcaatcaacctcaaatggttctctcctagtcttggtttgctcaattgttgaaatatgggattgcacctctctctgcctgctatgtccaagattgtgatacatgagaatgtttataacaatattctacaagttgtagaatggagtacatggatgatgagaattctgattatagctatattttccattaattattagcagacatgaatatgtagagtgggcctgctgtaaactggagtggttcttttttttaaccagttcacatcatcattccaaaacacatgtatactacatatatatttaaaaatatacacaaataatacttgaatagtatattttgaatattgtaagtctaaaataaatggaaacccgaataatgtgacagaaatagaagttccagatatttttcccataccccagttaattattttgtgcaactctttccttttttggcatgtggaagccactttgaaaggcattggctaggggactatatcttagagaaggtgtgttgggagaacctgcatattaagtggaaaggatacatgaaattgacatggtatattatggttaagtatatctcctacatggagttgggtattaggtctcatg

SEQ ID NO: 70635 - DNA, 1093 bp, Homo sapiens
acattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaagtaagtgattgttggctcttgagcattggattactgagtaatctacttgcttactcctttgccaccatttaaaaagcaaatttattcctctgcaagcggaatttaaaataagttcctttttgatcttcagtaagtggaagtgtccttttgacctttgtactaagcagggttttagtcactgattgttttatttctctggtttcttactttcatgatttcaagggtggtagaagaataattttgccttgtaaagaatatgcacctttattatttattgagttcttatttctatatttctgcacaaattgtctataatctgataaattgtctataacgtgtatttgtaaaaaataacacggctgataatagagctagatgctagactttacaggggaaatcctctgccatttgttaatattacttttcctgagttgactttggaaaacaatccttccctttagtgcactgggaagtcaaattcttaaacaatgaatcatactcacctttttctcgtgatagtgcataagaatagaaaagtcaaaacagaaaatggttattattgagtttctccctgtggccaattaagacctttgccttagggcatatttgttctcccgtattcccttagtggtatccagtacaaagttgtttgaaggccacagaagcattttaggatccccatacacttgaagagactgagcagttttctgctagagcattaaggagaggcattgagcggacggggcatcttgagaaattgtctgccttcccatctccccatcct

SEQ ID NO: 70636 - DNA, 1065 bp, Homo sapiens
tctctcagtaactctgtctgcctttctttttgtctttcagttagcattatgcccctaaattatagttgtacaatattgtcaatccagtctatccaaatacttgtgatcaacattgtgaatcaccaccaatgtttatcaaaatgaaaactactactgtatcaccatcataatacgttggaatcatagagtggaaagggaaaaggaaaaagagtgggaagaattgggtttgggaccgagcagtactgcttaccgcctttgttaccttgaagaactaactttattcttcagggtccagagatctctggatcaatatggggatcagttaagatcgtataagtatatatgcttcaaaaaatataaaagtagtaaacaaatgtaagatacctgtcaaataattaatggaagacagactttctgacccactaagatagaggaagatctaggggctttgtatgcaatgcatattggacaaataattgcatgagaataaaaatgacttgtctggcttaaagattaacagccaactgttttcactagggaaattgcatggggaaagcaggtaataaattaacatgaagataattccaaaatattgcaatggacagtaatacatgtgactagtttagagattggcattatctccttggaactgggtagatttttgtcagtttcaggcccgtaaggtgcaaatatgcctgggaatgcatttgcccccacatcagaaaaagtttcgttttggatagatagcaagaaaagttgacacatgtgtcctttattcatcctgtgaatatcagtactggcagcaaggaagatatgctatttttttagtctttctataagtgaagaaaggaacaaatatatttagtctgtgaagtagtagtgcctgtgctcaaatagagctgtataatttgctgcttaatgataaagggagaggatagtcaaaggaaggcaaattccttccttctcattttgtgaggatgaaattagactttatcttggcaagaggtagaattactatgctgaaaacacagtatcaaaatgaaatttccctgtattatcagaaag

SEQ ID NO: 70637 - DNA, 1095 bp, Homo sapiens
tactgctttctattggtcaaagcaagtcacaaagccagcccagattctttgcttacaaacttgaagcaagtacaatattttatgtatgtgcaaagaaagatagattactaataattattattttcttctttaacaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttttaccaatgaacattggccctagtaggagaagcattaggcttcacttatcagagggcaatctcaggtgttccgtggctgtgatctttaatcctaacagtatatgtcagttcaacttgagcattcttttggattctttggtttacatttgtgcagaaaggattgcagacaaatcttaggagggctgaggtacatgtttgccaggatttttttttaagtacctttggtgtattttcaaatatttctatctcttaaaaaaatggtattacctcagtttctaataatttctgggtttagtagtgttgacaattaaaaatggtatacattaaaatttataagtttgccttcagggtaacttccagtgtcacaatgagcagttctgtaagtgggtgcctctcagcacatttctatgaatatattatgtagataggctgtattgattttggtagcattgacaccttcttaggcaattagttgaagaaaactgcaaaatattttcttatgtaatagctgtatagagcaatagcaatcaaagcatgagaaggcact

SEQ ID NO: 70638 - DNA, 1050 bp, Homo sapiens
cacaaaacatggagtgttagtgaagcaactattaacttttattggtaattgacctgttttgctatggaaagaaaaaaagacataatgggaaatgattgaggataattaatttttcttcatattctcatttcatatttcctttgatattcttaaaatatttaaaaaccaccatgtaagtagaaaatccccatgtacttaaaatctccatgtaaaggactgatcaactttcttactcataattatttgtttcctaaaaatagatgtttatgcttaagaacatattatttcccgatttaaataaactttggatgcataaatatcattgtatactccataaacagtaaattccataaaaattaattattctgaaacattattttgtagctgattctattatgtttatttttaaacagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacagtatgaatattaatttccatttgccttttttcttagtttttatcttgttatttatacttttattgatacatgatagctatacatatttatgagatacatgtgatagttcgacacaaacatacaatgtataatggtcaaatctgggtaaatgggatagtcatcacctcaaacattaatcatttctttgtgttgggaacattgctcattcattagcttataatggcatagtcgttcacaaactatacaccaaagaactcttatgtgctcatttgtatgttgttttatttttcagaaattcagagacgatcatgaaatttttgaaaatggggaacattagtcaggatattattccccatcatatcaacctttcaactgttactgcagaagattatcat

SEQ ID NO: 70639 - DNA, 1050 bp, Homo sapiens
catctctactaaaaatacaaaaattagctcggtttggtggcgggtgtctataatcccagctacttgggaggctgaggcaggagaatcacttgaatccgggaggcagaggttgcagtgagccgagatcgcaccattgcactccagcctgggcgacagagcaaaactcggtctcaaaaataaaaataaaataaaataaaaataaataaataaaaattactttgataagaggttcacatattcttactgcaggactgcataagaaatatttaacaggatacatttctgtttgttgcacagttgaatttttattgttcattgtgaatttacatgctgctatacaatggtagtacttttctaggaagcattaagaattcacttacaggtttattggaaaagaaattgtcgcattgctctttatattctgaaataattgtgtgttacttttctttctacagttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaagttagtatgttagagcccttcctcattctgctaatcaccatttctggattcatccctctctcaaattctgttacagatttctgtgggcaaatcacacataacacttcattctaggtagttaaatattagtgaaaagtgacacttcaaaagtgtgcttacatttttaaaaagacaaataaaaacagtgttttatagtgaaatctaaggttaattataatctttccttatttcaacaagatctttaaaatttttgtgaatacttaaaagtcctttctttttgccctttattcaattagtcctaatgtttcagttctctaattaccaattagttaaattatggaaattggggaaagtggtaaaatgagtaattcattcattttgtttgtttgatatcatttgtttctctctgctgt

SEQ ID NO: 70640 - DNA, 1588 bp, Homo sapiens
tcaacgttaatgccataaaatctcattcactctaatttttctgatttagaatgcattatttcaatgagtttgtataaattttaataaatgagttcataaacattgtgtgaataagatttctaggagtttgtgaaacctgccccagaaaagaatgaattttaaataatcaattatttttatggaaaatgaaactgttttactctttaaataaatttaagctaaagctattcattaatattcttaattttatcctaattattttattatcagaaactctttgtagaaatcaaattcaagtttcagaatctagaaagtgcaaagtaatgaaattgtgtcttcttcagagctctccataattgcactatatagtaattcaaatattatctttaatgggataaactgaactagtgtattttctactgtattgaaaatataatctattttttgttgttgtttctttaggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtaagtttccttttgttggtgtatgctgtaatctttatagggtttcaaattatataattaacatttaaatgaaactttggagtgtgtgttaataaacaactcttttactatgttttagaaaacgttactggcatatggattaactataaatattaatatagctcaatgttgttaatgcctgttctaagtcctgagaaagacattaactttttagaaaagataatgtgtcccaaataaataataaaatgaagaggattttaaaatgttaaataaaattttatgcatttgatctcattcttttaatggaagaggtatgagaggtttaatgggatatcattttattttgcaggtgtgctattttgtagctctctactacaacgtcatcattggctggagtttgttttatttttctcagtcttttcagcaacccctgccttgggatcagtgtcctttggtgaaaaatgcttcacacacttgtaagatatgtataatacagtgttttggtatttaagcattataagagtggcaaaggtacaagctttcaagatttttttctttttaaaataatgtagaaacatcattcaaaattatcattataacagactttgctcacattcaggattgacatactcttagagatagacttttgggaccatctaatttttttagctctttccaagttactttactatgccctaagatattagggtaaagtattataagccttcacttattaactttgataatctttattttgtatgccctgattgatgccttacattttcattaaaactaacagaaaggggacagaaataagaatttgaatgaaaatagttgcttttatgtctttggttctgttgtttcatacttttcccatcatttttttaaatcccataatataatataaatattataaagagcagtcacctatagtagtgatgtctagtaaacatagattgtaatgcaca

SEQ ID NO: 70641 - DNA, 1051 bp, Homo sapiens
acatgctgttaaaataagtgtggctgaaaataaaatattccataagtcatgcatttcaggacacaaagtatataaagaatattttggtatttgattctagtttgtgataattttattgactggacaaaaatatggtttatttttaatgtggttgtaatctacaaaccctacatcaaataaaataataaaacccatgcgtatgtaaattttttcctggccactgaaacatgaaactctaagatgttatggtgacaaaatatgtttaagatatcttttagttaattcaaacaggcacaaaacaaaaggtttggaaaaagtagtccatttggcaaatctgccttagaggtaaagatcgaacgtagagtcagtgacgcactgtgcatccctatactgaaaatctccttagctagccagtaacctcacacatgaattatttattaaatcagctgtaagcaactatgtactatcctgctttttgtttctcacaaatcattccatttgccaagactagcagaatatcaattctggttttaagacttttttgccttgtaagtcgtattgaccacactattaaggaggatagctgatttggctgaaaagtcaggttgacttccatttagtacaatttctgtcttgctggagagtgctaaaagattttatatgtagtaattggttcttagcacaaatggctcctccttcttatttccatatattaaaaaagtcaaaatatcttttctagtattatttcttttctactaaatggaaatactagaaagcagtagtgtacatattataaaataccaaccgatttttcactttagaatggttgttacagtaccaaagattgtactcaccattcagtatggcattgagtcttctaattgttggaggaatatcttctgactaaacaaccagaagatagtcctctgcctcaggctatcaaaatcttattcatgaatcacttaagcactttttgagtaatagaaaaaaaaggtaatagagtcaatataaagtttatttgcctagtgatattatccttttaaaacacaat

SEQ ID NO: 70642 - DNA, 1080 bp, Homo sapiens
cttcaaaccatgaatatgttgtttatttctataattatgttatttcacaaatgttatataaaaattgttatatatgtatttctttgaaattggcatttttatattgttttcactgagtatcatttcctttaggtacatgcaagttgttgcatgtatcaatagttcttttttactgctgagtagtggttcatggtgcgaatgtagcacagtttaaccattcacccattgaaacgcatactggatagtttccattttttttctattataagtaaagctgctatggacatttgtgtacaagttttgtaagtttttttttatttttctgtgatatatctctgaaatatagttgctggttactatgagaagtctttattagtgttaaaagtaaccaagttgtttttcagagtggctgtaccattttacatttccaccagcaacatgtgattgatttagtttctacatgtcctcaccaatatttggtgttattaatttaaaaaacaaagtttagccattctgataggtgtgttatttgtagcccaccttttgggaaaaaaaatatacatttaatgaagtataaatagtgacttggtattgttatttgtaaaaaaagttcccttccttttgattggctctgtaattttttatttgatagctcagtgcaaaaattttatgtaaaccaggatacaatttgcaaaatacatttcaatttattgaattctatattgttaaaaatatttcatattattcatcaagattattatttcagtatttcatgaaatctcttgatgaaaatatttttcctctataattataccataactataaactaattggcatacggtgacaatttttcttgagcattacagtatggtccaaattttgattttatttggatggtctttatttttgtcctatattagaaaatagaaaaatgaatttcatttgaatctataaataattaaacatttcatattcaaattagtttgtatttaaataaaacttttttttcagtgaaattttaagttgtcaaagacagggagataatttactagtgttctagtgctttattatagaatacta

SEQ ID NO: 70643 - DNA, 1243 bp, Homo sapiens
cacccctgcagggctcagtgaccaaggaagaatcagagaaagagcaaactgccgtggaaacaaagaagcagctgtgcccctatgctgcagtgggagagtgccgatatcgggagaacttgtgtgtatatggagattcgtgtgacatgtgtggctgcaggtcctgcatctgatggatgctgcccagagatcacagcatataaaatcatgctttgaggcccatgagaaagacagggagctctcatttgctgtgcagcgcagcgaggaaatggtgtgtgagagctgcatggagatgatctatgagaaagccaaccccagacagcaccgcttcgggatcctctccaactgcaaccacacctactgtcttaagtgcattcgcaagtggaggagtgctaagcagtttgagagcaagatcataaagtcctgcccagaatgtcggatcacatctaactttgtcgttccaagtgagtactgtgtggaggagaaagaagagaagcagaaactcattctgaaatacaaggaggcaatgagcaacaaggcgtgcaggtattttgatgaaggacatgggagctgcccgtttggagggaacggtttttataagcatgtgtaccctgatggccgtagagaggagccacagagacagaaggtgggaacatcaagcagatacccggcccaatgaaggaaccacttctgggaactcattgaggaaagagagaacagcagcccctttgacaacgatgaagaagaggttgtcacctttgagctgggtgagttgttgcttatgcttttggctgcagttggggacgatgaactaacagactctgaagatgagagcgacttgtttcatgaggagctggaagatttttatgacttggatctatagcaaccttgtgtggcgtgtgaactggtctgctgaccccagacagcagctgttccctgtggtggtgtggcagtgcctgtgttctctcctaggcaggcctgtcaactccaggtgctggcataagaatttttacccagggcctgtcttttcaacccctcacctttccccaaggagtgtgttgttttccctcttgaaaaaaagttagaaaaataaatcttaaagttagttttctgaaaaaaaaaaaaaaaaagaaaaagggaactagaaaaataaaaaagaacaaaaaataaataaaaaagaaaaagggaacttggcaaacaataccaatcgattattaaattttagaggtttccttagagtcaggaa

SEQ ID NO: 70644 - DNA, 1053 bp, Homo sapiens
tgggtgcggctgtgttcatggaaaactatttacaaaaaaagtatctgtccagacttgacctgcaggtcatagtttgctgaaccgtggtggagagtacaccaaggtggaatttagagttattggaataaggtgccagtgcactgggttatattctttttaaggaaaccaaccagcctttctacctttattcctaagtgtttcaaaagactttatttgaagaggtacgttttctagttctgaaagttcctttaaatgaatatggctaatggcaaattttcccacttagggttagggagcaagaaacatccattacatcttcttataccacatggagcatttcaaataagaaatctaccttcattgaagcacaatgatctcgtgtcctggtttgaagattgcaaagagggtaaaattgaaggaatagtgtggcattgcagtgatggctgtttaataaaggtaatggcaaaaatagctccggtggggttatgtcatcttatattcctacaatagagtagaagtgacactaaaattctctctacaaatggcagcaattcttatttgcagtaaagaaatttaattttctcatcccatgtaccaccattttttaagaggtaaaacagtgcttcccagtgtgtattgtgtggggcatcgatcataacaggtgtgcttcagaattaaagtgataactatatatcccctgcgtggaaattcatgttgcacagtagtgctctcagagacatcttgtactaacttaactcagcatctcccagacttgagtgtagaatctgttgagtaaaaagagtgccaaggtagcagttgatatatacagaatgaattatcttatactttgttccctttctgtctcctggacttgtctgtttgatttctcacaggtacctgaaattcataatattcaaaactgggcctagttgtaactctctgagtccacataattcactgaagtaaaaacttggatattaattttaacccctcttttcattacttcatacatccagttatcaattcctaacagttctaatctatgtacttctt

SEQ ID NO: 70645 - DNA, 1525 bp, Homo sapiens
cattcatgatctggcccctacttaatttcccagaactgctctccacctctgcccccgcaaacacactcacactgtgtttgctgtaaccatatttacatgattgcaattagagcaaaaaactccattctatcatataacattcctttcaattagaatgcctccttgcccacatttttcaggtagctagtctgtactcagcaacaggctctatgattcataacattttatggagcccctgataatgttcctggcatgtttccaggtgctggacatacacagtcaacaaaacaaggtgtctgccttcatgaagctcacattctaatggggaagatagacaataaacaaatatgtaatatgtcaggagaagaccagctataaaaaaaaaaacagtaagataaagtggagtcttacccagtacctggcagacagtgggcactcaaatatttctaagtgaatgaagatagtatctgtatgctaaagctaataccttttttctctttccaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattatattctaatcttgaatattctaccatatttaaaaatatctcaaggtttctgttcattatgaaacatcaatatgttttctaccatttgtgaagaaatgaattttccagtttcaagtacctattcaaaattttattaaaaaccagcaaattaattttaatctctagccataaaaacataagtaatagtaagctcctaagcttggacaaaggctggattctcttcactataactgagtggtaatttaaagacaacaatttaatgtcactaattttcaaaattaaatagtttaagctcaatttaattttgctagatatttaacaaaacatacggctcaacctcataacctatatgtgtgtatgtctacatctgtgtatatatcataggatttgagaatcttaacacatgtataaataagtatatataaactccaattttaaatcttaaaattgctgaatttaccctcatattctttaaaaaacttaaagcattatgaatgtagagaaattcaccagagctcactgcctatttgatggctgtaacaagtcttcaagtatatacttttataataagttgaaaatttcatataattttatttattaagaattccaatctaagtataaaggtacaaggtagtgagaaggaaatactacagttcggagaactgcttatttccaagtatatttaacttataaagttaataaatagttaaatgaaacaaagtttataggtgacctttagtaaatggggaaattaacaggactttcttcttcatcttcaaactcttcagaagcagcaacagggctag

SEQ ID NO: 70646 - DNA, 1050 bp, Homo sapiens
taaatctccttgttcaaacgtaaaatatgtatatttcctatatgcaacttttaaagataatgtttccattaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaacttattataaaagtatatacttgaagacttgttacagccatcaaataggcagtgagctctggtgaatttctctacattcataatgctttaagttttttaaagaatatgagggtaaattcagcaattttaagatttaaaattggagtttatatatacttatttatacatgtgttaagattctcaaatcctatgatatatacacagatgtagacatacacacatataggttatgaggttgagccgtatgttttgttaaatatctagcaaaattaaattgagcttaaactatttaattttgaaaattagtgacattaaattgttgtctttaaattaccactcagttatagtgaagagaatccagcctttgtccaagcttaggagcttactattacttatgtttttatggctagagattaaaattaatttgctggtttttaataaaattttgaataggtacttgaaactggaaaattcatttcttcacaaatggtagaaaacatattgatgtttcataatgaacagaaaccttgagatatttttaaatatggtagaatattcaagattagaatataatgataaacta

SEQ ID NO: 70647 - DNA, 1043 bp, Homo sapiens
catattttgtatacatatatatcacacatatgcatacatgtgtttgtatgttcatatgtacaatgtacatatcctcattatttgtggattctgtattttctaaatcacctcctcactaaagtgtgtatgtaatcccaaatcaacactcgcagcacatttgcaaacatccacagagccttggaaagtttgaataatccaacctacatgtccccagcagaagtccaacaaggcagtgctcagtatcctcatttcagttttcatagagaaatgagcagaggatggagacagtagagggcagcacagcatagtgcaagaagctgtggctctggggcctggtggaagggatttgaatcccaattctgaggcttgttactgctctagccttaggagagtcatgtaacacttctgaatcttgttttcttatgtaaataaatagaatttaccaggatgagttatctttaggatttaagattatcatctgtgtgagatatgtaggtgtatgtatatatatgcgtgtatgtatatatatgcgtgtatgtatatatatgcatgtctgtacatatttcccgtagcagcagtggtttgatattcactaattgggctaactttatagaccaaaactactatggatagagaatactttgtttgcatttacgtatatatattttcttggcaagtaacataaaattgaactaatactatacacatttctagcatatttgcctttaacagtttatcatggacatcttttgaggtctgttcataaattatctcatccatttaataattccatagtgtattattgcatgtataagcacatcgaaccatttatgttttgatggatatttagtttgcttccaagtttctgcttctataaaatatgattaatctattgacctaattatgccattgtgataggatgatagagatgccattctctccaaaggattataccaatttatatctgaactatctttgactatctcttgtagctttttcagtatgctatgtagtcctattactaatttgtaataaaagccatc

SEQ ID NO: 70648 - DNA, 1067 bp, Homo sapiens
ctctatgaaaactgaaatgaggatactgagcactgccttgttggacttctgctggggacatgtaggttggattattcaaactttccaaggctctgtggatgtttgcaaatgtgctgcgagtgttgatttgggattacatacacactttagtgaggaggtgatttagaaaatacagaatccacaaataatgaggatatgtacattgtacatatgaacatacaaacacatgtatgcatatgtgtgatatatatgtatacaaaatatgtgtgtatgtatatgcaggaatgaggaatgattagtaatcacttttgaatgggaatggaagggagcagaaagattttctttttactttgtaaacggaaaaaaatataggcagtatttacttatttgcagtttttaaaaatgttcagaggacttgaaagagcctatacttagaaactggaagcaacagatttagtattcattgcttagcactgtattgtgattaaatctgtaacacccagatggagaacaaagagaagaacacttgggtacttgctactctatagtataaacaacacaaagagaaaaatgggaatatttttatattaatagcacagagagacaaaagacccaaagcttatcaggaattcgattttacagggagacaatgatcagaaatctgagccaaaaaaaaaaaaaaaaggcaaacccaaattcaaaaacttgggggtagctaacatgttttttaaaatacattaccaggtatggtgctttcagctccactttggtccttgttagcttctatctgatggattaattctgctttctctttatccagctgatgattagctaatctagaacacaatgataatgtgttaaaaaaataaagcagatattgcttcataaaatatatgggcatttcttatgaactagtgatgtacagtaatcagaacaagctagcctttatcgaagtaaacatttactctcaatgctacaatgtcaccattctcaaacaaaaagcctggaatacaaaagccttcacgtttttcttaatatctgacctgatggcatttgcaagtgtggtt

SEQ ID NO: 70649 - DNA, 1050 bp, Homo sapiens
gaatgttagcaatctgttaattccactggtaatgatatagttaagctatgtcttgcttctcacactttatttatttatttactcagggcactaatctgccattttttcgcactttttttccttttttttttttttggtactgcttcttattctggtttttacattgatagaaccaatgttagacgttcatttgccttttgctgtgtatatttgggtaaggatctatatgtgcaatatatgggacagttaaaatcagaattctaaatttgtattattgcatcaggcaataatgtgggaaataccttgacatttcatatacacaatattcttgtattaatttaacgtcttagttcaaaatcttccttgttaatatagagaccctattatttggtttggcaatacagttgaagagattgatggttcttatgaattgtttgccttttcttttcaatggctgtagctatgttaaattattacatgtttgcttgttatctttcagaatcaagtcagagatttgaaggaaatgtgtgaatttcttaagaaagaaaaagcagaagttcagcggaaacttggccatgttagaggggtatgtgagaatttaccatacatttgttttggtttcagcagtgataagccagaaatgaaaagtttagatatgttgtaaaagtactgatatgcctctacaagtgccctgtagtttcagtgtttattctgcatctgtaatataaaacagtaagcatttctatgtgtctcaaagtattttatcatctgttataccttacatactttcatctctctttttattgaatatgcctccataccttgaaaacatttaacttccaggaatccttttgtttatggaggtaactgctaactggtccttggtccaatgctgccattttgtaaccatttgttatgatatcttcccagcttggtataatgttttataattacattgttcctccccctctttttttgtgttcttgtaattttctccctatgttattttgtattcattttatataatgaataaatgttgcttatgaggtc

SEQ ID NO: 70650 - DNA, 1105 bp, Homo sapiens
agctcggcatgcccaaagattctaggagttatacaggttgaacatctaatccaaaaatctgaaatgctccaagatacaaaattttttgagcaccaatatgatgccacaagtggaaaattctgatgtgacctcatatgatgagtcacagtcaaaacacagtcaaaactttgtttcatgtacaaaattattaaaaaatattgtataatactacctccaagctatgtgtagaaggtgtatgtgaaacataagtgaattttgtgtttggacttgggacccatccctaagatatctcattatgtatatgcaaatattccaaaaatattttttaaaaaaatccaaattctaaaacacggctggttccaagcgtttcgtaagggatactcaacctgtatagcaaaatgaacatatttacatattctctaggaaatattagtttacaatttttctaggcaaattataattgataaatcataaagaaaatttaaaataacactggtaattttcctacctccttcgttattgttacagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaagtgagtttaaatatcattataaaactaattatgtgtaaaatcctttagtgacctggaaattatatagctttatcatagttgataatatgagaaatggtctagtttaaatgatcatttattatctatgatttacttactttttattttctttaaaatctgttttaaatatattgtaacaattatagatggattttcctgtgatctcgttgtaaattagcttatgacaaatatagggtgttacaattattgtaatttggtttggtaatgagtatgcaattgaaaagccaaacactgaatggtatatttcatgattctatattaaattccacagagccgataaagagaaacttactttgcagaggaaactaaaaacaactggcatgactgttgatcaggttttgggaatacgagctttggagtcagaaaaagaa

SEQ ID NO: 70651 - DNA, 1036 bp, Homo sapiens
aaacgttgtcatatatattgttatatacttgtttgtttaattaattcagccaaaatgaaacgtgcatatttgataaaattttgtttgtgggtgtttgttgaagatgaattgctttacactagttttttttttttttctcaaagtcgacttttttcctcaaggtagacttgacatgaatatggaaaaatatatgtagtttgtggttattttttttctcttgtgtacttaaaaattcagactgaatttttcttataatggtatattttctgttttatgttccttttatcattgatacttcttgaagagtcatgaataatacctttctttttctcttattagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacaggtaattttatatttaactctgataatgtctgatttacaatatagaggtagtagtttatttctactttatcattttatctatggtatttgttaaaactgactttcaaatcactttgattaatgtaattaatttcttttgtgacttctattgtgtttatagttctagagtagcatattagtatgttgtattaaaatgcagaagcagctaccagattatcttatgtattaagtgtcatttagaaagtatggtcagtgatagcttcagaaagttgctattatataattgaaatatttactgtctattttgttttacatttatttgtaaaaatataaagttacattttattttttagggcaaacccctgacagataataaacaaagtctaattgaagaactccaaaggaaagttaaaaaactagagaaccaattagagggaaaggtggaggaagtagacctaaaacctatgaaagaaaag

SEQ ID NO: 70652 - DNA, 1027 bp, Homo sapiens
tttttgtagatctcatgtgccactgtgttaaaactttgcttagtaaattgtgaattttaaatctgtgataactttcactggaaaaatttgaaacttactacaaatatatattttttttaatatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaaacatttaaacttgatttttttttttaagagacagtatcttgatctgtttcccaggctggagttcagtggtgcaaacatagctggaactcctgggctcaagggactctctagcctcagcctcctgagtagttgtagctggcagtacaggtgcacaccaccatacctacctaattttttaaaatttttaaatttttttgtagagacaaggtctcactttgtcacccaggctggccttgaactcctggcttcaagtaatcctcctgctttggtctctcaaaagtgctgagattacaggcatgagccactgtgcccagccaattttaaattcattatcttcaaaagagttacatgataatttcttaatatatgcctatatgaaaaatgcttaagatacaaattccaattatgattcattaatttagattttataacttagcagtg

SEQ ID NO: 70653 - DNA, 2260 bp, Homo sapiens
tagacaagattatatttggtagaatctatccatcatatggcttcagattttacttttcagcttggctttgtgagactttaaaaatcaagtcattgcacttatattcacaaagtcacattgctttactgcattgcttctcatacagtttatctcctttcagtaaaatgtttacttgccatttttaaaatttcttatatgtgacacttctacactaagtcctttatgttgttagttccacaattctgtgaggaataggtttttttttttaatcatttgattgatgaagaacattaagttccacagagattaaatggtacaggcatcacacaggcaggaagtaacagagctaagattagagtccaggtctgatggaattcagaaagctaatgtgctttccatggaactataatgctttctaatatacagcatctaaaatatctgaggtaattttaatataaacagcatgagattgacttaaatattattgcatgtaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgaggtttgatattataagttttatcatacaattatagaataaagaattagttttggtagacattgtattattgttaagtggtttgtctggatctctgaaatatcttattaatatagtgcctatgttttgtgtaataaataaataaaagatttaaatctgaattgtttaaaaggaaagcagatatttctgtaagtttttctcaccaatgttatattattagatttaatttatgaaatgttatttactaaacaatggaattgcctttcaccaccatcccttcatttaacaaatatttattcattgcctattacatgtcagaccctgtgttgggactggcagtatagcaagaaacaaaatagacaataatctctactttcagggactttacattctaattggtggttttatatatttttgatgtggtcagaatcattaaactgtgtggcagtaaatatagtttgcaagtatttaacaatttatgattaaacacaactcttacagtgtttgcttaccttgagatttaatatattttcaaagcatttatatcatttttgttttaactatgtcactaaatctatatgagtaagattttattaactcatttggatttatttatagatgatacaattgaagtaaaatataatgagcagattgcattctaagcaaagtaagaatattgcaagttcagatattattagataatgagttgcctaataaaaatgacttttggtggattggaatataaccagagtttccatagtttgtttctgattctttcatattttttaccctccttcagtctgttcttaacacttcacacttaatataatatgtgaactaaggccaagtaaagaggattgcagtactttaaaagctaaattacaaagaaaacctcaccaaaaattgatgtatctgaacattttttgttacatttccttagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaagtaagtgcatataagcattttagccatttgactagatgtatcttctttaatttgtctttaagaaacccaattacaggtatacaattcttagtagtaattgatactgatttctttttataagaacaggattaagtaatattaagatcggttttaacagggttaaataataatattgacgagaataatattgttaaagaggaagtgacctctcaagatttgcattttttagagttcaggaatattattgcagaaaggtccagttcctccacatattgattttttggggaaggggtgatggaggaggaatggttgtttattgtatttaaacttaagtttcttcattttaataagggagtaatagtacctcttctacctgtttcataaggttgctgtaagaatataataaaaaattcagattttgatttagtttacatttatcgggcatctactatgtactagtcacggtgcaag

SEQ ID NO: 70654 - DNA, 1065 bp, Homo sapiens
ttaacagttatggcagaaggggaagcaaacacatttttcttcacatggtggccggaattagaagaatgtgagccgagcaaaggggaaagccccttataaaaccatcagacatcgtgagaacttactattatgagaatagcgtgggggaaaccacccccacgattcaattacctcccaccaaatccctcccatgacatatgaggattatgggaactatgattcaagatgagatttgggtagggacacagccaaaccatatcagtatgtatatgtatacaagtattatatatatatgtatgtgtttgtatgcatacatgtattatatatggaggaaattctaattttgtaaaaaactggattgtgagttttaaggagatgttatataaagttaagacaatgtcattttgtggtattggtctgaattacaatgtagtttcttagtgatatttttcctttattcagtgtgaaaacatctccttaaaagaacaagtggagtctataaataaagaactggagattaccaaggaaaaacttcacactattgaacaagcctgggaacaggaaactaaattaggtaagttttatgactctgataatataaaatgattaacatctaataatgaatatttcttatttaaagttccttttttatgctagattaaaaggaagtattttgactaaaaaaagaaagaactttctgcctaataatttaacttaggcagatgaataatcctgtacttaaccccaccaaagtttagttttcagtccttaagttagatttgtttctaatgaaatcatatatgttaaaaatttatgactaagtattagctactttgaaccgtttaacaattaaaactgatgatattttattaatggtattatgagttctttcactgagtgcaagttatattagttatatatcacttgatatttttaaattaaaagataccaggaaacagcaaagaaaatgtgaaaagaagttgtatttctcatagttttactactatattactgtatatttttgctcctatatgcttacatattttatatattttaaattattat

SEQ ID NO: 70655 - DNA, 1059 bp, Homo sapiens
attttttgtatttttagtagagatggggtttcaccttgttagccaggatggtgtcgatctcctgaactcgtgatccacccgcctcggcctcctaaagtgctgggattacagatgtgagccaccgcacctggccccagttgtaattgtgaatatctcatacctatccctattggcagtgtcttagttttattttttattatctttattgtggcagccattattcctgtctctatctccagtcttacatcctccttactgccacaagaatgatcattctaaacatgaatcctaccctgtgactcccatgtgactccccgccttaaaaactgtcaaaagctaccggttacctgaagggtaaaagtcaagtcccctacttacctcatgtcatctagagcaagagatgaactagctgagttttctgaccacagtgttctttcttatgtatgttcttttgtacgtgctcttttctatatatagggaaccatttctctcttccagttgttttgctcagtgaatttctattcctgtttcaaaacttgttcaggcattaccttttttttcttaagcatactttttttaatggaacaaagtcactcctgtctacactagttctgcatcttatacataggttttgtacatagtacatatttatatcacatcaaattatatgtgtttacatatctgtcttccttaatggaatataagtcttttgatataaggaactatttaatttgtttctgtgtgttgagtatctcctgtttggcacagagttcaagctaatacatgagagtgattagtggtggagagccacagtgcatgtggtgtcaaatatggtgcttaggaaattattgttgctttttgagaggtaaaggttcatgagactagaggtcacgaaaatcagatttcatgtgtgaagaatggaatagataataaggaaatacaaaaactggatgggtaataaagcaaaagaaaaacttgaaatttgatagtagaagaaaaaagaaatagatgtagattgaggtagaatcaagaagaggattctttttttgttgttttttt

SEQ ID NO: 70656 - DNA, 1048 bp, Homo sapiens
acattctctgttttctaatctgctttactcctaattacctctgtactgtatatacttcagtctgtcactatccagttgatttgccttgctgttttcattgtgagagaatgttactaatatgaattttttgtgagaatatataactcctttttcttgtgtgttcttcaatcaaaatgaagttagaacaccaaatttaaaatactttaatataaagcatagtttaagttaaggcagaagtatgccttatatacgtgtgtatatgcacgtgatataaataggtctgtcatttaactcaactattcacgttggatttatagttgaatttttttgtatgtttatttacatttggatttttccaatgatgtctttggtatatgtgaaatatttgtcatctgtatagcatagtgtaaattgtgaaaaagatctgatcatccaatgagaaaactgtgtaattacagtaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgtaagttatttttttcatgttaatgtttttcccctatcactttagagagattttctgctgtgtacagatctccatagtttctgatgagatatttttagtcatttgaatcattgtttccctgtatgtaaagtgtagtttttcttgagctgctttcaatacttttcttctaccaattggataattgttattaatctgtcttcaagttcactgacattttcctctttatctgtgttcttttggttcaagggtcagcttgagaccttgaggagttttttacaccgactttggagctcgtttttgctgactcttttcttattgggattttcctttcacttatcccatggctttgggctgtatcctgtggttttctagatgagaaagatgatagatctctgcaattgcaccctgccctatgactaaatctttaaaaatggcaaagtcaatctt

SEQ ID NO: 70657 - DNA, 1583 bp, Homo sapiens
ttctgattatcatttggttctactgagccaaataatgtttgtacattgtttattctgatagaagttcttaagtttctaacataattgaaatattatttgttttggtagataattagtattctttctttggttattcaagataatatgcatcattttcccaaaatttttttgttttctttagtttctgattattatttttaattatgtattacctttctcatttctaattaccgttttcctgtccttttctgtagaacaaacgtctaaagaaaaaggtgaggctttaagtgtggtgaaatcttgggaatttaaaatatgttgtgagagcactatttagaggatatgattttgttattctgaatagttttgtaattgaatgttgtgtttggttaccttcagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcaggtaaaatggctagaagtcaattcagagcaatggttcctaaaaactttaatttcattacaatgtaaatataatatttagccctacatgtaaattccctggtataaatctgtcactatgtacttgtaaaatgtgaaataaattacatctttgaagttgcaactttttagccatttttatatttgcctgtcttggtcattaagaacaattgaggtccttatgtactattttcttgattcaatttgatttaattggtcaatgccaattagtaaaggtctataaagaattctctttttttctagaggacacttatggctgcgtttaattttaatttggtttaaatttcagtttttttaaaattactttttaattatagtgtctttaacttttttagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtaagaattacttttagaataacttatttattcagacttcatattatctcattactatttatttgacactagaaagtactttttctaggatgtgaatttttgtctgtctttttaatagtgtaatatcttgtcatgttggtatatttgtccatatgtgtttctccaatcacctcacaaacactaatttttgcaatttaggatatataaatgatacttgaatgaatgtgtagatagcagtcattatggggttttctataaaagactactgaaaatcctgtggatcataacatttcattttatcttaaaataaatacattataaatgtattagaaaccaatacattgttcagtatttatgtggattaaatttgtttaaaaggtagaataatgtttaaaaataaaattttctagtaatgaaagataattatgcaattataagatgcagaaactattaaatg

SEQ ID NO: 70658 - DNA, 1045 bp, Homo sapiens
ggcaggttaaggcactcagcttcactgactggggtggagattctgatggtttgtactcaggttccagatccctgaggctcaggaacctttgcagtttagtctggttacctgtggcccagtggttacaacagaatgattaacagtcaattctttgcatctctgggtggctcaggaaaaatttaaggagttattagctgtgaactaaccttaagtaagttaaattaaaaaaaaaaaagttcttaagctaatatgattttaaatatctgcactgaagtataatgcaaatttaaattcagcataattatttgcttgttgttgactcatttgaacctcaaaatataatgggattaatttatactttgggtttattactttaagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaagtaaagcactttttttttccatgaatcttcactgttcaagttacctggctttttattattattggtaacaatatcaatttttatattgtatgttatatttgaaaaatgatgtacacttatctctaaggttttatatcactgttcattttgtcatcaccaattttaaaatataatggtacttctagtgaatatgacttgaagattaattctttatatttggaagtacatttttctcaggacatcaaacttgttacctaaaattaatgcttttgtctggaagattggtatcaagtaactaatagattttcataaagaagtgatctttctagtgccatagtttattttgggtaaaagttatatttgttcatttcaatgtatttatatgattagtagattcgcaaatgaatctttcgatatattcaataatggttaattaaatatcttgtttttggttgtaccttattttatgtgagatatatatatatatgtatagtttttgaaaagttgtgttcatgtcagcagt

SEQ ID NO: 70659 - DNA, 1050 bp, Homo sapiens
aaggatccacccacctagaccaagcctggcaaccagcggaggcctctcactaccgcaaccaccaagctggacccggccgcgggccctgacagatccctatcgcggttccacgcggactctgggtccagccaaatggtcccgagcaagccaaagcggcagcggctgctaggcgacaccatccccaactccgccaaggccagaataagatcccggatgccaggagagcctacagttcacgaccgtgggtgatgctttacgtttagattctccgccggagtcccagagctcggtgttcaggatgatgagaaggcgtggaacgaggacttcaaatcccagagtgcagttctgcctgaggcttctgcatgctgggaactgaagtccctgagaagaggaggtaaggcgctcccggcatgcaacgcgtaagactgcgacggtaccggggcggcggggaaggaccgagaggcgggaggagcagcggctcaggcgcctgcaaactggtggcctgaacgaggtagaccatgactgtggtttcagtggcgtcactcgctgggctgctcttcctgaggttttcctaagccatcccctggcggaaccgcccccaggtgaggtcgagctgtcggtcagcatattgggaggaattgaggggagcagtcctgggttagagaagcttctgctattggggccgtagggcctggtcccattctgaaaaagtgggaacaccctgccttctcttcaggcgtttgcaagcggcgtccagggtagtgccttctgtaagaaggaaaaaacaaaaagttttagccttgtttagtatcagaatctgtcttgatagttagagtgagagccgcgcagccgtgatcctcgtttgggggcgagcgaagaattgacaagaggtctcggcatcccgaccccgcccgccttacctgtagcaccattcctttcgcggatcgtggggcttgatggttgtggagctagtataaagtcaaggctctagagaggagaggttagtacttgtccggaccactgccgggggtggagagagaagggatccaa

SEQ ID NO: 70660 - DNA, 1027 bp, Homo sapiens
ttcacattgccatggcatctgtaaactgtcatagcactggtgggagtgtcttttaggatgctaatgcattataattagtgtataatgagcagtgagaacgagcagacgtcccacctttctcgccatcttggatttggtgggatttggctggcttctttactgcatgctgttttatcagcaaagtctttatgatcagtatcttgtgcccacctcctatctcatcctgtgacttagaatgactgacagacatcctgagaatgcagcccagtaggtctcacccttattttacccagcccctattcaagatggagttgttgtgattcaaatacctctgacaatggtaggaatgaaatttaatagttactgagcacatgttatgtcatacactatgctgactactgcgtgtttgttttcataatagaagtctgttttctctaacaccttttcttctgttttttttttcattcgttataacttatttttatgtattcacttacaagtttcgtttgtctgtattactcttttctacccttctgccaccaccctcttgctcacattcataaactcaaggtgcctggtctctaatggtaaattttattctaatttttcagaagtgagaacaagttcatagaagttaagtaataattgatgaagctaagattgtaacctagatctcagtgacaattgtaactaaaagcaaaatcttacctaaattttattctttaactcattctaacagtattttttatcctgtttcctgtgctaggcactggggatacagcagtgaacaagtcagctctggcttgaacaagtcaactaagtttttatgcattgtcgtctgtacctaagtgtgagtcaggaaatttaactcaggttctagttcaataactcactgtatatttttgaggaaaattggcaaaactattatttttcgtcagattttctgcacctgtcagttttcatcaagaaatgggacttatgtgacaatgttgtaagtggccttgttataagaacacttgtctggacc

SEQ ID NO: 70661 - DNA, 1034 bp, Homo sapiens
ctaataaatgtctatttatgtaagattcacaaattcaccacctgagggcacccaaagaatgtttaagaaacaaatgtgcacttgaaaagttacggaaattaaagtatttttaccattatatatagtaatttttcaagatattctttattaatatgaacccccttcatttttcctttctaggtaacaggagttgttggaagagcagaacttttgtcatctatcttttttctagcagcttttttgtcatataccagatcaaaaggaccagacaattccataagtacatgtctcacatttgatttttttttaatagtgctaaaacttgattaaggaatttttatttactccaagtgcttcttataacacattatataccacatttgggatttatctttatgtattgttttactttagcatatgtgaaaatatgaaatatgtaacattgctagtatttaggaagtttgtgtataatttatatttttatcttgagctaatagattttatatgatctaattttaaaaaccaaataaccttagaatagaagagttttagagttagtcctagttccatcttctgttatctattaatgatatagattccagtatttcagttgtctttggataaataacacctggtagactgtcatattgtttaggtaaggttaaaagcctcctagaatataacttttattgtgtgttgatcatagctatttattgagctcctaccttgtgacctaccctggaaagtgcttcgaatacattagctcattactcttaatgattcctggcattatcagaaaacaagttctaggcaataaaaatgatttttttcaagtgtgggcacagtgggcacaaacctttaagttcttggggaaggggcagattttctcactgtagttccaaggtactcatgacaagaagactagttttatgtgtggaaactgaggttcaagaaacacatgatttagccaaacatcttaagagtgttctggatttgtaatagtaggtttgcctttgctgctctgcataatgcct

SEQ ID NO: 70662 - DNA, 1074 bp, Homo sapiens
acttactccagcctgagtgacagggccagaccctgtcttaaaaaaaaaaaaaaagtatagtaccctacttttcccaatacttttaaattttaagtttttaataatttatcagtttaataaggtataaagatatctgtcataatttcaggaatttgtcttcatttcagaatgatagctcattaattatgacacacaaacctgtaaatttctcttctccaaattcaccaccctacctttgttttaaaagttagtatttgatgaaataatttttctctttgtaaaaaatttcagttcaaattatacatgttgatattttgctttgaatgtataaagtaaaaattattaaatttaagtatattttaaagtatgtactactaattaatgagaaatagcactcatatggatatggaatcacaaagtttaaaatatctttttttgatattataaaattgttttctgaatttttatattttctgttctcaaattgcagtatggactccaattgccttgacagtgtttttagtggctgttgcaacattatgtaaagaacaaggaataacagttgtaggaatttgctgtgtgtatgaagtgtttattgcccagggggtaagccaaactataaatatataaattttcttattgatatattttatcctagttgaatcaaattttatttatttttattttctaaatgtatcattatgtaaattaatgtgtttaccaataataataccagaaatcatgttttatcctcatacctactgaaaattacttaacattttatgatactttaagtgttttaagaactgtgttttaaatttcaataatggaatcattaggcagcttggaaaagtatgcaatagtactgtacagtataattcattattaggtaagactgttgagctcagttttattcattattagcttcacacattcttccacattaattttataattatacttgtatctaatcttgcaattagaaagtactacagtattgaaaacattgagatatgtcgttatttgttgcttaaaacatttcttttctttttcagtatactttgccattactat

SEQ ID NO: 70663 - DNA, 1174 bp, Homo sapiens
tataattaacattttttaaactgcatatatttaaaatttatgtactgataatttttgacatatgtatacacccttaaagcccccacaataaagataatgaatgacccatcccaaactggttaagtgttaaggttagtgttaatttagtctcctatatccttagtgatttttgtctactcattctgtcagttactgagagatgttgaaatctctgactatacttgtagatttcgctatttctccttgcacttctgtcggtttttgttttgtgcgtttttgaagctctgctattaggtgcgtaaacaactaggattgtcaagtcatcttgaggaactgatccctttgtcattattaaatgagcttcatccctagtaatagtctttactcagaaattcactttttcttatcacagctgtctttcgttagtgttaggtggtgtatctttttccatctttttactttttacctgtctatgcttttatttataaagaggatttcttgtagcatccatacaatttggtcttcttttgttgtttggtcagataatctgacttttagatgggatatatcattgatttatatttaatttgataattgatatagtttgatggaaatctttcatcttgataaaattgttttctctttgtctcatctaatctttgttccttttttctctctttccaccttcctttggattctttttttaatatttcattttatctccttgttggcttattagctataaatctttgttgttttagtgttgctttagggattttagaacatcctctgcttatcacagtttaccttcaaggaatattctaatttcgaatatatatataaaataaaaatatcagtgtatatatagtataaatatatgtaatatacattttatatatgtaagaacttaacttttgtgcagtttgcatatgttttccttgaacatacattgctttaaacaattgtcttggaggaatttaaataataaaaaagtattttacattaaccatgagtcaccatttccagtgttctttattcctttgttggataagatttttatctggtactatttttccttttacctgaaggaatttctttagcacttctgattaaaaatatcaggttttgaaagataccttctctgggtggagaattctacactggctttttcatt

SEQ ID NO: 70664 - DNA, 1072 bp, Homo sapiens
gaagattgaattgtttatataagacttcggatttccttcttagtttcattggttttctgttattccttttagagaatttgaatcaactattttctatttccctatctacagtctaaaaatatagtttataggtgtgaatttatgtatgtgttagtaggtatgaatatggtgcttatagcatataaatattttccaaataaagcatttcaacattgtgtatatatgtttgtgtatgtgtgtataaattctattaccctctgaagttggatttaatataatttgatttattttgacattaactctttctttaaatcagctatcctaaataaactgtaatttttaaaactaaattccgaatagtgaattataggcaaaaagataactttttattcagttctgctggttattttgagaattcaagttcagactcaagatttattattttatctgaaaaataatatgtaagttgtgagattccgtatgaaaattttgaaatgatattatttgttcaaatagtatttatttttatcaaatatttgatatgttttcagaaaatcaagtcaaataagtggcagtagttgattttccttggcttactcatcttaaaatgagaaaatgggtcttttaagtactatatattataaccaatataatttagaacacagactaaactaatgaaatgtatatatgttgtggcctgggaaaagataaactatgatataagcttatattagtatttactaagagagaaagtagaacacaaattcttacacaggcctacacagttactactttgtactagaaatttggtttttagcttcctaggagtcaaagaaaagagggaaggaagctaggtgatatggttttctctctccatgacagaagaaaaatatacgaattttttccaggaagcataatttttaattagcatttagctctaaaagaaatgtctcatgtaggaaagcattggtgagtgttttcaaaagtgattcatacaacacatacaaccataaatcttatacaactttttgttactacttttaatcaaaaggtttaatggaacacttttgca

SEQ ID NO: 70665 - DNA, 1076 bp, Homo sapiens
gcatttgtggttttgttttgttgaaaaacctattagcatatttcattatcatcttatttttaccacacgcacataagttagatgtgtaaaatttttatttatttaatttgtattcctcctaactgaagttttatgccttttgaccaacctctccccaaccttctccctccaaccctggtgaccaccatgtactgtacttctgtgagttcaacttttacaaattctacatacaagtgagatcatgcgttgtttgtctttctgtggctggcttatttctcttaacatggtgtcctccgggtttatccatgtcagaaatgacaggatttccttctgttttaaggctaaatagtattctaaagtgtatatgtaccacatttttttcatccagtaatctgttgatggatacttaggttgttcccatatcttggctattgtaaattgaataatgctgcaatgaacaggggaggtcagatctctcttcaacatactgacttcatttcctttggatctatacccagtagtgaggatgctgggtcacatggtagttctatttttaattttttgagaagccttcctactgtttgcttaatggcaatgctaatttacatcccaccaacagtgtgcaagtgtttcctttacgttcttgccaacatttgttatcttttgactttttgataatagccattcttacaggtgtgcgatgacatctcattgtggttttaattttcacttccttaatgatagtgatgttgaacatttatatacttgatggccattggcatgttgtcttctgaggaatatctatttagctactttgcccattttttaaattgggttgttttcttatgattgtttgagtgtgttattttagatagaatttcaaaaagtacttccactatttaactggatgaacctttattgtttaatttttgcttaaagatgtgaatatttacatttattaaagtttttatattttactatgcaagcatattctttacagaaaaccagtgagatatagctaattatgcttctcaaatttaaaatgctgtaatggtttagattttaatttcaaggag

SEQ ID NO: 70666 - DNA, 1143 bp, Homo sapiens
cttcggaagcttttgcaaagcctcctggccttccaagaaggtttgcatctttccctataactttttcttacaacttttcccaccaccctgaccaaactcctacaggaggtggcaaaaaagtgatgtataatgcagggaagaaggctgaaagagaatggatagcaaatggctctgtaggtatatttgttcattgggcacgtatttgagaatttaccatgtgtcaagacactgttttaagtgctggggaatccagaagaaataaaacaaatttcctcccttcgtggagtttccattctaaataaaggcataaacataagtaaacaaatacacaccacatgtaaatatatatatatatacacacacacaaaatatatatatacacacacacatatgcatgcacatgtgtatttatatgaaagtgataaaagctataaaaagggcatagagattagaaattttcagagaaagtctcttcgagatgataataaacagagcaaccttcgcacatatactctggtgtaattttaagtatcactggctatgcagaaaacagtgaagaaaagcaggaagatcatttagaaggcttttgcagtaacccaaagacatgattgagttgtaattttttaatagcaatcttgaagtacatgtgacatacaatagactatacatgtttaaaatacataatttgataagtttcggcatatgtatattatctgtgagaccataattacaattaagatactgaaaatatccatcaacccctcaaattccttggatccttttctgatacctccctcttaccccttttcaccccagccttctctaagcaaaagctttctatcactacagataatgtgctttttctaaaattgtgtatgaatggaattatactctatggactctctcttttttttttttcttggcttttttactctgcacagttattttgatactcattcatgttgttgtatgaatcaaaaacccataccttggtatggctgagtagtattccttcacgtagatataccacagtttgtttatccatttacctgttgatggatgtttggattgttcacagtttggagctgttacaaacatggctgttacgaacattcatataccagtctttatggatatatgttt

SEQ ID NO: 70667 - DNA, 1094 bp, Homo sapiens
gaaagggtagaagcagctctgtcttagttgcattttcttcccatcaccaaaattgttcttttcctatttaaattaaaacttgaaacttacattttataatagttacttctaatatcaaactctcaggaactttcttgtttttagagttgattggttattgatgcctttgacacaaagaaaacatcttggttctcagcaaaaaaaaaagttttctggcaccacatgttaaaacttcatttattttctcatgtatgtgttatcatttgtattacttttgaggaaaaatgtgtttttaaacttcgttttgtagcctggtccagaaaactaatagtaatttgtaacattttttcctttggggaaagtacattctgaatttaagtttttgagataaaatctgtttgtaagttggggttttctttgttccgccgtgcctattgagtttattagcagggttgtatctataaataacacctgtcatgtattaattcataaagaactattcaacaatctctacattaaaaaaataatattttggacaaacattcattctagaagtggttttaatgagaatattaattgttgttccttttatttctgtgctgatactataggaaagagtagtattataagaacaactctcatatcactacttaaatattatttgtacatatgtaaaaataattctttaagcaaaattactttttaaaattttctaacagaaaatagaaccacactagaaagatttatacaatggtttcttaactggtcctcaattctaagtgtgttcctcaaagttatctacaggtcagattaatccctcccactctacctgttcagcttttttttagtcctttttctgtttgtttgtttgtttgtgacagagtctcacattgttacccaggctggagtgcagtggtgtgatctcggctaactgctacctctgcctcctgggttcaagtaattcttgttcctcagcctcactattagctgggactacaggcgcgtgccaccatgcctggcaaatttctgtatttttagtagagacagagttttgccatgttggtcagctggtctccaactcctgacctcaagtg

SEQ ID NO: 70668 - DNA, 1056 bp, Homo sapiens
ctctggctagctgccctttttctgatgcagtttagtctgtctcctttttaagataaagtcaaagaatatatttgctctgtcctccttcctggattcctcctgataggttgccctctgaaatcaggcataatttttttcttcttaaataatatttgaaaatatatcaagccaaatatactgaactaaggagttcagatttgaggacagtttcaaagagttgttttcgaaagagagttttttaagagtctgagttaagagaaaaaaaagctgtatgtggaaaggcttaaaacttggcaaaaattgtatctacaaactgagatggtaatgttgtaagtaaagcttgtgtttgatttttccacagaggagaattgcttttaaaaatgaataaacctcttaaagcaaaggaagcatatcttaaagcactagagctggacagaaataatgcagatctttggtacaacttggcaattgtacatattgaacttaaagaaccaaatgaagccctaaaaaactttaatcgtgctctggaactaaatccaaagcataaactagcattattcaactctgctatagtaatgcaagaatcaggtatgttttctcaaaatatttctgtttatataaattgtagtttataatataataagaccttaatttaactttattacccatagcaaacactttatgtattgacagtttatagcaatactgtgcttaactgatttatagaaagaatatttaaaatacttgaagtaaactattttcaagtaacatgcattctaacatatgataatactgatttttaattcttctggcatgtgttaagactaatttttcaggcagtctattaagcaacattaactattttgtcattttatatacataaacataatgtaacttatatataaactctccaaataatatgaacttgtgaaattttttacataattggctgtgaggagccaagagcatatgttttcaaaaaaatagcattttattttcttttgattcataagagcaaatacttttggcaccattttatatccagttttactacgt

SEQ ID NO: 70669 - DNA, 4340 bp, Homo sapiens
ggagttactcagatactaccctgatcatatcaagggcctcattttaaaaggagacattctgatgaatcaaaagaaagatatactaggagcaaaaaaatgttttgaaaggattttggagatggatccaagcaatgtgcaaggaaaacacaatctttgtgttgtttattttgaagaaaaagacttattaaaagctgaaagatgccttcttgaaacactggcattagcaccacatgaagaatatattcagcgccatttgaatatagtcagggataagatttcctcatctagttttatagagccaatattcccaaccagtaagatttcaagtgtggaaggaaagaaaattccaactgaaagtgtaaaagaaattagaggtgaatccagacaaacacaaatagtaaaaacaagtgataataaaagtcagtctaaatccaacaaacaattaggaaaaaatggagacgaagagacaccccacaaaacaacaaaagacatcaaagaaattgagaagaaaagagttgctgctttaaaaagactagaagagattgaacgtattttaaatggtgaataacattaatatttatcgtgacaatggtatcaaagaacatcaatccgtatcatgtgattgcttttactgggagctttgaaaaaaagttcaagggttcctaatggtcaatcatgagctgccttgaagtaggatcaaaataagattttcattaaagacctgtattatcccaggatgtatattatgtatcgctgttttcagagtgtgggtgaatatagcagaaatattacagcggaagtgacaaatttacaacttttattatagaaagaaggtgtttctggcaatgtaatctttactgctctcaattaaaaataattttgaggcctgaatgataatcccttgaggacaaatccaacatgtgctggtttattctgttaattcccatttatttgcctacttcatttttcttgcacctcttagaatctaactatgaattgaaaacacttaagtaattctgtttaatcaagggatttacactacaaaagaatgctggctttttttatgttgtattccttagttgagttttagaaggaatgcttgatgaaacattttaaaataagtcatgacatgttagcttgagaatgtattttcataattgtatacttgtttttaactttaaatgtaatttttaatcaggtaaagtttgacacatgtatagctacatacacacatttttaatggtgctcatatatactgtattttttgttgtttagttttacttattgagagtgtcacaacatgaatcacataatcatgattttttttttttacttttactccccaaattattcatgtttcttagatcgtagtcattgagaagtcccaataactctaaacttttgagttataacgtagtaaacttctctttcatctttgtgttagctctgtagtcttaacctggattttaatttttttgtttccaaagtcacaattgaattattcttagataccttaagccactgaattcagttctgtttgactgaaagcaaaacaacgtgacagtttattttcaaacactaacttcttgatattttgttatggtatatctttttattaaatatttattttgactaagctttcataaaatatttgaagctattttaatcatcaagtatggaaaacaaattactattgcattttcctatatatgcatatattatggattaaccagaattgtatcatttttggcctaatgtctggatataaaagataattagcctactatagtattaataaatttttcagttggtttgggcaaatttaaacctgaaaaataggttaaaaagtagttacaaattaaacttactaatttatacctgattttttttcttgaattaaagtacattttaaatgagctttataataccttaaaaagttggttctaatttaaaatatgaaagctctggctatcatcctgggatagtaatttctaattatatagtatttcaaaactatatattttttagttcctttgagataactaatttctaattatatatgtttcaaaaaccatatcctgtattttttttaagaattgttttataaataggtcataagatacaaggtctgcattagaagacccactcttactaggttccctaaggatctgccatagatttttttttttttttttttttttttaggtagtttaaagcaagcactgataccagtgggagttggtcttgatctaggagattctgttaagcatccaaaaacaatgcctaatttcagttcttaggttatggcttgtgactccagataaaagatggagaatacctcatgtactgtgacttgaaaatgaattcttaaaattcttaggctctctccatgtatctttcttaaggaaaagtttctgagtgtgatctctcttttgccatagtatcaagtggagggtagttcagaaaagttaataggaaatcttttgtgacagcagactataatagaagtttgagtaatattttaataaatttatataattcaaatgataaaaatgtatcaatgttatccaatgatttttattaaaaaattaccttattattagaactgtgcctattacataaaaagtgctcatgtatttgaattttaaataatttatttaaatcaagaccaccataagtcattaataatttaataattgttttaaatcagtggttttcaaccctcacttcatattagaatcatctgaggacttttaatatggaatccacctcataacaattaagtctaaatttctggaagatggagccatgcttgtttttccaaaagctctttgagtgattctaatttgtagtcagagttgaagaccactgctctaaattagtgcaggaaaatgcttttatttctcccatgttaacttttaaaactagtaatgtacccagttaagttttgatggtttaaattccactaaagaacatattcttctaataactagcatttattacatgaaatttaagagtttaagttccatcaaactagcccttgtgtaagattattatttcttctctataacttcaaaatagatatttcattcaaactgttcaggtgagaaaacataatggatttttttttttttcctctggagctgcctgttcagtgagatggaggaggtgggcacatttaaggtcagttcactaacctatggttcagagttctgatcatatggaagtttggaaaagagagcttatcacaggtttgtatgctggtgaatggatagttttaattctcactgtctcaaaagagaatcagctctccagcagttctagaaaagctttgacaatccccaaggggcagtgttaccttactccttcactgcttcttagaaggtagaattaagtttctggaattgcacctacatgttttcttattaacattcagaattgggaatattaatttttccagtgagtagttttctgaaattggtaacttggagagtaaaataacgtattttgcttttcaattttgtgtttgtttacttttatgtaaaaatttgatatgtgaattacacagttctaataaaacctcatgccttttcattacatctaatttgaactctcaacttcatgttacagaatgctttaaagatgctttaatgaaaagtattaagaaaatatatagatttgtatgtcagtttatacttcagaaatccatatatttgtcatatttatttttttagaaacctcctaattggataactagatggtatttaaaatgaatgcccaaaaatatcttgtacctttgtccaaaagtttatctgttggaagccgccagccattcatgtagagagtttataagaaaataatttaaaattgtatgcattttatattactatggtatctgtgtaccatatttctaagtattcattattaaattggtacttcttaaaaccataacctggcttgccttttagtgttaaaaaaatacaacattgtatatagagatttcttttatgaagaagagctgacgtaatttattagcagtgatctgagaaagacattaaataagtttctgagagtgatacattttcaaacatgaggagtgacaaccaccaaattaagaaaaggaaacaactcagacttggaattttatacgaatttcatttctatatgtgcctggtattgcctctggcataacttagaggaaattgttctacctatatgtcctcagtttcttcatctacaagttgggaaaaacattttcctcttaaaattgtgaagaggatttatatatttatatgatatattgtatatattaatatatttaaattgcttagagtttctag

SEQ ID NO: 70670 - DNA, 1040 bp, Homo sapiens
tgatctcggctcattacgacttccgcctcccgggttcatgcgattctcctgcctcagcctccgtagtagccgggattacaggcatgcgccaccacacccagctaatttttgtatttttagtagagacggggttttaccgtgttggctgggctggtcttgaactctggatctcaggtgatctgcttgactcggcctcccaaagtgctgggattacaggggtgagccaccacatccaacctaaattcatgaatcattttgcttctcatggaagagccaggcaggatcaagaaaggtgtcccaaaccaattccatatatgttctctctcattgagtttcttatttagacgtagtatgggacaacactagtgccttcaaccattccccttagtgttagtcttaagctttccaacattaaaagtccaaactcttagtccgttgcacagtggcatccgacaaatgtgtgttgaagatatgaacgtggaaacagccatgattctaagcatgagatacctaaaaatactataaccacagtgcacatacaattatttaatattttcaacagtccaaacatagctgaatgcatacagatcttgatccaggttgtaaaatgtcatgtttaaaatttctgagcaagctgtcaagagtgagaaagcaaaaagattttagaagataaaggcatgggagatagatttgcttgatagtataagtcattttccccccagaaatatattaagtctgtgttccatatgtgtcagaattacccaagccagatctctttctgtctctgtgatttctttcttttttaatgcattcatcttttggagactacatggatttatattgccttgcaaaagcaatattcagcagaaaaatcaatcttttgaatactttaaacagatataggtccagaatgtgttacagaaacagttaaaaacaaccacagcataagagcaaaacttctagaatggatatgctgtattcatcagtgtgttctttaaattatagggaaggccaaaaatccccctggagactccagccta

SEQ ID NO: 70671 - DNA, 1091 bp, Homo sapiens
ttctgggtctaagggtgatactgacacacatttttccctctgcccaagatgtccttcctccaatatgatcagttgaatcatattcatctatgaaatggcatctcatattctacttccttcctccaagaagtcttcttaattgtcccaggatgggttatatgtttctcttaaactggctgtaacacttactgtgtgactctaagtgatttaacctctcagcacctcaatttactttcaagactgccgtgaggttgaaagagtcaatacatgtggaattttagaacagtacctgacatgaaagaaatgtgaacaattctattattatatattgacatagaactctgtgcttactcctatagaaatatctcatgtgattctgtttttatgcacattttcctcttccagtagataatatgcccttgaaaggacttaattttattgaatttggtattcctaacgcaaaacccaatatatattacttagtaggtgcttaataaatgtatatggagtaaataaactgcctcttgtggagttgaaatttaccactggaaatgtttatgctgtagcctgtgaccacatataaggaaaactgctgggagactgaactcagcttttcagattcttctgactataagcttttagaagattatatagagatgttagaaccaacccagaacaacaacagggtggcataaagaataaatattattcaattggcattcctacccagaaattagatatgcttgcccaagacaccaactctatgtcctgttgaagatttacaatctgatacttatttcattatgtaatgatgtatttgttttcatatgagccagagactctgtcagacattttttcaagggctttgaggccacacgtttctgggcatccacgatctagggaatatgtgccactgttttccttaattggacttatttattctgatgacttgcagataagcagagctcaagaaatatggtcaggagaagggctgtcatgacgcttgcttgattatgatcataaaactgctctgcagagtcctctccatcatttactcaactggttgctaagtaatttccaatccagtccca

SEQ ID NO: 70672 - DNA, 1008 bp, Homo sapiens
gtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaatgtgtgtttttaaaaactcagttatacctatgtgtgaagtgacacattttagaactttttcattcagggattgattttgacttgtaggcatagtagggcaaggttcttttaagcttttcctagaacg

SEQ ID NO: 70673 - DNA, 1080 bp, Homo sapiens
ctttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaaggtacgcgcccagggaactccgcgcgcggggcagggctaggggcgcagggctgcgggcggggcgcgtggattgaaaatacctctgctccgctcagctggagcttcggagccgcgctgcccgcctagggaccggcagccggcgaggtaggggccgcgaaccgcgcgttccgcaccagagaaccgggccggctcagaatccactcgcttccggctgcgggtaccggcggtttctttctaacgggttctgcgccttcttagccagaacatcctccaccatcaccctgttttctatcgttcgattttgaattaagatttgcaggacgggagagattgttggggatgcaaattggcacatcttagct

SEQ ID NO: 70674 - DNA, 1096 bp, Homo sapiens
tatgtcccccgcttcttcctaggtaagcgcccttagttaaatcatttagccgttctaagttgcagtcttccacgtcggcataacgaagataaaactatctgcttcatagggtccctgtgacgacaaaatgggtacggtgaaacgtcctaaagtggtggtggggtgctattagccgttggaattaatttttcattctgaattgaggacctgtaaaaaggcctcggcttggggacacggtttgggcatcccacagatgccccttgaggctcgcttgacagcccgcctggactcgctcatctgcagcaaagccctctgagatactaccctaaccgatttaatccgttccaattcagctgtcaagtaaagggggtgttatcgtagaccaggatcaaaaatcctttagcacagttatcagaatggacccagctacatttctgatttctccctactggtcacctttggaacacgctgttctccagccacagcaaactgatacaacaatgcatattgggcacttaactgcatgatgggtaccgtcttgtttctgtgtttacttgcataatttcggacagtcttcagaaaaaacatgtaaattatcccatttacaaagattaaagaatttgcccaagggcacacagtagcaacagagtgtcaagacgtgaggccaaaccctttacagactcttaaggatgcccacatgcacggattacatagagtgttatggacactatattcacctccacgtggtattccctgcccacatgtgaagaatttcaaggtcagcattttgaattttgacctccaggctttctccagcctcacgttttctgttgcatcctccatgtcaaagatcaaaagcgaggctgctttccctgctccttttacacaccagtggttttctttgcacgcaacccttcatcagtcaaacattcactaaatgttgcatattttatctctcttagaatatgccctagatcctaatcttcacaagtgtcattggttatctagtgcgtcagcacagcacataagcctaggttcaaacctctgtcactcagtagtagtctgggcctcacttcattcattcattgatgcattt

SEQ ID NO: 70675 - DNA, 1074 bp, Homo sapiens
tcatgagtgcagagaagcactttcatagattcttgtttcttcctctgtgtgtgtgtgtgtgtgtgtgtgtgtatgtatgtgtgcaccgagcacctgtgcttgtgcttgaattcctcctggtgtttccccctggaaagttccttaaaaattgttagttaaaaaaaaaaaatttttaaagcagtgtattttggttataaaattttctctaggccatttgagaaacattccacttttgcaggaattttcctgagtttgagggcacttgagatttataagatgcaaatgggctagcatgacctttaatcttcttggaataatctctgtgaatacaatgacatttattaacacatcatgtgaaaacagttaaacagattttcagcaaataaggagagttttggaagttctgacttaaaatgtaaatgcatttaggggtcccaggtaggccctcaaagtgacagtggctttcagtgcagctaaaacttcaaaactgaatttaactgtatttgaaggatacacctgaaatagtatggcttaatgtaaaatgtatatgggttgcacaaaactgtccctaaggtcttctgatgagtgcttttaaaagataccaagaagttgtaccacaacagtagcaaccgagaaacacaagaagcctaaggaactgacagtaggtaacatgacttacaggcagtgataggctgtgagaaagccaaagggaatttcaaatagcccccaattaaaattccatgagggcagcccctgggaattgcagatccaggtttgcaatcaaactgcttctcacgtggaagctccgtgcagcttgccccatgatgaggagctgcaagggcttattgagcacgggttaatgatttctccaaacaatgcgggggaaggggaaaggcaggctaggttagacctcaaggcagaggtagctggacagcaacaccagaatcacacccacaagcatatctagggggagattggagcttccccatgaacgagatggcacattcacgcattgccaggatgataccacctgaagaaaaacatgaactattgtgaaattcagaccttagccaa

SEQ ID NO: 70676 - DNA, 1026 bp, Homo sapiens
ggtacttgctctcagtccatatcctggcctacccgacagggactctgattcggaagatctagggatgggctcaggcaactatattgtagtccagcagccagcagtggcttatacaggtggaccaaactttgagaagcttccagtgacatcccagatagtcagattcctcactcatccactctgttcagcaattgtagaaatgttcttgaagtaactggaaagatgagtcaaatagtattctttagacacaagcatcagaacttcgtaacaggaaaatgctgtgtcaggcataactaatctgcttgcccttgtaaatgcaactcttgaactggtatgcactctgatgagttatttactggtgaaacctgtcacaaagcgttgggagattacaaagaacagaagaaggtatcttggtggcagcatcgtgtgtttattgaacacccgttgtgtgtctaaaactgaaatgactgctggggcttatgaaaatgagtgagattcaggccctgctgtcacaaaaaaatataagtctaactggggaggttagacatgtgcccaggtagctagaatgtaatgtaataaatgtggtcattgcagtagaaaggaagtgctatgggaacaagaggaggaaatggttcatctaccttagggtgggaggtggaaggtagaggtggggtgctgggaagtgtcccaggggaggcagcatctgagttagattccccagggagcagatttctcactgtccccatccagtgggataggagaagaaccacacacactctgggcaagacagaaagatgacatgagctaaggtttggagggatggacatgtgtgaccagtgcagtgcaggtgaatggtatggaaggcaaagattggcagagaatacaggaaaggtagtgtagtgccagatggaaatgggctttggatgtcatggtaagaagttttgaatttttctttaggtgaagtcatcatagatatttatacaggggtgtgacatgatttcaggatataattctgtaacaaagggg

SEQ ID NO: 70677 - DNA, 1289 bp, Homo sapiens
gggtgaattcaaccttaccaaaatgatcttttcttatacgttgatagaattggtaggctaacatttagcttaaaattttttttatccatagtaatgaatataccaatatattttaattttagaatatattagaaaatgccctccaggtttttacaaatagtatttggtttcttatggtatgaaaatctcataatttttttttatgtatatacacagattaatccaaagcttgaggtaatcgatttgcagatctctactccccctgttatggatatcctttcttttgattctaccacagtaagtcgggtttttttttttttttttgacacttaagtggcatttaatcatttggcataatccattttcctttaaaaaatgttgggggaggagataaaacgtggcctatgtagcctaacattttagtataggaaaaactttatagtcatatttacaatgcatctaaatagtttaccacaaggggggagcagcaacaatttccaggaaagcttttttttttttttttttttatactttaagttttagggtacatgtgcacaacgtgcaggttagttacatatgtatacatgtgccatgttggtgtgctgcacccattaactcgtcatttaacattaggtatatctcctaatgctatccctccccctgccaccccaccccacaacaggccctggtgtgtgatgttccccttcccaggaaagcttttactttgaggtccctgagctcagtctaatccatacccactgtctcacgtattaagatgccacccaggtaacatttcacatgctgttgcagagcagattccctattgtgttatttgtccttcagaggtgctaaacttacttctagtcttctcattagaagctgtaagaaaaacagcactgccgttggttaatctcttttgatggattatccataaattaagaagtatttctaatacttacaattttgttgatagaaattacatatataaaatttatttattcagtgttttcaaaattttcaaagattaagaattttagcctttccatttaggattctgctaattctttccaaggcaaatcactgccacagttgatcctgctagtcagtgcaaaactaatcgtaagaacaaatgggaagaacagcgtggtctttgacgacactactgctatgatgtcagtttagttaaatattttgggtacatttttaatttgtagccaaaataaaaccctgacattatgacattacaaattctctaatagatctcaagaatagtatttattgtagaggaa

SEQ ID NO: 70678 - DNA, 1011 bp, Homo sapiens
aaatattatttgttgtaattcttatcaaaatcaatgtgtatctttcaatggccattaaatgaatcttctcctgctgtctttatcagtatgttgtatagattgactgggtaaatggtgatgggtaagtagattccatacttcagatccttccttcatgtggaggctgtcccgcttagccctgacacccagcctctcacacctctccctcactccttctgctaatttgttggtgggtttaggagaaattgggtaagcacagcctaacaccttctactctcctgcctttgggagtagccattcttcactgtttttctctgatattccttgtggggagacctgcccttgtctagtgttgcctgtgactcattctgggcatccgttctagaaagcctatttgtgttacacataaaagccacattctctttttacaagcatttattagaaagaaaggtgatatttcgattcttatgtgctgtattcctttgtcttatttctcaattggtttagaaccaagtaggtaagaggggtgccttttattgagcctgttcaaagatccctccctggcatatagatcaattttttaaatttattatttctttatttttgagatggattcttagtctgtcacccaggctggagtgcagtggcacaatctcggctcactgtaacctctgcctcctgggttcaagtgattctcctacctcagccttctgtacaggcgcaccaccacgcccagctaattttttgtttgtttgtttgtttagaagagacaaggtttcaccatgttggccaggcttgttttgaactcctgacctcaggtaatctgcctgccttggcctcccaaagtgctgggattacaagtgtaagccactgtgcccagcctagataaatttttttgagtatataaactagtcttttcttccagacaatattcaaacttctctgaattttttagaatgcatcctctttttttttttgaggtacttccttttaacaagtataagctgttta

SEQ ID NO: 70679 - DNA, 1004 bp, Homo sapiens
tggaggttcctgcaggatatccaaaaggggatgcccagcaagcagttgtactcatgggtggagattccaggaaggaattctgggcacatagatggtaaattcccgaacaagtaattttcatggcatgcttcatctttttacatatttttcatctgctttttgtctctcagcagttgcagaaatgaatcctgctactgtagtcaacagatggtttctcttctaatgctgaccaacacttaaaaaaaataaatgttttgcttattgacttgaacttcaccttcaatctgtaaacatcaaattctatcagcgcaaactctgagactgccaaatttttagagtctgtgaaaattttagggctgattcaatccagactccttcattatacaaataggaaatggtggccattacggttgtgagtttacaagattacatagctggacagttgcagaactggccctagaattcaggacttggtatttactgagcagtcttatttccactactttttactgcttcctcctactactgaagagctgttggcttcagagttcctcttactaatgatttgtgtcttacgggacatgaaatagtgcctgccctgtttggtcccagagccctgagtgctgggaatgtgtttttatagaaaatgtattctgaagataagaaatagccaaaggaaaatttgaattttttataaaagtgtctgtctgtctgtctgtctatctatctatctatctatctatctatctatctatctatctatctatctatctatctatctattgagacagtctcactttgtcacccaggctggagtgcagtggtgcgatcttggctcactgcagcctccgcctccctgattctcttgccttagcctcccaagtagctgggattacaggcatgcaccaccaggcccagctaatttttgcatttttagcagagatggggattcaccatattgcctaggcttgtctcaaactgatggcctcaatgatctgcctgcc

SEQ ID NO: 70680 - DNA, 1040 bp, Homo sapiens
gatctggtttaagaacactgccactttgacaataaggaaaggatttttttttaattgtgttctcaaaggagggtactaaattatggaaagaaataaaaaataaaacaattgtggtgggtcaactggatactcataaggaagaaaattaatcttgaatcctacactttataccacatacaaaagttaattccacgtagaaaacagatctaaatgtggtacgtaaaacaataagcttttagaagagaacacagaatatcttcatgaccttggggtaggcaaacactgctttaaaaagacattaacgtgtttgttgagggcagagccaatggccgggaagtgttgttggcgcacgccttccagatcgcagctcttgcggcggccatcgccttcgacttaagggtgttgcttggccgccgcctggtagtccggcgattcatttcttgctcggcctcctggagctgtggtctgtgtgggcttccacctcagacacctgcgctggctcagcggggccggaacatggctgtgtcgggtctggatcatctcaaaaatggctacagaagaagattttgtcaaccttccagggcacgtgacattaacacagagcaaggccagaatgttctggaaatcttacaagactgttttgaagaaaaaagtcttgccaatgattttagcacaaattctacaaaatcagtgcttaattcaacacgcaaaataaaagacacttgtattcagtcaccaagcaaagagtgccagaaatcacatccaaagtcagttccactttcttcaaggaagaaagaagcctctctgcagtttgttgtagaaccaagtgaagccaccaacagatcagttcaggcccatgaagttcgtcagaaaattctggcaactgatgttagttccaaaaatacacctgacttgaaaaaaatgtgaagtagaaacataaatgatcatcacagtgaagctgatgaagaattttacttatctgttggctcaccttctgttcttttggatgcaaaaacatctgtatcgcaaaatgttattcc

SEQ ID NO: 70681 - DNA, 1096 bp, Homo sapiens
ggctgagatgtctctactaggtgaggtttatgggaatgtttgtcatttgccaaagtcttagctaatatattatgatgcttttctcttgactttctatcttgaaggagtgcagtgctctcagccggggatatggtgcgttgtttcagaggccccgcctttcttggtatagtaatcccaagatctactggcaaaactttgatctgacttatcaattataaattcatcctctatcaacttcatatcatcgggaggacacgaatgaggtggaacaattcctccatgcctaacaatgggactggattcactttttcgttttactgtttctaaaaacaatgttgaaaaactttttttagcttgtcattgaatttcatattctgaatgtcgtattctattctgagatgatcctgatggttttctttcttgtccttctgatgttttatcctctttatctgatactttattatctatttctatctatttctattttctttaaaataactttatcttcaaagtttaatctttttttggttttaagtgaaacctctgtacttgaaggcagcatatttactgaattttcaaaagtgtaagtctctctcttttgggcactagatggaataacattttgcgatacagatgtttttgcatccaaaagaacagaaggtgagccaacagataagtaaaattcttcatcagcttcactgtgatgatcatttatgtttctacttcacatttttttcaagtcaggtgtatttttggaactaacatcagttgccagaattttctgacgaacttcatgggcctgaactgatctgttggtggcttcacttggttctacaacaaactgcagagaggcttctttcttccttgaagaaagtggaactgactttggatgtgatttctggcactctttgcttggtgactgaatacaagtgtcttttattttgcgtgttgaattaagcactgattttgtagaatttgtgctaaaatcattggcaagacttttttcttcaaaacagtcttgtaagatttccagaacattctggccttgctctgtgttaatgtcacgtgccctggaaggttgacaaaatcttcttct

SEQ ID NO: 70682 - DNA, 1062 bp, Homo sapiens
ataatctatttgctgtcctcgccagtactccaaaggtttcaaacgtgttctcttggtcctgcgaacatttggtgtgttggagggcaatactagtttgtgatggattctgttctttggtatcactttagttcgttttgagtcatctgaacttccaggaacttcctcatcatccacatcattattattctttccagacattaaataattattattgagcctggaaggtccactttcctctaaaactgaagtcttatgctctccagaatccaagtttgactctgttggtgtattacatgtatatccactggtctgaggctttaggggaacattctgtgcagtcataatattatcttcattctttgagcttcctgtagatctagaacaatccagatttttcctcttagccaagtctgcctcatcactttccaatggctcactcaggaaacaactggaaatttcatcatgaccaatgatacctccagaacctttagcatttaaaaacttctgtactctttggctgtctttagttgctgtcttctgccttttaagtggaatagtttttttcccaatattcttagatgactgatttgttttcttagcagatttttgcctactgttgtgatgcagtggtaattcatttcttattgaagaattgctataaacaggactctcctctgattttaccacccaccaattagacggatgcctggaaattcttcgacttctcgtgacagttgaagtcacttcttcagacacaagtttgttcttggactcactagaaaagcgcttctttttagattcttccttatcttttctagtgctacttttcttgcttcccacaggtggcatctgtattttggaagcacaatcatttcccatctcttcacgctcttccatatttctgtctgaatttctttgaaatttgtcttgggtaatatgtgacatatgtatgttttcatctttagtctgtcccacatcgagctgttcttcagctggtttagccataaattttcttctctgtttttgttttatagtccttttgcttccagatgatttttctgc

SEQ ID NO: 70683 - DNA, 1049 bp, Homo sapiens
taacttttgtgatattcttgtcaaaattatatcttcaatctaataaaattaacaaacatgctaccaaaataacaagcctatagtcttcaagaacatcaaggtcaataaagacaaagagcaacctaagaactcttctgtaatttttctgtaagcttaaaattatcaaaataaaaatttaccaaaaataagagggaaaagggaatgaggcagctctaggtattaacaaaacattgtctccaacatatatcatgctaagtagactgaggaagcaagatagagaggcaaaatgcagaatagcaagaataatatactaccatttgtataaaaagcatatgagaatagacacacacatttgtataagcacaaaggattccccagaaattagtaatgctggttgcttctgggaaggagaaccaggttgccaaggactagaaggagatttcattaaatgctgttttgtaatgttggaattctgtaatattggaattctgtttcaggtacacatattaccaactgaaaagatacgtaagataatttgtaagaaacaaaaaactggagacggtaacatttcttttcagaaaatagtgttccagacagagcctctaagtaactgcagctgattttggtcaaatcaatgagtgagaaagcttgagttgactcaaggaagttattggtacttaaggtgacacaaagacgggtggccatttggacattgtgtgacagacaaagagcaaacatgttttccatttgttgttctttgttgtcacctccagagacaaagcactgacctaggtaagcatgggctttgttctttcttctgccaacagggatttcttgaaacaatggattattgttatagaacataaatagtttttttaaactggtagattactagttaatgttttcccttaatttcctcccttttgacattttatctcgaaatagacccgttgaagatgaatggtacaagctttgacattttaaattatgtggtaatgtttatatagggtgtggtttaatggaaatgtatgaaagcaaattccaagttg

SEQ ID NO: 70684 - DNA, 1057 bp, Homo sapiens
agagggaatgtatttcaaatgtacaaagttatctaaaatatgtactgtttggccaggcatggtggctcacgcctgtatcccagcactttggggggccgaagtaggcagatcacctgaggccaggagtgtgagaccagcctggccaacatggtgaaaccctgtctgtactaaatacaaaaaaaattagccagtgtggtgggcacctgtagtcccagctgcttgggaggctgaggcaggagaattgcttgaacccaggaggcagaggccgcagtgagctgagattgtgccactgtattctagcctgggcgacagaatgagactccatatcaaaaaaaaaaaagaataaaaacatatttcttcctccagtgacgaaactaatttgttgctgaaaatatcaatagcaaaaactgcaattttgcacaacctaataattgtaaaactggacaaaatatatgtgagttagctgttttcaggcactgacctacagagagtgtgaaaactatgatctttgcaagaaagaaaacatgcaaggtgatgatctccttggctttcttcctgggagcacttttcctgctgcacagcagagaggtagagcagcctcagagtaacagcctggctgagctcaggatgtgcagagtgggaaactgtgagactaccagggatctctcactgctagactgagagctgaatgatactaatgaccatgcagggctggatgtctaggtctctagctccaacaaagaggaaatctctctgagcacttcagacattgagttgagacaccagaaaggccaggtctttaggaatcaggaccacacctgaaagaaagggccatgccctaggactaatttccaagctcaagcagacccatgctaccaaagaacaaaaggaagtgtacaagaacaaaaaggagccacctataatttaattgcctcccagttaaaaaaacgaaacaggctgggcgtggtgactcacacttgcaaacccagcattttggggggccaaggcaggtagatcacttgaggccaggagttcgagaccagcctggacaatatgc

SEQ ID NO: 70685 - DNA, 1057 bp, Homo sapiens; identical to SEQ ID NO: 70684

SEQ ID NO: 70686 - DNA, 1073 bp, Homo sapiens
catctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgtccaactttacggataggttgactatctaaataggcatttttagtcattaaaaaaaatctagtcaccaggaggatccctatgactcaaaataacttgtttgtaaaagaaaatttgtttacttacccattagtaagttcctgcatattcattataagatggcaaatcaaacttttctaggatgaagacagcttatttttaagttgtatagtcttagttggtttagggtctcaattttaattaataaaatacttggtttttatttgcttgtccttttgaattcctgttttaataattttaaaatgagcacaaagaacgttgaagttcagattaatctcttctgaatgatgtttttttcctctgtgatgagttgtttctgacttttttccttttgtatttgtaatgttgattaagatgtaaaataaaaagtgtgcctgattatttttgcaaatagattgtgattattttagcctatgggaacatactcctatgtatacatttataatggcaatggaagtaagttcagcttgcagttcttttacttatttgaaaattcagacagtggatatttaaaaagtcaaaattcccatattattttacaacgtgtcattaatcagcaagtattctgaaggggtgttagtaccattattttattaactactcatgagcaaactagaaatgatctgggatctctggggcccacttggaccactataaaaggaagcaatgggcacctggacatattagcaccaatttcactaccctgggtggaaaacaaaaatgtctgtcctctaaaccacatatcctcatatttccccggtccataaatgaaattcccttccaccagtggcctgtctcttcctctttagtgattcctaaatccctatacccctgtctctcctt

SEQ ID NO: 70687 - DNA, 1023 bp, Homo sapiens
agattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgagaacttgtgatgctctagataaaaatcaaatttggagttttgagaaatagagcacaacagcactttcgtcatgagctgacagtagtgtcaagaaagtcaaagagccttaagagcctcagtgaagattgtattttattttatcaaaagccacctagcagtcatctgtggagcactggaaagctggggttcattttggtatatcacactgaaactgggtacccagagtgctgctgtttaatatttcacaatgccttacttattggttgttttatataagagttttgtcaatatggtctcttcttaaaagaagttgactatgaattgaaacacacaaaacatttaagtgccagacttaatattaaagaatgtaaaggtccaagtaaaatgaggtatgatttatgttgatgtgtaagttcaccgcacatcccactttttaacaaaactcatgaatgtgcagtttgagccattgctattttgattacatagaatttgtatttcttttttagccagcacattaaattttagattttattttttaatctaatttttttctaatcaaaaagaaaattgagcttaaggcaaaaggcctggttttagagatatgtgtaattggaagagggcatttgtttgagtgtgagtttggaggcctttttaacatgcagacatacccatatttaaatgaaatggggagatatttacattccgtact

SEQ ID NO: 70688 - DNA, 1057 bp, Homo sapiens
gggcaaaagagtgagactctgtctcaaaaataaaataaaataaaataaaataaaataagataaagctcttttgatatttaccatgagactaattgaattcatttgaaaatagacccaaaaggaattatagctaatagctttactttaaaaacaacttagctttttatgctttctcttttgaaacattgctttcagcattgaattggtaaccactttatatgggaaattttgtgttatatttcttatgaaacattcccaaatataaatatctttggtttttatttcagattataataataatctgtgctcactattaagttggcaaagtatataatgacaaagaaaactaccattaagcatatcacacagacttaaaattttggtgtatatatttggaagcttgtgttctctgtgtgaataccatcattcatatctagccaaaccattggaactgtacacagctggggtttcagatatataacattcagttgatggatttaggaatgggccactgcaatttaaattgcaagatgggacaagaaacacttttttaaaaagtttgcatatatgaaggtataaggcatgggccatcaatctctgaccaggctggctgagaggaagagagcaaaggatcttggttcacaatgaggctgtccctgagaaagaaagaagtgagagtgaaaatgctgtgtgattaatgtcctcagcaactgtatgggaagtctgccttctccccaaaagggctataaaatgaaacataataagcagtggcccaagccattcttctgtgagacccccaaaagtggagagaaggacataaacagagaagccatttctccatcactcagagagagggagatgatgtaggctaaataggaagtgcatcaaatgacaatagtcccaaggggcaagtgtggaagacccaagttgagtggcaatggcaaggcagtgttgcagtaacaagcagccttgttactctaataactcaaagtgatgctttggattctctttcagaaaccattgcacatctcccctacgcagggactatgctaggcag

SEQ ID NO: 70689 - DNA, 4466 bp, Homo sapiens
ccagataactgtagtaattgatttaagttttaatctgttacagagaaaaacactaaaactttatagacaaatgatagacaaatggcatatactcaaatatttatagctgtttaatggcattttatagacatttatttgggttttgttcttatttttgtttttaattaagggagtagtggggtagatgtgagttcattgtggcattcagcttatatttgcttggctttttcatggtcggtgacaccctaattcctagcatgataaatagtaaccctttgtgcttgattttgtttaacttatttgagttgttttcaaaatacattctttttaatttaaaaaatcagctaagcttgtgtatggttaagtttttgttttgttttgtgtttgatttgttcttttagggaaaaaatcctataaaatggctattaaatttttagccaatgacaatgagattttcttaatattactttgaattctttacctcttaattcttagagtatgtggttttgttgttctgtagtgtcttactaaaatattcatttttttacagtgtattgcaagttccactgcattacatgcaaatatgattcactcatacctagctgtttgtggattcaaactcataaatgaaccatttttaagttgttaatagtgtactgacatatttctgtattttctgatatttacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaatggggactgaactttttggatattgatattgatttgaaaatattttggaattttttctacttgaaattttagaaatctaattgaaaattctataatgtacttgaaatgttatggttgtgttacagtgaatcactcttctaataatatgcatgatcttgcctctaaaatgagagtgggtacattgtccctactctccaacccactgtcctcaacccttatagcacaatagatcatttctgcagtctatgggaatgtaatctgctggttttagtacagattagtttttcacattagctgtaagagcttatttttatttcattatccatacttgtcaataccagttatctgaactctatggtaaaaattaataaaattatccatagttgttttttataataagttattaatataaactagcaactttgttgaaatactgagtaaactttaaatgatgatgaataccatatttttcagttagtataaatcattagtaaattattgagtatacttaagtaccatatttgtgacat

SEQ ID NO: 70690 - DNA, 3546 bp, Homo sapiens
gccgggtgcggtggctcacgcctgtaatcccagcactttgggaggccgaggcgggtggatcacctgaggtaaggagttagagaccagcctggccaacatggtgaaaccccgtctctactaaaagtataaaaattagctgggcatggtggcaggcgcctgtaatcccagctacttgggaggctgaggcaggagaatcgcttgaacccaggaggcagaggttgcagtgagccaagatcgcgccattgcactctagccagggagagaagagcgagacttcatctcaaaaaaaaaaaaaaaaatacattgtcattttgttctgtaatttaatccaatatgcagcataggaaaaactgaccttagagaatgtttttataaaaataatgttacctggaaaaaggggtcacaaaatgatgttttagatttgaattgaatagctttaacagtgtatatatgaaataaagtgcctgaaataagagatatacctcatatttactataggcagcttacttgcaaatgcatgtcattattttttaaatgtgacagtgatttatgcattgttcattttaagcccattactataaaactaatttatagaaaatctaacattttcatagatgaaggttaatatatattatggcatataatttgcatgagctaatttattgtcattctgcaaatcagtgaaaccagactttcaggttttccttaaatgtagcccaatctttacatctttgtgtctcttctttttcttaactatgtttctagattctgaggtttcttatctattttgagtacctcattaatagagatcatcttttaagtaagacccatactaagtgtaccatggtagaacaagcactgcctttggtggtcaggagacctaggttcctagtcactccatgagcaagtcactttatgtgccttgaagcctatttcaccttggtgaaatgaggtgggtgtactagaagttctccaagcagaattctgtagctgactacatgcttgtttctccctgataaacccaactgctgccttagagaatggatgttaacacataagctaatatacgtgtattggtgtttcttgtatcctttgtgttttctagggcatctgtttttgtttggcgtcatcaatcagtactaatccaattttaaactgttgcattttaaaaaaaatatgtaacaaaactattttcagtgtaaccttaatgatttttttaaaaattttatacattttttctcattgaactctgacagcattaatgaaatgtaaacgtgttttgcatctagtaagaccacctgccattttcattgtattcaaaataaataggactttttaagtaaatacatatatcagagcatggttttacaatgtactgtcttgaatgtcctgatgaaaatatgaaaaatgtaatcaggttaatttccatttaggaaaactttttatccttcaaactcaaatcttttgtgtagctaagagaagaatgtattttgctctgggagagaaagactaatcaacaggatcccattacttcattggtaaagatagtcggatactctcaccacttttaatacctttagtattacagttgatcagcttacctttacttgatatgatttatttctaagttcattcccctgtgttgtagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacaggtatgggcctggtagagaggtaggagagatgatgggagccagggctttttgacctggggaggaggttcgagtgtgctccttaaacttcctctctagccttcccaacccacaaattgtattctcttgaaaagtaatactggtgcctggaatgagtgagacttttaactgattatgaaagaatgtgtctatatgcccctaagctccttttttcctagctcccccatcccccacttcatctcaaaatgctattcttgcctatatgctgtgtaaaaagtgcctttttctttttatatgttgatagatggaatggtcctttctcttgttctctctctctcttgctgagcaagctgtcacaatctctgattccttgcagatggatgtagtgaatgctttccagagtggaagttccattcagggggctctaaggcggcaaccctccatcgccagccagcatcatgatgtaacaaatatttctacccctacacatgtagtgttttcctcttctactgcttctactactgtggggtgtgagtgtgtgttcctaagtgcatgaaattaacatttcctacttcacacacctaacgtttctcattttctccttaatgtttgaattcattgttcaggctttttcataaagctttcttttcgtaaagtggattgagacctcaaagtgttgtcgttgttgttttatttcttagagggctagataacaggtggaacaattgcaaccaaagattagatgcaatctgtgagcttgtctctgtgctaactctgatagttaatatggggaataaaattgtagcttagaacttgtgaaactactataaatttttgagtatatgcctttaaacatgtttatattgcatgtttcctaaaagcatgtgatttgaaactcatctaacagaaccaggaaattgcattttcaaagctaagaataaatttagcattttgacttttgtccaatttggaaagtaagttagtagcctgaagacaagttttcagtatgtatagccagttgcttgccttcttaacctgaactttgccttgctttgattttttttttttttttttttttttgcttggttgtgcagtggtttcaggggaaatcactgtgtaaatttaaaaagtttctgtggtatttatggtttggggtgttttttttttccatttgtatagacaatttagttaaaaattgcatcatagataagaaatgttctgttaagtttcagtagaagtaggaaaagtatactattgattaatcgttgaaccaataaatgttgtaattttcaataattgactaaaataacattttctttcaggtttttagtaaatagcaaactttctaaaagccttataagctataaatcttactgagaattcatggcgcattctcaatatattggaggcattaaagatgtaaaccccaaaatttacagagctacctaaggttagccttgaagtagacagagacctatcttttccatttggtctccagccagcgaaggactagaggaaccttgagaagctgcagagaggatgaattaagggagaaaacagtgcagactttccacttaatgcctgttttttccgtatttacttaagtatattttcatttgatattttttaaaatgtggtgaaacaggcacagtaagaactgtccctgttttacaggtgtgaaaactgccttagagtttaaataacttctctacgactaa

SEQ ID NO: 70691 - DNA, 1238 bp, Homo sapiens
ctttgggaggccgaggcgggtggatctcttgaggtcaggaattcaagaccagtctcgccaacatggtatattaaaatcctgtctctactaaaaatacaaaatagtgggtgtggtgatgtgtgactgtaatcttagctactccggaggctgaggcaggagaatggcgtgaacccggaaggcagagcttgcagtgagctgagatcgcaccactgcactccagcctgggcaacagagcgagactctatctcaaaaaaaaaaaaaaaaaaagtgggacattaaaagtaaaatattcacattgggagctggagactaagattctaaaataagattgtttcttcattgagtattttgagaaaggtttcatctgaacttcatgtttatcaaaacaatgtatgcgtagcatttaaaaggtcaagtagttctataagacttaatagcaagttccctgccacataccaaatttttggctcccaaaggaaactgttttagctgcttcttttacttagttatgtacctttatatctctgaatcacataattctggtgctttttgatttttttaatataaggctttaactactgactttcattaatgaaggtgaggacttagtgctttcacaagcatatagaccacattcaccgcatataccttcatgctcactacctatcccatcatctgccagcagagttatatcataatttagatttgatcaatattcagtccttactgtgacttactgtgactgtaaatgctgtttcaacctgatctgtgtggtctactgtaattacttttccttccttacacagctttttatgttccctataatttgttgtcttttacttgctttcttttaatttttatttggtttgtttgaatttttttggcttagtttttctatgtacttaactaattcatccccaaattctctgtttcatacatcagagacctttagcactcttaccaattttagtgtctaagagatacgtctctcagcatctttcaacatgctttaatctgcactcgctgtttgctagccttgctgcacagctgtcttcttggtctccatacctgaggattttctttattctcctttgtgttggatcttgtacttcatgaattcagtggcatcatcttctttggtttattcccttatctggtggagtcatcttctccagctgcttcctgagaaagggtttgtctttgtccattttgtattgtgataacagaatatctaagac

SEQ ID NO: 70692 - DNA, 3185 bp, Homo sapiens
gtaaaaccagaagggtagaaagccaaccagaaaagaattgcctaatggttgcctggggaaatggtgctttaaaaagccttctgtaaataaatactgcaaacaaattagtagatgacaactgaaaacgaagcctgagctaagtctggcagtggaattggaaagagattattgaaaatagtgcaagaaatgttgagtattggaaatgaaatcaatcattattaagtcattgtatcattgtcatcatttgggggactataaattaatgcagtcgtgtgcagtgaaatatttttccttctaaaaataccaaattaactttgtaatttttttttttaatgtaaaccaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagaggtaaagatttattattattttgtttttggttgacagatgtttaatatattaggaatttaactcaacaaacacatattgaatatgcactgtgttaggcaccatgcatgaaataaatgcagtctataccttaggaagcaaaatactagtgttctaagggataaaagagagaagtaataaattggtactaaagggagtaagcatttcttgctatgaatgctatataaaagtagcagcagtgaatctaggccaatttcagaagtacagtatgtataagggagtaatgggagatgagttggaaaggctgatatggagcatattttagggggccccaaactctctgaacttcttatgctaaattaaggaagttctattttcataggcagtagggggattttttaaatttggtctcataatgatatataaaaacagtggcttttaaacttgagtatgcatcaaagtcacctagcaagattattaaaacacagattgctgggcctgccccacagtattcgctaagatagatctgggtccatgcccaagaattcacgtttctaacaagttcccaggagtttctgattgttctgtggaccacactttgagagctactgataaatatgccagatagctcattaggatttaagaaactatgtttgggcatattttaactttgataaacacttatagattgagcaagagaggatagacaagatttggccaaaacttcgagtacttgcaagatcatctcctactgataagcatacactggttaaaggtaagtagatttttcagttatttcacaatttcttaatacagaaatgtgttctgcttcccagaatagtaatagatactgaatattagattgagtcatggatatcatctgttttaataaaatctaaatacatttcctttgataccttaggtaaattgtgttgttaagtgattatcttaagtgtttaaaacaggatattgctctgaatatacccatagtttctgaagtaggttctcacccaacatctaagcaatttccatttttatatttgtttatttatttttaaccttgagtctataaaaccgacgtcaggatattcttcagaatcatcttattaaagagtaatgtttttataacacaaatatttgcttgtatttaaggtataattgacagcactgtctcagaccaacgccaggttgtagctgtaactggtgatggtacaaatgatggcccagcactaaagaaagcagatgttggatttgcaatggtaagaatttactcattcaaatatccaaacgtaatttactgactggtttgtttgtttgtttgtttgtttgttgactaaattactatggattttaaacactgtccctcaagattagttcgagggataattaataagcttaaattggtttataagtctaattagtttatgcattagctttatttgatgtcatgaaatctgactagattgtttcttttgagcaatttaataatattgtatgttggctttgtattctgttaattttttaatgtctgtcaactcaactgaaccttttaataaccctttaatgcaggacacaggcttagaatagttgtgtgtatttaaattaaaaatataattgaaactcttccattcatctactcagttactcttcagttatttaaaaagtaattgaataccatcattttatatataatctttttttattgaaaaaaatcctacctacttgttttccccaaagtcctcaatttaagtattttattttctttgagtttcattttatttttggaaaatactggttcataatcacaattctcaaatctagaactatcaggaaactgaaatttttaacctaaattttgcagcagactcatttgattgcaaaatttgttctgaactgatgtgaggctgttatttgtcctacttagtgtgaatattcatagccattgtggagattttaatgtgatttttatggggtgctaagctcttttgggaaaattgagatataaggttatgtgtctcattatctttccaaactatgagagactgaattccgaatcacagtctggccctaaggttttcagatgagagattgtttttgtgtacaaatgtttatttgcataatttgtccccctgatattttgctgctaaaatggaaatttagaagatctaccatggtggcagcctttcaacaggagtgagagagatgaggaaaggaaattatgggtaaatttccctcaatcaaaagcagggaatccaaagatcccccgccctaccccatcccaaatttaaatggttggcagctgcattggtaggagcttctgaagacatgtgaagcatagctgaagaggtctatggaataattaagtgctcttccttttgctgtaggcaaacaggctcattccctttaggaacataggatcactcactgctgctcttgagcatttagcaggattcttattgctatttacattctgacagctgaccagaaaggcagttatgtaaaatgaattttaaaataaaaaaagctttcttcccaaaacttgaatgtaagacagatacaatgggctttaaataaatacaggtaaatataatcaaacaaatacacaatacaatggcttgttggttagtgttttttaagctcttcatggttttaggcccagttatac

SEQ ID NO: 70693 - DNA, 1507 bp, Homo sapiens
atgaacactttacaattagtttaagagacaaatatataaataaataactgaaggcagcatataataaattggtacaaagtttttgggtgagagatcacactgtagggatgtggcatttaagatagattttggtatgaaatgagaacttcgaggtggggaaaccacagcagaggaaaggagatgagaatatgcaggtcatactggggaggggaatatctggttgtatagttcagctgaatagtgatgggcttttgtggcacacaggccatatacagctttcttcttgccacagtacactcagttacctgatttcattgaaaaggttagaaatctgtttcaaccctggcttgctgggtagtagatagatggtttaggagagaattttttttagtcaaaactgatcaggcattgactctttctctgcaactaactagcttctggatatggggcagatttttcccttacttccatttttctcatctgagaaagcgggtgatgaccaccaactctgtggcacttaaatgaagtaatgcataccaactgtctagtgtgaagcctggtggacagtaaacatacagcaagtgttcccacagtaatatttgcattttgttgtggagactttttaaatgttgggctgagcagttaaaattgaagtaagccagataatgcaaatgaggtatttttttcttcaagtagtagaatcatcaaagctgtgattaaagataattcttgcatcagggaacaaggtgggttagagggaaaaaaaaaatcaactagagacatatcagttaaaaggctattgctattacaatagctgtagctttgtagcttgaagtaagaaccagaagaaagtagtagcaggagaaataaaaaggagtggacacattgaggaggctgttcagaggagaaatgtataggacttaggagctaatagtagagagatgatcaggaaaaataagtattaaggtgaaattttagacttacatcaaaatgattagggtaatgttgatgcacattacatgggcagtgaagaggcagcttccagtctttcatccattaaggtttaggtactgataaaacatctgggtagaatttttcagcagtgatggaaagctttgaaaaacaaaacagaagatgtggatttgggaattacctccctagaagcaggaagagatggcatcatcaagggagaggagtatagagaggcattatgaaaaacaaactttaaataggtatatagtatgatttttattcattatgtaatgaaagaaaaggtagtagtgtcactgaaaataacttttggcattaactctcattctgatagaatgcttattttaacaataagttattttttttctttcatggttaaaacaatataggtgatgaaacaacatctcaggtaaggggttgactacgcttggctttttaccttaaaagaagaaaacatttgtgattttggtattatttcaaactaatgtctgattctgtaccaaaatggtgaagtata

SEQ ID NO: 70694 - DNA, 1074 bp, Homo sapiens
ccataaaaattggtagatttaattttgaatgatttagtataaaagttaagtgaaaacaggaaaaggaaattaaaattaagttccactctgtattaggaaccaactataaacttcatacatcttatatcacttaattttggggtcataagtgctcctattttacagatgctgaagccaaggaccaaagcagttgggtaattgtcaaatttcacgtagctagtaactggcaggactgagattagaatccatgtcattctcaccccaggctcctttctaccttacttttctatatccttctttaaaatgttgatattagacaattgctttgtaattttattttagaatatcgcagtctgttttacattataaattaaacgttcttagagaaacgagatactagctactaaatgtttttctcttatagccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtaagagtaaaatgcttggatgaataaattgctgactatagttgctttatggagtatctactgtgttgttattgttgttgtctttttgtgaacatcaggcatttgataggacctcagagttttttagcatattttatggtatccagatatttgcccctgctattctgccattttcacactctagcttctcttatttcttagcattttgttatagggaaaataagctcattacattcaatctggtatgtttaatgaagtatactttgatgtttatttttagaagtcgatttacttgttatttaatatgcagaatcttgaaaagcctcctgggaagaaaatcaagtttatgtctttctttctttctttttttttttttttttatttgtttaaggtggagtttccctgtat

SEQ ID NO: 70695 - DNA, 1045 bp, Homo sapiens
gacaattttgaactttttttttttcaaaatgatcttgcaggtaaaaaattataaccaaacaaagaatgctgcttttgtaaattttcaaatgttaattactagttctctttaagaaacactgctgacagtgagcaatattaattaattagtcatcgtttctacctttgcactcttcattattagacctgtcttgataagaattttttttgcttactgtttgagtttattttcttttcaggcatttaacaactttcatttcaaaaataaagtaaatgtatcaaagtgataagatacagtataatcatctatctgtccttttttgatattttaaagtaatttgaaatatttggggtaaatacaagttttggacacatagaacagtcattttaccgaactgccattagttcattttgagtagtcattaatgatactaatttttcaattgattagaaagatactggtaggattgacttatgctttttgaatagaaaattaataagaacaagttaactacttttttaagcctttattagatgtttatctagctctgttaccaattactgttcttttcacagaggtatagtctttatggattctctgttagtgtttcacaaaactgaacatggtttctttactgcagaacttcatttttctaatctttaatatgtaaatcacaagtaatttaggaaatacacatccgtttttcacatattttttcaaggaaccagtttttttgcagtatcttgcaaattagtcatcacaaaaaacactttgtaaaataactccatatagtttttaacccattccacattaagtgctgagaactaattataaggtattttaacttaaatgccctgtgagactactgtgaaaactgttggttttttagaaatgattttttctgttgtaaatgagagaaagaagtgagatgcagtttgatgctaaggatgaaaatgccaagtctgccagcatatagaatagctaaaaaatgactcattctagttttgatatgttaactctatcagagttaataataaaaaaaaat

SEQ ID NO: 70696 - DNA, 1030 bp, Homo sapiens
gactcaacttaagtatttcaagtatttgaacgctggttattatatagttagtagcaaaaatgcataagaaacaaaatatatagcataaatgttactgcatttatttaagagtcatatatgcatatttctatatgcatatggttatacataatctctacattatggtcataaattataggggagggattatgttgtttagatgttacctaacataacacacaggaaaagaaatttagtattctttagttctcagtttaaggaccctgtatgcctcatcctcattacctagcacaacattttcaaatatggtacaaagtttcacaacctaacgtcactattgtcttattttctctgtgtagacacacacacacactcacaaagctgaatgcttatacctttactggtttctgtaagaaactgatttttaaaatttctttaaaatgttaatagtgatatgtgcctttaaagtatagtgaagttctatttgctcttaaatgtagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtatgatatagagaagaaaataaagtgttttatttttaagtatgctttctgcttaaaaattgtcttttgacacacttaaggctggaaattgttgctttgtgaatagaaggggagtttgaaatattttcagttctagctacaatgcaccaggccctttgagttactataggtacttataatttgctaataagtggtcgggttaggattagtgcctaagtctgtccagttacaagcctgtgcactcatctctgaatttctgcattaagtggagaaaaggcaacctgtgaggttatttagtaaagatgaactaattatattttaataaaatttcatcacacattttgctcatctttttactggttatggga

SEQ ID NO: 70697 - DNA, 1921 bp, Homo sapiens
tttccccctgagtcttatacactggttttattaatctagtctagaacattccccagaaattaacatctaatttgttgactccctttttttgttgttgttgttttttttttaaagaacagggcaacattttttcttctgtgggcctccagcccttctcccattcccttgactgccttagcgattactcagaagcagtccggggtaatgtgtctcagttccctcagtggcctggactgtggccgtctggtctctccaaacttgagctcattaaaagtagctaggtattatcttactatctcctcatcaatcttgagcttctattccttcttgaccatgtttgttccatgttttccgtttgaagatagttctcctcgataaagaagctagaagaatataggatgaatggttctcctgctctttggcatttttaatattgtagtgcctactccagacaataggcctgtcccttcattactttattgcttcagatatgctcatctttctgtgttttccaaatataagctgatttggagagctgccttacctggtagtcttactggcttattctatacattcgtattctagttttactaagttacctctcctatcttttgtacatattttgtcctcactctcatcaacactctcctgtgtgccagttgtctttttttttttttttttttttttttttttttttgagacggagtctcactctatcccccaggctggagtgcaatggcgtgatcttggctcactgcaacctccgccttccgggttcaagcaactctcccgcctcaacctcctgactagctgggactacaggtgcatgccaccacacccggctaattttttatttttagtagagacagggtttcaccatgttggccaggctggtcttgaactcccgacctcagatgatccacccaccttggcctcccaaaatgctgggattacaggcatgagccaccacacccgactgcccgttgtcgttttataacatcccttcctcctccctctctacccctgctcttcctcctccctctccacctctgcccttttctgctttcttggggttatatttgtatttagttttaaaactttttgtatcatatttaggtttattacagcttataaaataatgaagtcctatggaaaaataaaacaaatatagacaccctaaattattttgcggtattctcccgtaggtaagacttagggagtgattgacccagcaggtcatcacaagtcaaatgttttctaatctgtagacacacacaccattgtgtaacaactgttatagaaatgtgaactacttctgcataatttagcatggctgtattcatttcttttggaaagctttaattcccattttgttcctacagataagaaacaagatggagctattgagaatcgcaacaaaggtaaatttaggaggacaaaagtacagtgagcttgttttcattatatccaaaaatctactgtataccatatttattcaaaagtaagatacatgtggcagggaaaatcaacaatatacgttagcttgggttaacctttcttcctgccggtgtcttagtcatgtcgtcactgcaatgttaataagattttaagtatgatttgtggtacaggttgagtatcccttatccgaaatgcttgggaccagaagtgtttcagatttcagattttttttttttttttttttggattttggaatatttgcatgtacataatgagatatcttggggaagagacccaactccaaacacgaaatttatttatacattgccatatacaccttctacacattgcctgatggtaattttgtacaatatttttaataattttgtgcatgaaacagttttgactattccgcatcacaggagatcaggtgtggaattttccacttgtgtcatgtcagtgc

SEQ ID NO: 70698 - DNA, 4868 bp, Homo sapiens
ggaggctcttgtagtaacctcattgtgatagcttgaactaagttgaactaagtaaatatgaaatggaaggggtggtgggaaaaattacaagttcgcttccaaaacactgaatgagagaaagctatagtatcacaaattgacccccaagtcatattaattattctaacttttaggttctggggttcctattcttattttcccagtattctatatggaatttatgaaattgtctatcagaactgtacttgtcagattgaatttatactagagttttgggaaagccaaatgtagccttctacatgtagtcttctgtcattgtcaggtgttgatagattgccaacattttatacattgtcagatgattgctgctgaaaccagagtcaaacctgtgatatccacaagggtcagttaagttagaatcacaactttagagcaaaacctaagtttaaccataactttttaagatttataaatgcatgccaaaagaagcttattgcaaagaaccagacacatttatattggccagaaaatcctattgcaaaaaaatcagagtaattacatttataaacaccattataaataggataaaagttccaattctaatatagacttaacgtttcatcaaaaaaaaaaaaaaatcttgagatgtgtataccttcagtatcctgtgccacttagaacattaggagatatacgtaatgctaaatgacgagttaatgggtgcagcacaccaacatggcacatgtatacatatgtaacaaacctacacattgtgcacatgtaccctaaaacttaaaatataataataataaaatttaaaaaaaagaaaaaagaacattcacaccctgtttggatttttctttgtattggtgtggttgtcatttataccaaatagccagaaagagcttggatatataaatataatgtatttaagtataatgtgttaactcattctacttaccttgccatgcttctaaggaactgtagttaatgttaaccaaataaaatctataacctttccaaaggagagggaagctatctaatcataccttaccatcacagattaaccagaccacaatgtgtaacaaactaagatagtctcctgtttgctatgtatactgcatggacttttatgtacatctcacttatttacatagtgcttagctcttcaggttgatttcctttaactgaactttggtcctttctgttttaacagagatgactggtaagctttatgtagactcaggttcctaacacaccaagtataccaggagaactctataaattttccacatttaagaaaagactgaaataactttgtagagtcccttatcgcagtatgggtgggaaagtttttctgcatttatttccctattccaaaaatgtactaaaaaacatgacatgcatttatttttaaatttactctcatgatgccatctctgactgctgttcttggcttcttaagtttagatttttaaaagcagtattcagttagtggtggggatatgaccaagacttaaaactgtttactttgcctgagcacattcactgccaacatctgattacctgtggtaaggcaaaatagaacctaaacaattggagtctggagaaaaccagaattgttaaaagaaataaattatctactttttcactatcttgaattatatttcttgttttccctgcactttcactggcaaagaagctaataactagtgaaataatcaatatggatttttaaaagcaaggaagcaaaggcctaaaaaacaatattggataagttactcagtaattaatagccaaatatggattcttaaatacttgagtaagtacatatattttatgagcgtacttagcaaataatccttgagcatcaacttggttcataagattatggtagatgctatgttcactgtgctccagaagattgtaaacaaggaaataaaatacaaatcaatgataacgtgtaaaaaaaaaaaagttgctttaaagcctgcttaaaactaacaaaaagattagacggattagaagccttttagtgaataagaaaagatatagagatgtggatgtacaagtcggagaaccgtaagcagacttatcagcattataactgaagaagaatatactctttatcctctgacagagctggactgaatctttgccttgacatttaatagttgtataaccttcaggccgagcacggtgactcgcacctgtaattccagcactttgggggctaagacgggagacaattatggagaccagcctgggcaacacatactctgtctctacaaaaaaaaaaaaaaagttgtataaccttgggcaagtttctagaaaatgagaatagtaatgcctgccaacttccaaaattgttttgcgggacatagaatttaatccatgttcccatctctgattcctagttttctgtaatgaaattttatgttagagtagtggatgagtaagtttgtaagattgggtcggtctcaaggtgaggactttggactcaatccagtaggcaacgaagaatcagaaatttttgagccatgagaagtatatgatgaaatcacaattttaggaagattaaaatggatttcaggatgaactgggaagacacagagactaggtagggggctattgcagttacaaaggcgtgctggaatgaaagcttgtgttaggtagaggttatgaggttgggtgtgggaaatgtgacattggttgtcattgatacatacgttgtttctttataagcagtgtttttctcagagaagtgtccctcataccttaggttacaattaatgagcattcattgaacccctacaaattctaggcagtatgctaagcactttacatttataggtttatatgagaaatgtaaatctcatatttctatgaagtgtacagacagggaactgagttgttaaaatttacctaatattacatggtaagtgagtagtagattgagctttgaacttggatatgactgattagagttaaaaccttaagcacaagaaataagttttatttaatgtcttactaaatgtattttattgatcaagacatggtggctcacatctgtaatcccagcactttgggtggccaagacaggaggattgcttgagcccaggagtttgagaccagcctgagcaatatagtgagaccctgtctctacaaaatttttttaaaaaaattagcagagtgtagtggcgtgtatctgtggtcccagctactcgggagggttacttcagcccaggagatccaggctgtagtaagccatgttcacaccattgcactccagcctgggtgacagaccaagaccctgacttaaaaatatatatatatatttatatatttatatttatatatattttttcctaaatgttgaggctgttaaaaacaatattactgaagtttgaaatttggtggtagcaaggagatctatcagtatttttaaaaacaaactatgtttttggttataggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaagtaagaataacaattttctataattggtatttggaaatagggcaaataatttgtaagaactagtaccttctttcaagagattctggtatgaaaaattctacaaaaagttaaaagaagatttttctattagacttaatagcatgggcctttagagaatacatcagtcccctttaccatggccagagaaattcagcatctacttgaatacttccattggcattcttgcatttattctctaggtgtagaatctcccatcatctgatcagcaaaatgaattgaactctcacggcggattttttctgctactttagcagtggctttctttatcagccatattatattttggtttcactgagctttcttttaatcttcttcacatttctattctactatacttaatgtgcttggtttttgaacacaagactaggacttcactttgacaccttacatttctcttgttatattcagcccatcattagatatcaaaatctttttaaaatgttgatccattgtatctactgtccctccaagtgttctgttatcagaaaacttgataatcatacataccatttatctgcaaggatcttacaagaaactgttatacacaagagacatctcagaatctcctagttaggggcatgccacttttaaaaagccctccccaccctgcttctaagtgtctgctataccacccttccttcacactcaggattacccctctggagtcttttccctttaggttgacaacattttacggtggtttagccacttagatttatttgatgttatttaggatagtaaacccatattgttgtttctcacatgaatattttgaaacattctaaaataactgcctggctaaaatcctggtttgctataactacagcagtgtttttaatatttgagtggtttgttttgttctttgagttttgctgttagctataaaatctctatttcgaaacaaaaatgtatgtgaaaaattctggacgcagatccaggtggcaagccccccattctaggttttttttctatgtcctccttgaagcagttctcaatgtgcttccatacgtttcttaaggctgagtagaacgcagtttgaaaaccagcacagtaatgattccatttattgaatgttttacatgcactatctcattaatcctcacaactgtacaaagtaaagacttattatttttttactgataagtaaactgaggcttacggagattatataatttgctctagatcaaagtgcta

SEQ ID NO: 70699 - DNA, 1405 bp, Homo sapiens
taataattaatatggttagctcttggttgagtgcgaagaaagccttagccactgctgtacctactttaccagtatcctcacatttaatcctcacaataactctggaatagctggtggtatcataatttgacgatgaagaaaccaagtctcaaaaattaagtaacttgccttaggactgatatttcatctccttcagtgtccttactcttaactagtaccctacctagactgcctccctctactgagattaagaattacagaagcagggaacttgaaagtgacatagagttcttatggaatactttgaatttaataaagtatttattgctataagtaaaattgataaacataattaacacaaaaatatgatttagacgtactatatgtatgttgtcatcaattcagaatctttttgataagcattttctttctttccaaatagtttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtaagtaagtaaaaagagcagtacatctgacactaaacataaaattactgtaatcttgtttataagtttagtatatcatgctttttattttaggtgatcttcttccagctgacggcatacttattcaaggcaacgatcttaaaattgatgaaagctcattgactggtgaatcagatcatgttaaaaagtctttagataaggatcccttacttctatcaggtaaaaatttcatttatatctttgaacactttcctctttcgcaactatgtaccattgtcagcaaacaccattttcctaagagtcaataatataaagaggaatctgtattttatgctaccttctactgttgtaatccttgcagactttttttggtaagctgacaaaaacattagaaaactttgaatgcagagctatattttacaaatgagggaccagagtccaaaaaatcaagagatttgagattcagcattcatgctagtgtaatgataaaactgaaatataggcctaatgatatctcttgagttggtctgttattctgtatcatgactatttttaatgcctattgaagtataaaattaaagaatgaatatatgtttaaagcaaattaatgaattctctgtgatgctctacaaaggacaggttgttttttcttaagaactggtaaaatccttaaagtttacctaatccaactcctttaactgctgaaga

SEQ ID NO: 70700 - DNA, 1433 bp, Homo sapiens
tatgtgtataaggtgtatatgaaacataaattgatgtttggacttgggtcccatccccaagatatctgattttatatatatgcacatattcccaaatctgaaaaaattaaaacatttttggccccaagcatttcagaaaagggatactcaacctgtacagagtatcctaaccaatagagaaatacattatagcgtggtagatttgctttaacttgtggctacaaatgtttttttctcctatctttccctttctcttttaaatttctttatctgccttttaaaaaatttgtttaaaattaatagttctgctggtagattctgtaactggtaggaaatctagcatgcattttggttactatatttaagtagctgtaatataaaacaaaccagtagtattttatgtatcaaaaggctgattcaccaaaatatttttgtgaaagcttcattcctataccctttcgagttgtgaagagatacttgctaactctaaaagttgggtaaggtaattatgttagtctgtttgcattgctgtataagaatacctgagactggctaacttataagaaaaggttctgcaggctgtacaggaaacgtggtgccagcatctgcttctggtgagggcctcagaaagcttatagtcatggcagaaggcgaagcaggagcaggcagaacacatggagagagagggagcaagaggtggccttgaggggccaggatttttcaaggacctgctcttgtgtgaagtagtcaccatggggagggcaccaagccattcatgagggttccacccccatgatccaaacacctccccttaggccctgctttcaacactagggatcatatttcagcatgagatttggaggggaaaaacatccaaactctatcaataattatgtaattatttataagatgtacctaggctcacgtaagactgtattctttctctttaaagaaatttggacacagcataaatcagtttttctgagattggtatagattaaggtttcttagaagcagcacgactgacatattgagcggcaaaattatttgtcacaatattcattctgcaccccacccccagtgaggcaaccaaaaacgtctccagattttgctgtgtgtcccatagggggcaaagttgcctctggttgaaaatcactatagataaggagaggcttagacaatattcttgtcactgttgagctaaattattttttaaacttttatttatttttgctaaataagtagtacctattttactgtttaaaaaaaataatgggggtgggggaagacagtccaaaggaaataatattcactggaaatcccatttcttagagattcctgctatacccttttatgtatatatcctttaagattttaaatatgtatccgtggtctatgtgtctatgagcactaatatatgtaaaggtatgatg

SEQ ID NO: 70701 - DNA, 1961 bp, Homo sapiens
tcctacatccagtccttaagtacgttgtctgatctccttccaaaatacctggcaaatccacttatccccttctgcctccacttctaaaacccaaatacaagcaccatcatctatactttataagcagcaacctcccaactggtctttttccttcaatcttgctctcttcaatttccttcagatagcaatttatgtgatttttctaaaatgcaggttagttaccactactctgctttaattgttttcattgcactttaaggtgagaatgccattctcctctccctagcccccatgttcttacctttggccactttttccattttgaccctctcttctttcctccagggtcactgggttttactacagtggctttgcttctggctagtaaatcttctaatcttgttttgatctctgggcctttgtatttgcttttgctgctgggaatgttctgctcgaaagtcttctcacccttgacccctggaagttcagacagaagccaaatgttagctccttagaaaggctaatgtagcccactaagagagttctattggcccttttttattgtcttcattgtacttgtctgtagttattttaattgtctactgtctacctccaggatagtataaacttattgaatgttcttgttcacactgactcctcagcatgtagaacagtccctagaagtagtaaatattcagtaaatatgtattgggaaacagactattgttacaaaactgttcgttttattatatttagattgtgtaagtttattaatagaaattaattgtccccaaaattgaattaataactatagtgttcagtcagtttataatttgtgttccacttatttaacttaagagttgccctgtttatgatttatgaactgtgtataccttctcttttggttcttcaaaacaaccttgtaagtttggccaactgatattagtgccctcccttgacccccaaagagttaagtgacttgcacaagatttcagtaggtgaaccggaacctaggtcttctacttcctataccagatagttttattggtatagtgtcctaggtgtgtgcttttgtgtgtgttagtagtttagaggaattataatagcatttaagacctttacttcccatatactctccaagatacgttttaaagctatctttagctctgtggctgttcttttcagtggtaacataaaatattggtccctgttataaccaatatgttaagatttggccaattattttttagtggtgataattatcaggtgttacaggtatgtcatatatatgcaattaatggtagtctttatacagtgtgagttaggctcatataaccactatctccatttttttttctttttgctggtaagagcattcaaacacaagacaagacaaacctacgcatagactaatctcatccttattactgcagtccattgctgccttgctttctattgactctgtcttaaagattagagctctttggaagctttcaactgataagtcttttttttttctttttttttttcaactgagaaatctaaaatactttccgtattgcccagtatggaccctgttatagttgcaagtgagatcattttctgaaatctttgaatcttgttgaatccttcaatgaagtaaataattactttaaagctatatgttcatttctcattatttattctaatgtatttatattccctcttctactctttgcctgcctgagcagtgagattaatagttaaagcacttaaagctgagagccttaacagtaatctactgttttcctgtcttcctcctttgatgttctcttggaataggctcttgccaaaaaaacaaattgaagttaggtttaatatgagaagtcaaaaatgatgttatcctggttatctctgccttcttctctagcattctttttctttctttctttcttttttttcggaaacagagtcttgctcta

SEQ ID NO: 70702 - DNA, 1220 bp, Homo sapiens
ccacctcagacatttcagccatttgttagctgggcagaaaactcactttcttgaagtctgctcttatcactagaagaagaaggagtaacacctcatgggattaaattgtaatgattaagtgagagaatgaatttaaaacaactagcatagtgcttggaacaataacagtaatactgagtggatcataaaattcagtcatgtgaagtgcagttttatttaataatgtaatctaatgtcttctgatgtacagttttatttaaaagttgtactttgatcttttatcatgcaaagcactttaaaagcacaagactggagttcaaaaatatttatattattaaattatctactttagctacctggtgacatttagaaaatatgcttacatgcataatactcttaagatagattttattaacttttaaatattttcttcttacagatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtgagttttattatgcttgtttttggttctttgtgcaaagagttctatatatttggcttataaatgagcatgcttatattatcttggcgattgtatgattatgacataattatagtgacattaaaaatgggttagttatcagattaatacagttaaagtatttttatattaacacataaatgttgcaaattaatttatatgttttagattggcgggatgaaatattttgttccattatatatactactgcttcctgtttatgataaaaagattgtcttccctttgagctatagaggatggaaccaggcttggatgcctcccagggatttggtggaaataaactctcagatca

SEQ ID NO: 70703 - DNA, 1034 bp, Homo sapiens
gccctccgcttgaatagcaggtagagaatacagatcaaagtcttagaatgaaggtcaagagtgtgtgaaaccagagagtttgaaggatcaccaacatgttgtgatggagtgggctacagttcaacacatccctgttgcccatattctttgcactttggtgagttaaccataaataaattcttgtctgatatcctcttaaaatagaatttaccttattttccaaccagattatttaaatgttttgcagaagtgagtattgatttactgaactgttctttaataatcacagctggaaattgcaaaagatcatcaactatgaaactatataaatagaacgagataaagaaatgggaaagtgccttcttcccttagttctctattcagttggtgaagaactgtaataaatcttattgaaatctagagtttttaattaagaaaacagaaagctcatgttaaatttacagataagagttatgcctccctcaatattgccaactttatttttgtgagctcttttcagtgacataatgagcatcctgtttccttaagcatgtaagtgtaggttcttgtgaattgacaggatagaagctcttaagaactgagtaggccgacagagcagctggtgtgacattcaagtgttcatgttgccttctagctcctgaacagaaggaaaaacacagttttaatttagaaatctcttctttgactatagctgaaaatttcaacaccagtgagactggaaaatgatagaacatttggttctcatatttaactggagatatagtatgttcttatatttggtaaactgcacaggattatataaaattaactttattttttgagcttttcaaaagcttattttactaggaaacttactgtaaagatgaaaggtttctaaaatgcctaaatagaacaatagaataggagaaaacaaagtagtttattttctgggagagcaaaagaaagtaggtacctaagattctctgttaaacttttaaaaatttaatttttttaggtgtttaaagtaatttaac

SEQ ID NO: 70704 - DNA, 1030 bp, Homo sapiens
aaaaaaaaaactgccttgggaaacagactctcaggtcttggctagcacattctcttccctgtagatttaccacatgggaaaccacgttataattaggaggttgcttagtgagtatgtaggcagaacaagcggtatgtttggaatgtgtgatggactcaggcttttcttaacttctcaaagaccggttagttacctcatctggcaattgggggtaataatattaaatactacattgcatagggcattgggaagattaggcgaaaggatccatgtagagtgtatactgcaaattgctaaacacagtgtctggcacaggtgtcctcctcttaactctggtaagtagtcaacattttaatccctcagttaggatacaaatactactgtaacctcattgtgaacgtagaaaactcttccttctaaatactgcttgaatgagaaaggccagattttcttttcctcttctaatgatcgtccttagaagacgatgtttgaccaacccatttctgactgttaaatgctttttttctcccattgagttaaactgactcattcagtctacctaatgtcagatcttgagtcctgggctccattttgctctttttaggttgcccattttgaatgttctgctcaatccattttattaggttgagctctatgaaattgctgatattctcctggttttcatccacaaaaatggcagtgtcatatggtttaacctgatataatgtataatgattttaaattttaattcctttcagatgatcctagcagttcctattccaagtcagttgatgaggtctgagcccccccaccccttttttttttttttaatgtataaggcctgaactgttatacttctttccctgtgatcaggttccaagaaggttcttctgttgtatgtgggcatgtgtcttttgtatagtgtatcatttttccttttctctttacatttagatcagaccagcattaaccaggcgaatgattacttgtacttccttaactgatagtttacgttttgcatttattatta

SEQ ID NO: 70705 - DNA, 1030 bp, Homo sapiens
aaaacctatttaactgtactgaacacaaaacaccttttttcacagcacaactattaacatactatgagatagcttctccagctcaccagtttggaagtctagtctagaggaatttggaagttcttaataggaatagagtttttgtgtttgagtttgaggataggaataagattactgtcaagattttggagatgaaagataaatgaagcttagaattatagttttgtaaattcagctaagtggaaacaagaggctaaacttggaaaggaaaatacaaatatccagttgtaatcctgaattgcatgtgggtctttcagacaaggtacagtatttcagtacctcaagtgtatacagataaccgcactagacttaatatgattcacagtagttgggtaatgaagggtacaggtagtgtttataaatataaatctatagtcataagtttgagtgccagtgagatgaaaatagaagactccagactctactgtggtgggtgtggagatagtggttgggtgggagagaggcagaaagtacataggggagccagtcagagacacagagaaggaagggtcagataaatagatataaaattagaattgtacacggaaggcaagagacgtgtacaaggcaagaggatttcgcgcgataggcagccatatgtgctagataagaaaggaatagaaaggaatatacatacatcagagggcccagtttctttttcttcctttttaaaattgtttttattttttgagagggagtctcgttctgtcacccatgctggagtgcagtagcgtgatatcagctcactgcagcctctccctcccagattcaagcaatccttctacctcagcctcttgtatagctgggattacaggcacccgccactatgcccagctaatttgggtattttaatagagacggggtttcaccatgttgaccaggctgcccttgaactcctggcctcaggtgatctgcctgcctcagcctcccaaagtgctgggattacaggcgtgagccactgcaccagcca

SEQ ID NO: 70706 - DNA, 1041 bp, Homo sapiens
agaagaaaagaacattggtatgaagtttggtatcaggagaaataagcaaatgaaaagagttgaaggaaccagtttatgtatttttatggaagtaagtagtagtataatgttacttccagtacagttttcctttgaaggtagtagaggaggatgcagagaagggtacatttgttctgtggcattttcagttgtaaaatgagtaaatcataagtttcattataagcttggtcttgtgttcttccatttaaagtgtggtgaatcagatattgccattagtgaattaagaggagaatatttgaaggacaaattaatctcagttggagactattccttaaaatgttcattagtgtgctagaaagatttgggagaaggtataatcactacctcccgcttcccagcatacaattgaaattaaactcctgtggataagtcactcaaaacagctgggctctgcctaggagtatctcaaaagctgggccctagatccatgtaaaatacaaggtgtttaatatcctacagggtctgtattcagtatcatttggcagtgacaaaggaagcttctgtctgctgatccttgtgtatccctgcacatatacagagtagttgttaatctttaaaattgcgaaatgcttttcaggatagcactgtgattgtttttgtttgtttctttgtttggtggtggtggtggtggtggtggtgtttatttttgagagagagtgacttctgaattttttggtccataatgcatacaagttcctacagagttttcttctgaggaaagaatttgatttgccaccgtgtagaaaaggctcactttttttgtgttctataataataactaaaaagtctgctttataaatttgggaattattcttttaacaatgagaatttagaaggataagtatcttgtaagactgtggagccagaacgttttgttttgtatgtttggcacagctataaaatgaataagctgtatctatttgcaatttttatactcagttaagtaaaagtgtcttcccttagggaagactgcattcccca

SEQ ID NO: 70707 - DNA, 1055 bp, Homo sapiens
tgcattggccaagggagttttgttggattttggcatttatttctctacttacaggtaatttgaagtttgtggtactccacttgctgttaatactggaggctacctatggttttatttgtacttcttatgatattgtgctttttgggggaaaagagagattgggatcaggctactgccattatccttctggctcagaagttccacaggagctttttaaaatcaagattaagtcttggtcctggagactgattccaacggtatgaagtgaattttttaaaagactagttccattatgtggatatagagctaattttagcaactggttgccttagaccagggagaggccaatatttttgtaaagggtcagatattaaatattttaggctttgaggactatctttgttgtgtattcttcatttttaagcctttaagatgtgaaataataaaataaaaattcttagtctttggctgtgcaaactcaggctgtgggtgattttggccaacctctgccttagaccaccttcaaaagtccttttttttccaaaagcttggcttaaaagttattgtaatgtttacctttttctgagagcctaaaatagtgattttttttttaatgccttaagtagctttggatctactctggagcataaaccaagaggtacaaactagaaaacatagaagtaacaatatgaaatgggaaatgtaaatgtagttgttaccatttagatgcttcagcaacagaggaactttatattattcctgtaaaacacctaactttacgaacactgtggatgcctagcatattgaccaccacaatgagtagcagctagtatgcatgtaaatgtgcgaatgagaagttcttggagaataagttgcaaatggccctccagagttgtttaaattttaaaaatttatgtcaaaacgattttgacttttgcatggctgaaattgagcctttctggcagtatacaggttcaattgcttcttaaggcaagtcttgatttttgttagtaagacacatgcaaaatagcttcctatttgccatggccagaggg

SEQ ID NO: 70708 - DNA, 1236 bp, Homo sapiens
tagactcaacatggaaaaaggggtggactttcctgttttgtgggctaagaatgctgggaagtggaaagaatgattatttgagtcggaaatatggctcttaagtttatctgtttgcaaatctgtctccctagatagactcagttctttgttgggacctagcatagtatgtgacatgtattataagtcttaacaaactgagtaataatcctgagtgatcactttctggttaattatgtttgacttttacaaattatctaggataaattatgtggtacattgacagaagatttttgtgtaaagtatttaataaaggtttgtctttataatgacaagttttagcttatggcaaatatcttataacccaattctggtgaataaataagtgtttttgacatggagaagagtttgagtatcatactaataacagtcacagacttcaaaccattgctttccttaaagaaaatggagttggcttatagactttaatatttgaggtcataaggataaagaatctgattttcttttttagttagaagaggactgattgtatcagaagcatgttgcatgtaacagttggtatcatttaatccatataatagccctctaaataggatgatgatttttttttccctgtagacagagaaatgaatcagtttacatgcccaaatgctgaatggcagaaaggcatgtgggcccagctgtctaactctagtccactgctctttctgctgtacacagttgagcctctcacatgttactagaagtttgaaataatgtcaaaaactagatcgtttttcctttttggaattaaaatgttcttggatgattcttaaagtgcttgcctaatttacccaaagattgatggaaaatgtacaagaggctagggatttggtttattcttattgattctaaatattgactgcaaaaaagccagatttaaatccagttctccttaggttgtgggaatattgtgccactcacttaaagtgacaagcagtgaagatttgatattatcctgattttaaagggagaatttatactaccagaagttttaggagaaaatagtaattcttgattaaatgtggtatttccagtgatagcaggggaaaatagttaaggtctgtagtagaaaagcacaataatcaagatcttagaaagcattcatgtcaaaattagtaagtggtaagtaataaatggtaaaatacgtgtttattagttttttttttttaaaaaaag

SEQ ID NO: 70709 - DNA, 1041 bp, Homo sapiens
ctcccttcctgaagtatacctgtggccctagatttaaattaaatgtttccacaagtgggaactgtattggttgaaggccttatttccgagtggagggaaagctcttttgagcagattctttggccatgccccttcaatgtatttgataccaggtaacccccccataagcagataccctaaggagttgaaaggaggaaactttgagtggtttgggggatgttgagagattatagtttaatctagatctgcacatgcacagaaggagtttgaggttgtcattaaaagtcatagattatagtggcattggggattttttaaaattaaggtgacagctgtaagtgggatatgagagggagagagaataggacagattatgtagttgaatataacttttttatatctagttagtagatacacatctttctctatatatatgtatttgaacattcagtgcaagtgtttcttttggctactcaagtaataattacttagaatagttatgggtataaaaggacgaaatgtatcaaattaattgtaccatgacattcctctaattttgaggtcagtggaaaccagtcttcttgtcctggaatgtaacttagtggactaatcgctatctggaatgctactggaatggggaggaatcaaagagaaagcagaaatagaagaagaatggagagaggtgtaggataatttttctcccagcctaaggctattatttatccagtttcctgaaccatgtaaaacaaagtagagaaccaggaaattggcagaaaagccctctaagccgccagaagttcatgaatcaagactctcagcaccttactccactttaggtgtttacttgctgtatttattcatattttaaatacattttgataactggtttgccagcacactgcagatgaaagagagcaaatttcagaaactagaaagactgtttagaatcaagcacaagtatcataggaactaattgaaaatttacattttagtgatggaaaaggaaggtttttaaagtaaaaaataagaattcacaaaact

SEQ ID NO: 70710 - DNA, 1042 bp, Homo sapiens
actagcatttaactctgcctcttgccaaacatatactaaaatgagaataagggaattcttttttaaaaaagccataaatccacaagggagaagagaaacccacaccaaaattttagaaggcgttgacttagtagacttaaaaagctgatctctaagtaatagaaaagcccagaaacaagtcagtttatagaattccctgagagctcaaagctgggaaaacatgggacccatggtgaagaggggacaggggggcaaaacgggagaactggttgaaattttaggaatttgatacccagatatctttccctctgtctgtactctgtgatctcttttccttcatccttgcagaaggctggaagcttgctttctggagaaggctatgcacactgggaatacagttgaaaaccagggtaccacactcaaaaccgagtgtttacctatttatgttaagatcaccagtcttcttccctcacccagctttcagaattctggccagaatagaagtgtcttatctaacctgaccagctcaaggtaaaagacctcaagaatcggacattggctgtgtctgtgtctccaaagaaaatgtcccagtcagctcaccctactgtgaaacccatattgaatccagaacttctatttagtttgtgtcctttttttctcataaacaaatttgttatagtcttactaagatataattggcatagaataaactttacacttaaagtgaaaaacttgagttctgaggcatgtatatatttccacagtcgccaccacagtcaggtaatcattcccctaaattttttgtgcctccttatcttccttcccttcccctaccccagctcctcctttcctcaggcagccccgatctgctttctgtcgctatagaataatttgacttttctggaattttatgtacatggaatcatacagtatgtgttcttttttggtctgacattcactcaccataattgagtttcatccatgttgtgtatattagtagttcttgttattgctgatgaggattcactgtatagatacacca

SEQ ID NO: 70711 - DNA, 1149 bp, Homo sapiens
ctccagaaattattcattttcctatgattagcacagctgagaccttacaggtgcactgctattgagtattctcccaaccttttaaattttataggtctaattgttggtaaggtattgtggaaggagttctaagacttgctcctgctttaattgacgttgcaataataatcataataaaattgttggtcaaagagtagcacaggagtggttttggtagtgaagaaaataaaaagaaatctgaaggtagagatgaatggaatcagcaaaagtgaaattggttagattagtaagttgtttttctactgggacactcatggatgatactgacatatactccattctcccttgctaatatctagatttttttagtacctctaatactaagagatttttaatttctttgctatacttctgtccttttcttctctattcatgctcaaaagaaagtaagtgctataactactcttttttgtttgcttaaaaaatgactcatgaacttaaggtacttaagtgtggacactcctgacaactaataccatagcggagaactactgagttaaagggtaccagtgcaaatagagggctgaaaacaaggaaggtcagtcagtgaatgggaaagaaatatgacaaagcctaggaaagggagctcctctagcatcaaactgtctgcatgtcgagtctcagaaaaacaaggattcgtcagtcaacccctttctgcatgcacagtggatttagggtaaagtttatgttaccctgtctttggccgagcgcagtggctcctgcctgtaatcccagccctttgggagactgaagcaggaggattgcttgaccacaggagtctgagaccagcctgggcaacatgacaaaacctcatctctactaaaaaaaaaaaaaaaaaaaaatttagccaggcatggtgtcgtgtacctgtagtcctagctacttgggaggctgaggtaggaggatcgcttgattctaggaggtagaggttgcagtgaactgagattgtgccacagcactacagcctgggcgacagagggagaccgtctctgtctcaaaaaatagatgaccctgcctttgagcttaagcactactgtttttatgtacataatttaatgctggaacttgatcacctccggccctcctgct

SEQ ID NO: 70712 - DNA, 1627 bp, Homo sapiens
ttagtttaagagaaaaaagcctgcgcccccacctccctttttgaggaaggagtctgtaggaggaccgcgttccagtggcaggggtgtggggtgggggctgtgctctctttatcccatcctgcgggagaatcctgtggctaagctggttagcgacccctggttctgcgccgcggtcaccagccaggttggtctctgtgcgcatttcattcaccagttttctgcgggactcgcagcgctgggagtgctcgcaccctgtgcgctgcttggctcggaggggagggcagggcgtccgggtgggttaaaggggtctgcaggtacttggagggctcgaccctcctcgacaggctgatatttaccttttctttgggttagagcgctgcagacagccacctttcgcttctgtgcccgctacttttcttggtttattaataatctaatggcttctgttggtatcgattgctgttcgtgataaattagctacatagatttttttcatacgtgtgtaggtatatgcatatatctgaacttgtctgcctgtcaacatggaagcctttgttgtgtttaacctcccccacctgaggacagtcttattttaaaataaggcttttgttcagcgtgggtgtattttataataagaagtacttgtaagggcctggtttgtatgaggctctcatctggcagagggtgtgtaaccctttggatggtggcccacgtgagtgaatggagggccttcaccacttgccccgatgccagccttcccgagactccctgtccttgtgtgtggcaggggtggattgggggaattaagagggattggaggagaatctgctttttgtacttgtgcgtttcatttgggtcctcctcctcccctctctttttctttatcctcctggtgagttcaaatttgaagtaaatagaaacattttttttttaattgggaacctttgatagctagtatatgaaatgggcttatttagctatgatttcaggaggacgttttagtttttaccttgctttagataagacagctaaattgctgtaattaagggtggatctctgtcctgattttggcttgggtgtaactgcaaagatctttgaaaagtaactgttaatttcctaccatatagtctgcaaaagtgagtcacattcgggtgagttgaggacagagcgccacctttaatttaaaatttcgtgattttcttttattaaaatggtgaaaattcggggtacgccttcttgatttttatcgcagctgtcattattggcatccccattttgacgtgtaagggggaattgtcttcatttttctgtattctctcatttctcttttgagagaaatttctgcaattgtatgggaaatcttttttttattgaagcttgggattttagcattctgagatgagatgagaaactagttttgatttgtgtttataataatattgatggtctggatattcttggtaaaagaaggaaagtaatagctgcttttaataggtggtttgaactagccattgccaccaaataaaggtacctaccagtatgacagtggctttacaattttttttttttttttagctgtaggcctattaacagattctaaaataaacacgcaggatcagatatagta

SEQ ID NO: 70713 - DNA, 1088 bp, Homo sapiens
aatttttattggcagcaagggagaccccttcctgaaaaagaaagaaaaaacccaaatctatgtctaattcttaaaatatgtttcaggttgtagattttagcaatatttattattcaagcttgggaatatgacctcatttgccatggttgtttgcttattttaagaaaaatgcctttctacttcttgttgcaagccatcaggcaaccatttaaacatgcaagcaaaaagtctggatcatgggcatatttaaaaatctggaagacttcaataagttgtaaagatttacgattccatcgtgggcttgcagaaggggtttgctgtggccttctgtgagcaagggcggcctagtatatggtgggcataggccaaagaacttaccaaaaattctaccagagtgaagggagcacaaatagttttgggggaaaactttccttgtcttaagcaataccgtatacagtgtttagaaggaatgtcacctaggtttcagaaggtgaatttgaaaggctgaaataaagtactttagaaagaggtatctttttctttccaacatcaatttgatgcacacagggacagattttgagaagctctgtaattgctcccaggagttgagttaggttgaggtagtcaaccagctgctaacaatttagtttaatatgcagtcttagtaaattaaaggaatctgataaattgagacccagcatgattcttatttgtttgctatggcataacatgttgaacgccagcagaaattaacccattgaaatttttctactcaaggcccccattttattttctcactttcctgtgtcagatgtttttgctccagacttggtcatctgagcaattccttagttttatgcttatctacttaaaaaatatatatataacaataatacaaattctagaatcatgcttattttcagttttctctctgtgtttgtatttaaactccttgaaggtaaaaataaataaataaatgagtctgttactcctcttgtgtgttaacctttctacttcacatgtagatcatcttaaacatgcttgatgtagattttgttttctgtgggagctgagacacttgtgggagg

SEQ ID NO: 70714 - DNA, 1373 bp, Homo sapiens
gaatgcaatagaaaaaaaagggtctactaccacttttagtttctgtagtattggttaatgaatatgatactcctctctacagcccctctccccaacatccatgttttatggcaaaagattataggctcataaatgcagctggggccaataattgatgaatgcaatattttatgacagattatgcatttccttagacaggtaactgttacagaaatattgcttcttgattataaccaatcagataataaaaatatgtttcagttttactgagatgtttgattttcttaggtcttgttgtgccacaccaggaataaagcttaattaaggattcatttactaattgtttatcataaaagctatattcaagggaaaaagttacattgaatccatagttttctgggaggagaacatgggaacagtctgtttgtgacctgtatttctctgccaacttcaggacttggtaacctatacaggtttcctatgtgagaggttaaagtgtgggtccttctgtttcctaaaaaggaagcctataaagcaccacatcatcttttaattattttccatacaataaagccagtttaaggccatgaaatggcctatgagctcctatgtgttatgtaacattttcagtggttactgtagcaacattttgtcctttatggcatttcatttccatataaagtaatctgcattgttatgggatgctttgtcccatagtgatgaccataaaccatgctcaagggtctcaaacactgactccccactcccttttgttctacctgaaaggcgcctactaagcttcttcttttagtgactattaaagggggaaggatgccctgaagaggttcgtccgctgtccaacagcgacccctagaggcacaatgccttgaaagtggccaaaacctccaaaacttcaatgcttttctccaatcaagtgctgctgtaatttgcttaccttgagaactatcacagcattaatcaagacctgcctttactctgaaaacatgggctgcttttggtgcccaaaaacgaaagcccaaagtttcgggagctttactacctactatctactacacatacatttgttttctctttgtgagatttaagggaaccgtggaagaattgctttttattcatcatcaaataagcataataacaaatttgggcatagtcaagatacaacgcctttgatggcttttcgttagttttttgtttttgttttgttttgtttttcgcttgaaaaataagttaaaatctcaggaagaaagaaagaaaatcctagcgctttttcttttctgagcttgcaactgtttgtagctcaggcacccggatgattcatcccatgaaagccttgagcgctccatttgttttgt

SEQ ID NO: 70715 - DNA, 1016 bp, Homo sapiens
gtgaagaataacataaaagtcagaagggcttgctttgttaatgctaattaacccatttgtgcctgaagctgcaattttttgaatttttgcaatcagatcttggtgatgaccttgagcagcaggatataaataactcccagatgcttagcgttccaataatggaacactaggcataaatggatcaggacacctgtcctaattccattataggattgtactgaggaacgaatgcagtgataaataacacagttgttagaaaatataaactatggtcttttgtataatgcaaatctcagatatgttagaaatggcttttgtattatttatcttaatctaacgtagttttaactccaagactcaattctaccatattgccaagaattcctctagccttttcaaaatagcaccagagactgggagccttaaatcttcatgaaaatagggaagaagctgatgttctggctaacatggtcacttctgattttttcactatccagaagatccccttgacatctggcagttctcaagtgcttgtgtaccagtctcaggtgggaatctttggtcatgtttggaacgaacccagctgtggtcccatctcctggtagccatctctcacttctgcgggctcctgacatctaatattcaactctggagtcatcctgccttctcccacattcatctgaggaccagggctgtggttccactgccctagggcctatgaccaatgagcctctctcctctgggggaagactctccacccctggcttctacaaattcttccttgtcttctttactgcatgggcaggtgggacaggatgatttctttccatttccccatctcttcttctctcactgggcatcctgatggtggcacaggggcagctaggtgtcagggctgggacttgagcaactcaatagctgacaggctcagggagatagggaaatacatcactgacagcctcggcctcttcctctacaatcacctcattctatttccaaactcaatgctggactcc

SEQ ID NO: 70716 - DNA, 1077 bp, Homo sapiens
ttgtttgttgagagaacaaatacattagcaaacttgaagtaatgtttcttgcaatgtatataacaatattaagtaaaatattctttacttcatttcatagcctctgatctcaaggatcacaaaacacattgagtattttttatgtcactgatcactcccttttagttttgaatgtaggtattcatttctcttagaagggaatttgagacccataatccataaacagatcatgcatatgcataaaacaaatgtgatctccatggtaccaaatatacagggtatctgttttcttcagtaacttgattcagtggttttacatagccttaagattacatggtcagtcagaagtagggcttggatgtctgactattttccccataaacagaaggacaatataatttatagtccatacttgggacacctttgagagtgaatggggtgctattaattatgttgtaacaagagatgtaaacaaaaaacattctgggacatgtgcgacgtatagtcaccctactctatagaactgtgactctaattctcctataggctacattaagttgtttgcttaatatacacccaaaactgtaattccaattgatttcctgtggtttcttgggtcactgtattgagaaagatattaaggccgcttccagatgtcacagaaaagggtgctgtgtttcactggtgatgcctggtggctgacaaatgtgaatgaaaggacaatggtaggagtgcccctcacttatgattcctgatctagaactgagaatccacagctgtttgcacttctacactaggttcctaggaagtagttatttcctcaatattgactcctcctccattttggtgcttcagttccctttgtgaggatctggatttcatatgacttaggccattcataaccaagatttgctgctaactttctagactttataaatttgctacttaccatttccagttctagctgtgctactcaggattcttgatttcttgtctatccataccgtcacaattatagacttttttgtaaaatcacttccacctaattttggaattactgggcttccagtcctcatg

SEQ ID NO: 70717 - DNA, 1392 bp, Homo sapiens
aatcagtagaaaatctggctttgcctcacatagtaatatagaattttaatgataaactcatgaattaatgggcatttcaaatttttttttctagaagaattgaagcattttattttaaatataatagattatatcaggtatataataaggtataaggtgtcttgattatacatggtggaaaggttacttgactattttttatagttttatctagacaggctgccttcgtttgccattatattttcaacttcaaaaacgtttcattaagagtgttccagaaactttatgtacttagaatacctctaaaaacaatttaaaaatatgtctcataagggtgcttggaaaagcagttaattcatgtcaaaggctatatttttgctactttggaaaatgttttcattgtaaatctcttcaaaatgtatttttatgatagaaaatactcatttaaaatcaacaatggtaaacaattgtttaaatcatttagtaatattttaaatactaaaaaataaacccaacaaattatagttttaagaagataaggacagtaactcagttgataactaataactgtagaaatagagtaaatctgaacacagtagacagcatagaattttagagagtatttcagcctgtttctcagtatgtttaatagttatttcaaaaactatttattatctgtatatgaaatttaagttgatagcaatgttattttttccttcaatcactaaacaaggaaggaacatgaagtggccctgggtaatttgaataagacatttctttcctgtagggacaagtaaacttttaacagtgttgtttttccagttgctttcatcagataaaagcagcttcccactgtcctccacactcttgtaaaacctcatgacctagtttggggccaaatttaatctgtctaaatactacttaagaactggggagaaatgatcaagcagaaacttttgcttaatgttctcaatgcacttgggagtttgaagctcaaaatccatcccagctgcttgaagttcagctctcacaaatttcccatggtcactgctcctgaggaattctttttggttcccgtttcccttcctccttgtgtttgtacagggtcttgtgacaacagttctgtcatacacatactaaggtgaccaacctagttctcatttgccagaaactttcctggtcttaaaactggatatctggtgttcccagtaaccccttaaggcaggggcaaaccaggacaattgttaccctaacccagttcatctccaattccatattccctgttactcaatacaccttcagtagtagaatctgctgtggtataagaaagaaaagaaatggaagactaaatgaggacatgataatgaaagataataaagaagattttgaaag

SEQ ID NO: 70718 - DNA, 1003 bp, Homo sapiens
aattgatattagccaatctttaccactggccccatgttggactccatgttggccactgtggctactctgttgatgtgcccattgaacttgttctggggcacaggggttcaactaaaatgaataatatggaatcctgggtcaattatcaattatcaacagagtagccatagtggccaacgtcgagtccaagcttgggcccaacagcatgaatttttacttatcaaggccactaactacttccacttctaaatgactaatccatccacagtagagaccaaaactgagcccttatgtgccattattccttgagaagatcaacttcccacttggctgaacattgacttgattgagccctttctgtatagaaagggccagtggtttgttattccaggaatagacacccattctaggtgggtttgcctttcttggctgcagatcctcatccagcaccactaacagactcaaaactctgcacaaaataataaaagatagtttacttcacagtagagaagtacaggttgggacatgaagacaggatacactggttatattttatgccacatcatttagacactgatagtctgatagagctttggaatgaccaactgaagtctgaagctgcagcaccagcttggaagcaatgctctgcaatcactacatgcaggctgaatagactatgaaggccatggagaaagccctggggcagaaagactgagaacagcctggccagtgttgcagttgagatactggcagcagactcaaactactaaaagtcagaagtgagctgggctgaaaccagatggtttcactgctatattttaccaaacatttaaagaacaactaagactaatcctactcaaaatattagaaagaataggagagaagggaatacttccaaacttattctgtgaggccactattacgccaataccacaatcagacaaagaaacatcaaaaaaagaagactacaggccaatcaatatccctgattaacactgatgca

SEQ ID NO: 70719 - DNA, 2206 bp, Homo sapiens
agagtagctttcgtgaagatcaacatcctcacatcctgataaactaatctctcttagcaggaagtaaaaggaaactggaaagaggatgctgtctttatcttccacaagcgtaatgttatttttgtgatagcaggagatagaagggagccagggtgagaaaagggaacctaattctgcactatgattagctgaatgtgagcttcttgacgtaagacatcaaagagtatatgtattttattcctcataattcatttgcagaagttagaagttgtgcatgtgtttgcaaaagttaaatgtgtacatgcgtgtgtgtttgtgtatgtgttagaaacctttcttaatactggcaattaggtttttctcattagaaaaaataaatagaaacatagattttacataaaaacaatatcacagctatgaaaagaaaagaaatataatgacaagctttatttcaagaaaatataaagatgcaagaaacttttttgtcaaaataagataaaactggaagataataagataaaggataaaaagataataatagaggaagagtgagaaaagcaaaaaattgtgagaagtttattacaaaatgggtattgatggtttctttaatttcatacttttggagttattttgtattttgctgaaaggtttagctgtttgaacaaattattgccatgactcttatcagtcagacgtctttagggcagtcatggaggtatttggctcagatctaccttcaagagaaaacctgtcaaaaggaagacaaattagataacagcctccaggtgcaagtatgcctcaaatttgaaccaagaccttatgatacccagacatttttcagccaatgagtatggcaggggtacaacagaacctcaattttcaggcacaggactcctcaaagagcagtcctcctaaaggagatccccatcatgttggctgggattttgtcagagctgcagtgctgtgtgaggctcatcctatccaatcttctggcttccttctcacctttcataggagccaggcctttactacagtgtgaaagcttcctttggatgttcctgccttctttgcctttacatgtttaaaaggtattattctccaataattttttttttgcacttctaactcaatcttggctttccctttctagaaaaaccaagtgacattaattgatactggacacaatctgtgatatcagtgattaagttggagttatgcaagtggatcatttgccaccaaccagaaaataaggattcctttcaagtggatgtgggatatgaatattttttggcacaagacagtagttcaattggtaaaaatttcatcaatggtgactttggagaatgtcatgttgcaggtgaatgtcctaaccaggacaatattcatgcatttgaaaaatccagcgtgagaaacatagaaaggtaatgaaattgactaattattactaagttgcatttgtgggacaatgaaaattgaatacgttgcatttgtgggatgatgaaaaattgagcattgttaacaaaagcccaaatgtaagtgtaaaagccagaaggcatcttgggcagcctataaagtgtttttatcttttgcaaagagagagagtggccatagctggagaggaaattcaggatctgctgtttagggccactgagctgcaaagatgattggatgctcatagaggaattttcttaggctaaggtcagagatctgcttgggaaaacttgaggcattaaaatattggaagaggacatctgggtaaatttccccaaggatctacaacttgagagcctaaagaattgacccaccattctctatgaagagctagacattttctcatgcaagaagatacttcagaggccactttcacataagataaatggtatgtttatcaggaattactcccactttttctctaggcttctaggctaaaaatcatggctaaattccagcataacccagctgagggataaaaacatactgggactgataagtaagaaaagagataatcatttcattaagttcaataattagctagtatgtgctttcaggattcagaatagtatccatgagattggatgtttgagtatgccgtggtttgaatgtatccttcaaaattcatatgttggaaacttaagtcccagtgcaacagtgttgagaggtgagaactttaaaaagtagttagatcatgagggctgtgaaccctgaa

SEQ ID NO: 70720 - DNA, 1735 bp, Homo sapiens
ttataaaagtcacagaggagactctcctaagtggaagaataccaatatcactcaggtccaggatcctgtcttctctaggagaatgaaaagaaaagccataggctgggaaaaaaatacttgcacatcaaagacgtgtatccagactatagaaaaagctttcaaaattcaattattaggaagcaaacagcacaatttgaaacaaaacaaagcggaccaaagatttaaatgaatgtttctccaaagaagatgtatagtaagcaaataaacagaagaggaaaataataatgatgataataatttaaaaatcaacaaatttagaaaataagagctataagttaattcttgccgagttaggatcatctaactttgcaatctaaatttagacttcgctctaacctttggtccagaattcatcaaactgtgggcttctgtcaaattaaatataactattaatatatcctccctgcgatcctcttctgctgattttattcataggttttatgtttgtagtagcaaataacaaagtcaggaattatttggtttagctaagcatagagaatgatttaatatttgctttgggaagatagaaattttatctacttggttttggagttggtttacaatgtttcttagttgtaaaactgcagcggtcattcccatggtgggggtagaggagataggatgaagttgagtgcttcttgaataaccagttgagggggaaccaaggaatttttatgttgcactcttatcccaagtaaaagatggtctgattaaccattggacccatctgatttcttttagaaatatcatgcatctcagggattaaaggggaggttccaagagccaggggtcaggtccagagaaaaataagttctggagtgaactgagaactccatgagaaaaagcagaaaagccagatggcatccacatgagtcgaagtcttaataccttgattaggcatttagcgccaacagaggaaaggggcaaacagtttatgtattcatacaaagccttttctatgtttggcattagaagatgggggatacaattgtgacaagacaagacaatggtctgtgatttcacaagtttacaatttgcagtcagcatttgagatcatgaatataaggcttttatttttagtatctttcttacttaaaatcaggttgggtggctagaacttaaactcacagaagctagtcttaacatcaggccacatcctgaaaaccacaaatgattcatatacattgaggaatcatccatgtttccagagaaaagaatattgtcctagattaataaggcccaagtctcttccaaagtttctctcctggccaaagagaagatccaggtctttagtaacctcgggaacaagtcagaagtacctctttagggtgagcagactaattcacccacaaaccctttaattgtcttttagcaggcttgtatgccaaaatattttaaacaaagcctgtgtactgtgtgtttcaaattgttaaaacttcttgtatatctctttggatagaaaaatcatgagataaagagatattcagatgtttccatggcttcaggaattttcttctcatctcctttcactctatacaataatttggatatacatccattttatttgattgatattaatattaattattattttatttaaattactcaatggaccccaggattcaaacatttatttcctttaacatatttgtagccagtgattactgctgtaatc

SEQ ID NO: 70721 - DNA, 1027 bp, Homo sapiens
ctaaaacttcaaaatttagcatggtggcagttgcctgtagtcccagctacttgggaggctgaggcaggagaatcgcttcttgaacccagcagacggagtttgcagtgagccaagatcatgccattgcaccccacctgggtgacagagactctttctcaaaaaacaaacaaacaaacaaacaaacagaaaacttaggaaatgattgataatcaagattgattagaagtctagtaaagaacattatgcaagaaggcagggtatgtcaggcatatggggattataagcaaaatgcaaataatatactccttgcccccaaatgaagttattttattgatttttgtcttccttgatcaacaatgttctaaagagaaaagtttcaattaaatgcacatttcctttcagttgccaagtctacaaaaggaaacaagttgaaatgcaaatgagtagcactttcttggaaaaatattaacaaggaagctgtatgttgtatgctagcagtagccagagacatctgacaagccacttccaatcatatatgtataatatatatataatactttatattgttatatgttaataataaatcagcctgtctatttttccaactttatgtgtatgcacagcactttatattgagcagagagaaagcaagccagcaactagaagctgaagcaaatcctaccaacagggcagccagagtggtgagctaactgttccacatgtggcagattctttcttgaagggacatctgagccaagcctgatccaccggcactgaatcccaaataaaatatcaaactattgtcctgatttcacatcaaagaaggtgttgcaatgaacgacatcacataccacacaatccaaaagtaactggactcagagagctcgaacttctttctaaagacccagctgaagcaccagctcagagtgctggtggaaatggtttgaaaggattgtgtttattcccctaatcaacaaaaatttactattttataattttgtgtcaactgggctaaatcactttccaa

SEQ ID NO: 70722 - DNA, 2554 bp, Homo sapiens
gatttgcagctctggaaataacagaaaacttctctgaatgtcatagtctcactttagatcaaggattaaaagaaaatttaaataatatatacacttagtgatttttgtaaaacgctttattagaaaataaacatagaccattataaatatatgctattttgtgcacaagtgagaaacaaacatttgctgaaaatttcccaacttctaagatctctatgatcaaacattttgaggattttaaaaatacatacaattctcatagcactgaagtattcacggtggagatctctttggcaaggtaattattgttttcctctattatcaatataacagaaaaatagtaatcagatttcataaaccttactttgtgctagatacctttgctgggctttttgtatgtgtatgtcttcttatatttaattttgacaaaagcactaatatgctttttaagctccagggatcttagcttcctcttttgtaaaatggggataataatattacttgcctcatagggctattttaagaattaaagaaattaatgcatataaggtactaaggataaggcctgtgccatctgccaaaccccaaatggaaccgctagaaaccagctgagctagcagaacctaacttattaaacatactgtggtcaaggtcaataccattctagtaggataggagaatctcagaatgggaaatgtcagaaaaaaaaatatatagaaaatgacagaaaaatatatagaaaattttctatatagaaaatatatagaaaattttctatatagaaaatatatagaaaatgtcagaaaaaaatatgtcaggaaaaaaatgggaaatctcagaaaaaaatatataatatgcacacacatatatatagttttggctgatggttctattaggaatcttaaaaagcaggagactaattaggattgggcagctgatgacttgagagttatggattggtagacacagtaaggcaaggacattggtacaagtattaatgaataagtaagtagttggtcttataaaacaagttattttagttcatttatcttccagggacaattattttctgccccatgtttatgtatttcttaccaggtccccagaatcttttaacacaaaaacagaaaagtatgttggtttcagttctcacgtcagatgtactaagttcaaatatgtattagcaattatcattgtcatttttatcatcatttttttacagatgaggtagctgagaccttgaacgattgggaaacatgcccaaggtcatatagtttagatactgtaactgctagcatcttgttcatatctcagaaccttcatgttagtgtggaattaacaaagtctgtactataagcatctacttgctcaaatgaatcttattcagaaaaatgagaaaaactgcatacaggagaaatgtactcttgttaactataatgtgtcttttctcttggaagcagttaggtatgatggaactgaagtggcataggaatggtatgggtagcagtgaaagagtgatggacgagtgctgtggctatctcatcaactctaccaccatcctcccccttccaaaaaaacacacaaaaaatatatcaaccaggcaaagtttcgtttatcagacctactgcagtacagtacaggacaacattacctgtatggttagttctgtctttgaaggagaaggtcagatccaaatatctatcaggtttgagatctggttataattgatttaaggtaggtctttcaggatagaaaattgatgggtattggacaaggtttgtggcatacagttggtagacacagtgaggcaagggtcttcaagtagttctggtaagtaaaatgtttgataagtgagctatttgctaggtgagcaatctattgtcctgataggagatcttttgtttaaatttgcaaactatttgcccaaattggtttgacatatttcatgaaactaatagtaaaattattcattggccatattcatatctgccttggtgagaattctcctggaccaaacatgtaagtcatgctgacacaaggaagcttagttctgagtcctaataattaagatatatggatgtaggtggtttcagttctcaaagcagacaaagtgatggattatagttgtgctgattctcattcccaaggttatttatttttaaaagcccttttggtacaccagtcctctaatcaggcaaattatctgcatactaaaaaacataaaatataattaggctaaacaatgttatttaggccaacaattgtcttattattgtttaactttatccgcaacattgttaatttatgacaactttgttaacacctctaccttacaaaatgcaagtgtttattcccctaatcaacaaaaatttactattttataattttgtgtcaactgggctaaatcactttccaaagcaaaatactccctagtcttttcatttaaatatatctatgtcctttacttatatagttgtccctccaatatctgcaggtgattggttcaaggactgccacagataccaaactctgcagttgatcaagtctcctacat

SEQ ID NO: 70723 - DNA, 3102 bp, Homo sapiens
tctcttggccgatagtgctacatgttgttgaaggtctgtgagacacagtctttacttacacacttcacatggcttgtgcccttgcagaattaaagcacctttctgccttaattaaagctttacattgcagtcttcttgaacattgttattcacttttggaagtggtaggtgacttttcatgcaattattcttcaacaaaaaaactaataaattgatttcacaattacaaacaaagttctctaatggtgaaaagctgagcatgagtttccatttaattgcctatacctgaagatatatcccttcccttatgaaaggaagacaagagctggcacatggcagcctatggaatgggaaaggagagatctcgttaagagagtgagtgcttactcagaatcgtgatctcatcgaattaaatcttttcatactagtcattatttttgtgcccattttactaagtagaaaactgaggctcagctaacctcatataactaaaatgggtcaaagtcaataatggttgtgttccctcttctgtcctatgctgcttttagatccttaatgtaaagggtgagtgtgtcacttaagggaaggggtggaagaaagagactaatggttcacaagacagaatatctcttctttcctaggtcagtgctgctccctttaactaggagggcagttttggaagtctgaacacagcaccagtggggaacgaatagaaactgagtgagcagcacataggaggtaacatgattaagaggctgccccaacagctattgatccagccttgaggagacagactacctctttctcctcccctccagattgatgtaaatggattgaaaaatctgaagctgcctttcagatatgttttcccaggtatcacccctgtgaatcttccatcttctgaggttcattaatgacttattacattggctcatatcaatacaatatgaccttcacacttgtctttcattcactcgacaaattcttgctgcttaccaacttatgttccatgtgctatgctaagggcttggacaaagcagtcagtaagtcagccttggttcctgtctttgtagaggctatcctcaagtcactatagcaattgcacttgccaaaactggcttgtgactttttgtgcatttattttacatttttgtgtaactatgttacattttgcagtatgcatttttggagaatattaacaagattccctattttatttttgcattccacccttcctccattcttacacacacacacacacataaacacacacagtcctaaaacttattctccaaacagctatgaaatttgtctttctcactgtatctgatagtgaccataaactccagactccatagtgtaacctacaaagtccttctctatgtgactgtggcctgactttctagattcatctctggccattcctccttccaccttatactctatgtcacacaaagacactctagattcttgccaattctctttacacagaatgccttgcttacctttttcattagggaaacccttactgacccaattcaaatttccctttgtctaagaagccttcaccctgtcctccaggaaacaggtcttctcttccatgatttacatgtgttatagcaaatgctgcattgtattgcaatagtttgcctaactacatttcaccttttgtttcttgagttcctgtaagagaccagatatctttttgtttttgaactttcagtgcctagcaaagttcctgaaccctggtagggaatgaataaatagctaaattgatttcatttgaagtaagactgtggttaagaaaacttgattttgtttgcatgtgatgagcattaaccccatgcagaaatgttatttcactaaataagggtaccaggttcacattttttgatgactaagcatttagatgaaaatctagtcaggataagtcaccttaggataatttcaaataggcaattctcaacattttgttaattctggggtcaatgactggacaattaaaaaataaaatatgatgagtgacagtgcttaacattttagcatttcaaatgccatatgtaatttacctcaaatccagggcttggacaaaagttgcagtagagctaaatgaaagcccccacactcttttaaaatagctgaatgtagcccactcctgaggctgtttatttttacatgatatacaatgaaaacactataattaagaatgggtaaacccagctgtgctttgggttgatcaaatttcttaaagttgctttttgactgtttggagtctgtgaagacgaaagtctatgtttaagaattttccctcaatttttaaatcagtgtttattttaaaagaagtataatccatatggttttgattcctccacacttaactcatccaagtgcagttttgtaagaactatttgaagtcaaaagctttttaaaatttttatgagcttttttgtcttttgccccctcagaaaaggaagcaatacttgccaagtgtaaacaaagttaatcaccaaacagttttatattctaaaataatgaaaccacactgggtgctgaatttgacaaaacagttcttttatcctcagggaaattgttgtctaagctcgtagagtgactgccttctctgaagaagagccccaggtgacatcagcattgtattattagattctcagatcctcacagtaaagtagttgttgttttccagctagagtttactcacaatatctttattttgtcacagaagtcacccaagtacaatattaaatgtcatgactaccgagaaaagttagtgatagcgtatctaaatgttgatgcaatgctgtatctatgaatgagcatctcagggctgtcagaccttagcaggaaatcaaagaggataaaaaacacatgaccccatggaagctctcaaagtcacatctagaagagccctcagcaaactacagctcacagactagaaacagcctgccaactgtgtttggaaataaagttttatgaaatacagccacacccctacatatcactcacagctgctcttgtgctacagtagcaaagtggaatagttgtaatagaaaccacatggtgagtaaagcctaaaatatttactac

SEQ ID NO: 70724 - DNA, 1033 bp, Homo sapiens
ctctcaaaaaagaatcctgggcaacaatacatctggcactctgctcgaggaatttgtcatgtcattgacatgttcagcctccattgtccacaccaccctgacagcaggtcctttatatttcaaagaaattgcagcctgaattaatataattagaatgtaactgttattcactgcagaaactccttatttccagaagtaaagatctgatagcatgtctgtacttaaaatctttcccatgatggctggaggggagcaagcagataataaaatgacagaatagatgctatttcacgggctttttaaagtattaactaatggaaatatagggggagaagaaaactgttctacccttggcatgtataaatggaaacatcttttaagtttactagcctttatagtacttctataaaatatgttctgaaaagtaactaaactcagagaaataaattaaatcagaaaaattagctatctccaaaaaatatgcaatgaagcatgaagtagagtggctaattcatagacagaattacagatttaagagatggttgaataactttagtcatttttccctgcttccctttgaacagttgatgtcactaactaggcaactgtcaccaagttggtaacttgagtgctggatttttgaattttattctttgttagcattctgtttctacaaatacatgattactgatatagtggaaactgacattggcatttttcttttgaaaataagattgattcacattcttttaaataagttaattttctcactgggaatgactcatttgagggggaacaatggcctggcatatcaatgtgttggctggtgcttatggcctcttctctgaagaatataatgtttatccttgtacatgttatagaccgtttgtgtccttctgaaatttatatgttgaagccctaattcccagtgtaatgatatttggatatgcaagcctttaggtaattagatttaggagccttgagggtggagctctcatggtggaattagtgtccttataagtagaggaaaaaa

SEQ ID NO: 70725 - DNA, 1062 bp, Homo sapiens
gtgatccgcccgcctcagtctcccaaagtgctgggattacaggcatgacgcaccgcacccggccgagaaccttacttttaatacaattttatgtttactttgtctactcagccactagtcggttcttgctgacgttatttcaaaggctgaagaaataaatttgtcttgcccacaattactatgattctttgtttttgtttttttaatagaatccacactttcctctttatttgtaatgggtttcttggttctacatgacacacagcaccccttcccaatcatgttgcctcaagaaagaaatagagaatatgtagaaaattaaagcacttacatttggagttgaaagaaaagaaggcaattgcaaaagatctctccttattctgtaatggaagagtgcaaataagcacatttttcctgtccttctctaagatgctcctggcccacacaatgcgcttgagaataaatcagtaattctctatcatcagcactgcatttactcagtctctaggtatggcacctcaacaatgagcaaagtctgagcttcctctcaaacaaaattgaatttaatacgtttttgtctctaagattcctttctgaattttgaatttcttctttttttcaatctggttgttttaattttgattttagtttgaaggtaaatgtggctcctgtgtcttctctcttatacccaaaacatgtacatggtaactttctgaagaacatgggaaaaaatggctccttgttgagggatgtgttcaatagaaaaagaagcctggacatggaaagattctataaatgaaaggatctggaggatctctttaaaggagcctgtgaggtttttaaactttattttaagctattgtgagcctatgttagccagtccaggaacattcattgtaactaaacctcttttccttttttttttaaatttgttttaattccctttttatttcttccttctttttcttttggagatggagtctcactctgtctcccaggctggagtgcggtggcacgattttcactcactgcaatctctgcctcccaggctcaagcattcct

SEQ ID NO: 70726 - DNA, 1045 bp, Homo sapiens
tatgctttgaaaagcaatagtgatattatgtgaggtttcatgcagatctagaaattttatccaaagcaaacatttaccacaggtgccatgacaccttttttttctttttaagtcatataaatagattcttcaactgccaaacttgttcttgtaaatgctaaactgtcttgtctaattatctcaaaattatcttcagcaccaatatatctatttttctagtgataacagacccacaaccaaaaattccctaatgttaaatttgggaacacaagtaaaataaccatgttaatttgaaactgggtaccatggatacggatagtgattatagccttgtgaatctgctaataatttgttgtaataatctatggcatctctcccagaagatctctcagattcatcaatgcagatcaaagtttgtcctttatcaaaatgctggctatgattctttggctctgaaaggtatttttgcccttctcttttcatgagaaaagtcctaccttcatttcttaatgagtatccctttgtttttattcttcccacctactcacactgaacttgtcaacttagataggaaaatactctgccgtgtagaatgaaattaaaacatccaaatgtgtagttggacaaagttatttttaaccttagtcatttagtgtaacactttatgttaggcaatcaagttacgataaaggtaattgaaatgaggttgcttagtagcctatttcatagctcaaggtttttagggtattgttgagtaaaaatatatttcaataccttgagtacagatctctggtctaatatagtttgttttttcagtgggaactttcactagaaatttatttcaagggaacaaaatagagtcttgtgtgtatgtgtgtgggtgtgttacatatgtgcttgctgcgagagtaggacgggcagagttagcactggaaggaagaaagtaaaattcaagaaatggtgcaaaaggaagatttctgcatacatttgtgagtcatatgtatatgcctttgcccttcttaaattagtgtagagaaagtaatgt

SEQ ID NO: 70727 - DNA, 1050 bp, Homo sapiens
caggccttgcatcttattttatagagctttcctgagctgtgtgcctaacattgtggttttcagagctattttctcagtaaaaaaagagtccttcagatcctttgtctatattgaagacaccttaagttgagagatggagtaatgcaaccgaacatatatagcaatgtagccctgtacaaagcatgtttgcttccattatgttttttaatcctcacaacaaccctttgctatatgaagttgacttttcccagggtttttagtccttcaaaccattggtatttggccatgcttttgcaagagattttcaaacagtgatttttaaacagaactcagtggttctcaatcttcttaatctagagtggtgtgagtatttcctttactgcaaagaaaagcagcctttttataaattgtcagtttgaatttgagtttcttcctgtgatgtaacctgatgcaatgtttgcctgaatcactaataatgtaactgatttcccctagccagtcataaatgagtcagtgatcacggattcttttagtttatactcaagttgctttttctgtgtgcagatatcctcattgaatagcttgctgttgggcttgtatagcattatggtttacatcagggaagtagatagccagcagagctttgtgctaatttattttgcaatcctataggaaacaaaggacccattctttgttgaacctgaagagacttctagggaaaatcagcctctgaccctttcagaagtcttgcatcttaaagctcgtgtgtggttcaggccatgcttgaacctatgtgtgtagccttataagtcagtcagtgtgcccctataatgtttaagattgtgatgtaagaataagagtttggaacccattaaaacaagggttaggtggccagtgttgtcaggaatatttctctctctcaagccggtagtcattgttacaattaaggatggagctcttaggtaatatcactagatacaagctctttttccctctcagattcttgcacttttttccactaccctttaagtctttcagttattttttaac

SEQ ID NO: 70728 - DNA, 1290 bp, Homo sapiens
tacatatatttgacatacactaaaaattttgttgataggatgcatgatcagaaacatttagagactatttctttaggttttcactaaagtagatgaatatttgctctccccaaaataactcataattatgttctttaagtggtaagtcttaaaatgacaagttagtgtagcaatacaaagaggattgccttgtataagtttaacttatttgcataagtctttataataataaaactaagtcatcctttacagccaacagatatccaaattgtgttacaccaatttgaaatctatgttcccatatattcaactatgtgttgctgtgtgttgaaattcacatttttgtttctcagaagtttttttttaaatcttagggtctttgtaacattgatatgcatggttgtaagagaactgaattatcgaagttgtagatgggtgatttaattattttagtagttatggcttagcaagaaaggccctgtatcttttccctcttgttctgagccatccctaaatttttgaaggaaaagatgactaacaaattggactttatttgagaagattccataaatgaccataagccataaaatgattagacttgacaattgctttatgagcagatttgagtacactttctagtagttgtcttgatttatggcagttttgtcccaagtcagtagactaaatggagttgtatttcccacaaattgtacttgtgagtcttcaagttatcaatatatattctaatttgaccttccaacaactggatgaggttggcaagtgggtcagtattttttatcttcattttatggatagaaaactgaggcttagagagcttaagtaatttaccctaaagccagacagctcgtaaacagctaattcacaatttgaattcaggcttttctgatcacagaatccaaactcttaactattgttacattgtgatgcatgatttatctaccttcttttacactgttggaacatgtattttaacttctcattgtgagttggccatctttggttattttcagccttgaaactctttcactatgttccggaggcatatagcagtctacaattaggctcctttctttgagaggcagttggaatttagcataaagaatactagtctgggactcagaccaataagttgaaatcttgacttgtaccaacttgtgactttggaccagttgcttagcctctctgagcccatcattccttgtgtaataatggagacaagtcatttgttgtcaaggtaaacatgaaatcatatagctagtgaatgtttgg

SEQ ID NO: 70729 - DNA, 1053 bp, Homo sapiens
gataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttcaacttctgactgttatttatgagccttttcatggtatttatcattttagtattgaagatgcagtgttcttttgggaattacgtatgcttagaagagagtactgatgctcaaaggtgaaatgatttgaatctagagttggataaaaagggaaaggatggggaaaatgaaaactgggaagctaaactgagaaggaattgcaaggtttggtgataaaaattcatttgctatggtcatagttgtgtatcgagaggtttgcacagcacagtctcttggcagagtttaggaatctctactctggggattctgcagttcatgaatcgtcagggagactctgcattcaatttgtttctgtgaacatgcaggtgaaagtggtagtacaggtggaacttcatgggaactggttttgggggaggtgtggatggaaagcacaaatgt

SEQ ID NO: 70730 - DNA, 1020 bp, Homo sapiens
tatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctgg

SEQ ID NO: 70731 - DNA, 1006 bp, Homo sapiens
ctggccgaggctgcgcgcctgattcctgttttggcggctcaaccggttggttcctggagattgttttgtccggtactactgtgttatttctaaaaccctgcccgctttttccatccccgcacatgcacaacaacggatgcaatcctggacattttaaaaagttgatagttttcattttcgctcctcaaaggagcctggggtaggaggaatccgcagtgggagctaacgatcctaagcgttgtttctctgttcttcttttcttctatagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcact

SEQ ID NO: 70732 - DNA, 1367 bp, Homo sapiens
ccagacattgccaaatgtcccttaggatgcaaatcaccccaagttgagaaccaccagccagagtaatttcagtagaaagattaaaaataaagccagactgcagcaggtgccatcatggcagacacaagtcaagtcctccttggttctggtctcaccatcctgtcccagctgctcatgcgggatataagcctcttcctccaaaaataggatgcaatatttttggatggcaagtatttcaacttcctggtctcttttgttacactcaacacattgccagtatcaatgagaggtatgggtttttcacaggcttaactccaagactgtgttcgggaggccttcaaactgtggcccatggaaaagttttacagcattcccaggagtgtgatgaggacctggaaatgtgcataaggaagtctcatcttcctttgactgagttatcaaggagacagcttgagagatgatggctcattctgctgctatcctcatcacatatcccttccatgtgatcactctgagacctgtggtacaattcattggcagaggacctaagtactgtggactttgtgacttcatgaccatctatcagaaagagggcatcctagggtttttcccaggactggttcctcacctcctaggtgacatcatttctttgcggctgtgtagctcactggcctacctcatcaatacctatgcactggacagcagggtttctaccatgaatgaaatagagttattctcaagctgtcacaagatttttgctggcatgttgacctgtccctttgtgcttgtctctaatcttatggctgtcaacaactgtggttttgctggtggatgccctctttactccccaatgtatactgcatggatagattgttgatgcatgctacaaaagcagggaaatataagcccaggaaatagcttgtttttccagaagttcctcttaaggaagacttattcgtgtgatttgaagatgtggggcagagacagtgatatttctatagtcctagatacgcaaaattatggcagaaaatgttgatttccatacagtgtgatgcacttttataacaatcatttaatcttggggaaaaaaacagaccgcaaagggttatgagtgagcaggtagtgcaaagtgaagtcagcaacttagctggaaaaataaagaaggagagagagagatagtaactagaagagaatgtatgattaatggaggatttgggttttttttgtttttgttttttaagatgaaagaggctagaacgtgcttaaatgatgacaagaagatccaacaaagaacgtgcttaaatgatgacaagaagatccaacaaagaacctatatttgaaagtggctaacagatggagcaaagtct

SEQ ID NO: 70733 - DNA, 4113 bp, Homo sapiens
actttataaaaactttttaaatgcctcctctggttcttttgagagttccataataaattctatgtaaaatgtttagcatagtgtttgataaataggaagcattcaatttaattataacagagattaagttaacatattgaaacatatcattaaataatataccaatgacttgaaagctaatgtaccttcataatgtagttggtggtattcatgtagtttcataatacttttggtatagtttttattcttgaaattgtttaatttttgtcatttacagcatcactgccgacagtgtggaaatatcttctgtgctgaatgttcagccaaaaatgccttaactccttcctccaagaagcctgttcgtgtctgtgatgcatgtttcaatgacttgcaaggataatgggttatcacaacttcagagtaatattacactaacattagatttttaataaatgtacttaatagaggtcttggactactatttggtttggacactggttgcaatactagaccaaataggaattagtatattttggaatgttatggatatcaagtaaaactcttctatttttgtgagacttgggcttatcatctttcattacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatattcacagcaccactgttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagtttttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaactagttgtattctgtgactataaattgttttgtctaacaaaagagagaacactgtattaaccattttgcattaatttatttacagaatattaggactttgcacttggatatagacagtggtgttttaatgttgttcaatttcgaatagtaattaaattcctgatctcaagagaaattattaatgccattttgccttagacattccatttaatat

SEQ ID NO: 70734 - DNA, 1102 bp, Homo sapiens
ataatggtttttggcagactgatagagaaaagaaagcatatggaattgggacgaataaggaaatttcagctttgtctctagggcaccttgctatccctaaccatatgtgtctttcctgctctggtggagaagaagaaagatctcacattgtgtcactttagctcaccatcatgatggtcactatccatcatttcagcattttgacctttgagccaattcatattacatagatgcttgtggaatcagttttattaatgtgtaatgaaatatgttctcctgcctccattcccgaagaagcaaattgccagtattttaaatgtaataaatcacttacatttattttgcactacttttgtaatagatttccccccaacttttcctttttttcagcattccgaaataaaagaaaaggaagtaggaatgaagaagcatgaagaaaatgaggctaaacttaccatgcagattacagcattaaatgaaaacttaggcactgtgaagaaggagtggcaatctagtcaacggagagttagtgagcttgagaaacaaacggatgacttacggggtgaaattgcagtattagaagcaacggttcagaataatcaagatgaaaggagagcactactggaaaggtgattgatatctagtaaaattagtttatttccattgtaagtgataaaaagattgtcatattccatagtttttaaaaatagaagaatcttgagaaaagtgcataagcctctataggtatttaagtagccatttaaaaattaacctgtaaaacaatcagatagtcaaaattaatgtatcatatattttaaattactaaagtagtccattatctataccctagaagggtctttaaatgattttctaaaaaattaattacctctttgcaatctattccagatgtcttaaaggagaaggtgaaatagaaaagcttcaaaccaaagtattagaattgcaaagaaagctggataatacaactgcagcagtgcaggagctgggcagagaaaaccaatcacttcaggtcagtcacctatggatatgaagcagttttttagtctagaattggcttattagtgaaaagcatatttttaccttt

SEQ ID NO: 70735 - DNA, 1395 bp, Homo sapiens
ttttcacattacccaatgaagcaaagtaaccctaagagtttggatctcattgaaatgataatcaagagatgtattgatttagaaaattatgctcacaggtagtaaatttcaaaatatgaaagagtttagaagtaagatttaaagggattgtttattcaattatttttcttcctaaagtcctttcataatctgttatttttaacattttacctgttataagcatagatagggtacccattgaagaaaactaattgtctattatttgctttgtaaaatactaatttcttaaaaaaaggttagattctttcttgagagcactcataatgtcctttatgtctgtaagcatactttcattttggtttataattaattatctctttatgttcctctgtcctctagaatgtgacttccttaaatcagggaatgtgtataattcatctttatgttatatccccagaacgtaactcagtgtgtgataactaaatgatgaccagtaaatgttaagtgaggaaagggaaaatagagagtacagtttgtttttttttctccacataatcaaaacgtatacatttttgtcacctggatttaaatgattgttgagcaagacatactataatcttgtatctttttaaccaattctttaaaatactgaactttaagaatttcataagtgggtaaaacctatatttgatctattgtgataaattgcataaattttagccaaattttgaaatatttactatgaaggatgatttatttttggccctactttttcaacaggagataacaaatcttaaagatgctaaacagcttctaattcagcagaaattagaacttcaaggaaaagcggactccctgaaggcagctgttgaacaggagaagagaaatcagcagatactaaaagaccaggtgaaaaaggaagaagaggagctgaagaaagaatttattgagaaagaagctaagttggtcagtgagttaatcgggggaagtgtgttttgcagtagagctttaaatcaatccagtgagaggactgttctacttataagatctgattgaaatgctttcctaacattttagtttttgattaaggaaggagatctgatttatttacatagctgacatgtggttggaaatattttaccctgtaaccataattctgtttttataagtgaacattgaaatgaaataaaattaaaaaattttttttgttttttaagtgtcagaagctaaacaaccccacaactacgtagatctggtaaatggtgtgaatgctagtcatgttaaacccatttgttgggtcaaaacgaatgttgataagggggagcggaaacttgagtttgaaattatgatgaacaaagtctgcttttcctttcctaagttgcacatgccaaatgg

SEQ ID NO: 70736 - DNA, 1052 bp, Homo sapiens
tctgcagtgtatattccctgaaattcttggtaaattctaaatggttcagttcctgaaatttaatttaaaaatgttctgtgggtgtggtgatggtgaagctggaatgaaattcatgatttgtgcttcaagtttagagaattctgacagaactcttgttcataaggccaggtttgatggctcatgcctgttatctcagcactcccagagaccaaggaggagggattgcttgagcccaggagttcaagatcagcctgggcaacatagtgagaccttgtctctattaaaaaaaaaaatttagctgggcatggtggtgcacacctgtagtcccacctactcgggagaccgaggtgggaggatagcttgagcctgggaggtcaaggctgcagtgagtgagccatgatcataccactgcactccagcctgggtgatagaatgagaccctgtttcaaaaagaaaaagaactgttgtttataggagtttagttgtgtgagctttagatcatacagacttgctttggttttggctctatctctgatagattattttatgtctcttaaacctttgtttcttcacctagaaaatggagatttaaaagtctacatatactagagattaactgagataatatcctaactagataccttatataaagatagtgatagtaataaaataggagttataagagtaagaatcgtagttttgcagtatcattactctgaccaggtacaatttatctcacaatattaactataactatttaatctttacaattattttattattgttcacactgtataaataaggaaacagccaagaaccaagagagggtaagtaatttgcccaagttaggtagaaaagggcagagccagtgtcatcaatagtagcagtcatttttattacacccattttcatttaagtatttgctttaaaataattttaaaatatatcatttttctacagtcactgaaagaaaaagaactggtaaatgagaagtctaaattggcagagatagaagaaattaaatgtagacaagaaaaagaaatcactaaact

SEQ ID NO: 70737 - DNA, 1822 bp, Homo sapiens
tgaaattcagtaacttagaattctctttacaaaagatgatttatagctggccaggcgcggtggctcaggcctataatcccagcactttgggaggccgaggtgggcggatcatgaggtcaggagatcgagaccatcctggctaacatggtgaaaccccgtctctactaaaaatacaagaaaattagctgggcatggtggcgggagcctgtaatcccagctgctggggaggctgaggcaggagaatggcgtgaaccccgagaggcggagcttggagttagctgagatcgcgccactgcactccagtctgggcgacagagtgagactgtctcaaaaaagaaaaagaaaaaaaaaagatgatttatagattaatgaataatttgcttacaaattctaaaacaaatgttttcctaaacaaaacaaatgtagaattatgtcaagaaaaatttggaattacaaagaaatgtttataaaaagataatttttctaacatagttgaatcagaagtattatttttgttctgtgattttcttggctctatgtctttttttctgtttttgttgcttagtcaaagcacacatcttgtagctaattttgctgtaaacttaatggttgctcttcttacttttaagtctgtctgtcatcctctcttataagtactctttttttttttttttttttttttagtgacagggtcttgcccttgttgcccaggctggagtgcagtggcgtgatcttagttcactgcagccttaaactcttgggcccaagcatgcctcctgctttagcctctcgggtagctaggtctataggtgcataccgccatgcctggctaatttgtttttcttttggtagagatagagtcttgctatattgcccaggctggtctttaactcctgacctcaagtaatctttctgtctcagcctcacagagtgctgggattacaggtgtgagctgctgcacctggcctctcttatacatacttttatcatctctctggacactgcttttccatagtatatttctgtttgataagtaacattagcttactttttcttagacaaatattcaagaacctttattgctgcgtttcccatgttggggaacgcagcaataaagatctattatcccctgtgaaataatagggttttgctgtcaccccacctgaaacttgtttgccttttccttcatgtcttatacatttatatagagcagatggcatgtatcatatgtatgtattccatgatttttcccattgcttttaaaaccaggctcaaacttcattgtatttagatgatcttaactagctagctccccttgactttgctcattttttaaaaaaattgtgccttaagaaatttgacacacttttctattaacccattctgactcatgcattatgttttaactttcttagaaggtttttgtggttgttgtttgtttagttgtgtgtatttcatttagagtatattttgtttaaagcatgaaggctttgattgttctttcctatttcagtgtcatccccttccagcacactgcatgtaagtttgtacactaaaggtccactaactgactcaccaggtacttacagtagcttcttatcctggctggatgtcttacagaatttagttaaaattctgatccatgttttttgcttaaatatgtttacttaaaatgtttagtgttaatttttacaaccccactgagaccaggctttgacattagattaggttggttgatccaggtctttgattagaagtgttatttttgtgttttatacttgatagcattgaaaaatgacaaaatttaaggcaggtgattagc

SEQ ID NO: 70738 - DNA, 1065 bp, Homo sapiens
tgctttaatttttgttttgttttgttttgttaggccacaataagccagctaaggagtgaacttgccaaaggcccccaggaagttgctgtatatgtacaggaactacaaaaactgaaaagttcagttaatgaattaacacaaaaaaatcaggtgagaattttaaagctatatataatagcaaattgattttatgtattttaaatattaatcttacatactttaaaaaatatattggcatagtacaatgtgacttattttttttttttagtgtttaatatgttcacattattgtgcaaaccaatctctagaacttttttcattgtgcaaagttgaaattctataactgttaactctgcattactccttctctctagctcctggaagcttccattctactttctgtctctaaaatttgactaccctaggtgcctcatataaatagaaccatacagtatttgtcttttaaaaatgttgttttttaaattttttcaactttgggttactacatccaacagtatttgtctttttgtgactgacttatagtgtcctcaaggttcgtttgtgttatagcttctgtcagaatttgtttttaaggctgaataacattttgttgtatgtatatatgttattcattcatctgctgatagacacttggattgcttcaatcttttggctgtaatgccactttcaacatggctgtacaaatatctctttgtcacgttgctttcaattctttacctgtaagtggaattggtagatcatatgataattctatttttaattatttgaggaactgccatactaatttccatagtggctgtaacccttttatattcccaccaactgtaccagggttccagtttctctacatcctcaccaacacttactttctttttcttttttgagagtagccatcttaatgggtatagggtggtggtatctcattgtggctttgatttgcatgcccctaatgactacgttgttgaacattttttaatgtgcttgctggccatatgcaacaaaactgggtttcattgttgttattgagttgtaggagttctttat

SEQ ID NO: 70739 - DNA, 1052 bp, Homo sapiens
attgacttctttttgcctgggtatttttgaaggcatatagaaaatatctcattctaaagcatttgaaaattctttatagataattggctgttttatggattggaaattgaggatttaaaggttaaaaagtatatttatacaaatctacattattgaaaatatctaagctgtaatcaacttatatttggtgtagtatttaatggaaatgatttttaaagaattttacttttttccaaataaactcattgaatcccagttttaagtgctaaaatgttcatgtagatatggaataagtatgattatacccatgcatagctatgaaagtatttaaatatcttttaaagtatgcttctttaagagactagatgtgtaggcatgtttggtcattttaattatgtgctcagtgtgtacttttgtcagtcttgtctgccacctttcatccaccattttgttattactttttctgctttctaatggagatgcttaaacttgaggtaatgtgattttgggaggctttttaatattaataatacccttaatgtgtcaccttcaattgttatatggcaattttatgttttaaggcaatcttagagctttgaagacatgctcatttttgttttgctaatcatgcatagcttcaaccattttaaaatgattatttacttatagttgtagcatattaaaacaataattttaattctaatgcaccagcaggatgtttgcttgaaatatctttccttattttgtaaagttttttagtaaaaattcagtattgaattcaataacatttcagaaaaccaaggaagtgcaaactttttataggatctaatatattgtttccttggaaataaatatctattatctctttggaggtataattactcattcctttagtgagtctttttgggtcttccaagtgtcagggactactttaggtgtggggattaaaatactgaataagacagaatgcttgctcccataaggcttaatcctttgtggaaatcaaacaacagactgtacaagtacactgaatcatgatagaaagctaggta

SEQ ID NO: 70740 - DNA, 1090 bp, Homo sapiens
cccattctatgactagagttatgaaagatagggaggtgaaagaatttagtgtctccctccatcgtctcctcctgcaaacagggctttgtaagaaatggtgattttttttttttttctagaaaaggtatttctaggaaagaaggaaaatggcttagaaatcagttcttcgtgttttcatttaaattttcataaaaatttatcttttcaagtatttggaaataaatttagaaaggaacttatttgtgctgagtaactgaataggtgatttaatatttcattatatttttaataaaataataatacttattacctatttaattaatagatatgtagtgatgaatgagaccttggctatgttaaaatattttgaataactttaggaaatggtaacttaagagtcagaataatattattattagaaacaaactcttactcttttgagcaccagtaggttttggatactatgttaggcacttaaaacgtggtcgcatttgtttcttataaccctgtaagttaactattaagtatgttttacatgtgaggaatctgagaggcaatgagattaagtaaattgttcaaggtcacacctaatataaaagctagggttggaactcaggttttgtccaaagcctgtgtcattccctttttattatgttgtctcctaatttaggtggtctgatgattgccttttaagtaaatttgtgctattaatcttgtcctaaaacttattgttaattacttttctaattttgccatattgtgtgttgtaatatttgtattgggtaatagcttaaaatacttttgagttgtgtcataccatttccatatgaaaaaaattactaattacttcatctcatttatttgtttataactgcatttgttttttagcttttccttaatctgaatatatgacgttttattaatttattaaaattcaattctagttattttcaattaagtatgttagtgaattataggacttaatacaacaatttttattatggatgttgctgtttttaccaaacctaaatattggcatcagaaacaaaacacatacaaaggaattaaagaagctaaaaatttattttta

SEQ ID NO: 70741 - DNA, 1057 bp, Homo sapiens
gctcatatttattcggagtatttctcttccaagataaacattttcagttcttctactatttcttacatgacatgactttggcctgtaaatcccttgtataatatgtcagcatttaataaactctaagatgtataatacataaatgtgcttaaaaatcctagcctttgtcctttttactttattataggagacattttgttatgactactgttatttgtagtctttaagctcccttatgtaaagtagacctctgattttcatattttcagtttaaaaagttgttaccgtaacattttaatttgaatctcttccttagagttttgtaactggtgatctaaaagccactctattcacaaatataacatgtcatcaagctttggggtataagtattatagataacccatgtctaattcatttttaaaaatctttctttatcttatgggaagagatggtgaaagtttgtggatataacacacataggcatgtaaggccttatgatgcctaacactacactctctaacttatgatatttggatgcagtttttccaaaattgacactttgtagcccaataacacttaattccaaaaattttcaaacaatttcaggtggttcatgaacttactgaagccagttaaaagctcttgtcctactggtattattaatcagcagaagacaatgataaatctataagtacaaatgtgaaatcaaggagaggctgaatcaaagaagtctcatgaggaaaagtgctattcagatgttaatgtcaaaatacctaaaccagggtgaacccagtcatttatttctttgtatcagtaagaactatttttgtttagatatgtctgcctattggtatttctcaaattaaaaaaaaatacactcccttttgattaaaaaatatcttaaatgctatttgaaattttaaaataaatgtattatggtgactaaaacagaaccaaattaatgtcagttttaggaatatgtattttaaagttgagtcctctctgacttattccagctgcaagttttggagttatgcatatactttttaaacaaat

SEQ ID NO: 70742 - DNA, 1386 bp, Homo sapiens
attaatggaatttaatgatttcagagttgctatgtaaattattttgtttgtcctctagctgcctgccttcaaaggactggtgtttctttgtagattcttcttgaaatttagagaagatacattttcttctgtggcatgcttaaagattaaaaaggaacattttaaagaagtgaagtaaataatgtagtataaatgtaacacttggttatactattacatatatatgtttttaacatgtgcttttaggtaaaatatgtgattaagtacattaaaatgctaattattaacttaatgttgagtggaatttatgtagacagttaattttaagttcatttcatgtaattagaagtataaatttactgtatatatttatggttatctaaggaatgtgaatttgaattagagtgatatacagatatgcagagtaatatatggaaacttataaaactgtcctccccttaaactaatatttatataactatctttaattagatataaagtcaaagtatgatgaagaaaggagtcttcgagaagctgctgaacaaaaagtgacacgtctgacagaagaattaaacaaagaggcaactgtaattcaagatctgaagacggaactggtaatttaggaattatttattgagatgtactcttatacctttctaaattaaaaataaaatacataccctgaaggaaaatgtttaaaaatataatttgagtgaaatcaggaaataagcaattccctatattctaccacctgcatatatattctgtatatgatttttaaaataaaaatggaatgttatgatacgtaacttactaccttaacatttttgttgtttctatctaaatatcatctgtcattttagtagttttcatatctgcatctctgatcctggtcttctcttgcatgtttgttttataaatccatctgcttttagggtactttgtgttgaatttctagctttaatttcaaattcaacaagtataaaatcaaagtaatcatgtttcctcattactgtatttctgttattggaaccatacatctctaatactctcccaagacttaataatcttggatctgtccttgactttctttcctttatttagctctcaataaatatataaattaactacatccaacctggagcaaactctatgctttcatttgctccttcatttttattaccagttttgtaggatagaaaaagaaggaatgtagcattttcaagtcactgttatgaccaatagatgtagtttgtgaagggaaggaaaacaaataaagtagtaaagataattgtgaatttactatacagcaccttgagtattaatactattaaatatgaggtaggatgggaagaggaagtggcttattgtgggagaagatatcag

SEQ ID NO: 70743 - DNA, 1117 bp, Homo sapiens
acatatcagtatccccaataaacagtgagccttgattctgccacataatgtgcacaaataataaatgaggatgtacattttttggcatcagcattcaaggagcagtttttttatttatttatttttagtttttacgtgctcagagtacttattgcttagctcattttctcccttagaagattttataatctgtaagctattaaagatcttcttttttttggccaatttttgcactgccatgttcattcatatttcagtgaataaatatacaatatagaaaaatatagtatgtttaaagtaccacctgtggccattatggaaatatggatgaaaaaaatccaatatgctgtgtattacagtgagtataggaacttgacaagctaatgagggtgctcctggagggaaaaagcagtatacgcaaaggcacagaaatttgaagtatgatggcgtgctcagggaaacgcaggtattttagtattgttgaagtatggtgagggagtgtctggagatcagactgcataggttgttaggggaatggttatgcagaaccttgtatgccatattgatgataaagtttgctgaaggatattgaagaatctgttttagaaagattcctctggcagctctgtggaagattaattaggaagagggaagactggatataggagcactgtttctaatgttattgcagagtgtggacaagagatactgagtatccgaacacgagcagctgcaatgaggatggagatgagaagatggaaaggagaaatgtttatgcttaatgttttattagaaatgagtgagagggagagtagtgagtagtttagccaaatttttaggtttctagtttaggtgaaaggtgggcgttgatgagaaaaggaggtttggaaaatgagtcttgcatttgttgtatttgagatgcctgtgggatgcaggtagagatatatgttgttaaagatccagaagaattctggagtgagttattggctagatagatggatttgggagtcatcagcatgtcagtgatagctaaaaccattgcattgttatatacctgggagaatgctgagtcagaagaggaggaggtcaatgagagagccctggggaacagtgatct

SEQ ID NO: 70744 - DNA, 3100 bp, Homo sapiens
ggtgggcagatcacttgaggtcaggagtttgagaccagcctgaccactgaggtcaggagtttgagaccagcctggccaacatggtgaaaccctgtctctactaaaaatacaaaaactagctgggtgtggtggcatgtgcctgtaattctagctacagggaaggctgaggcacaagaatcgcttgaacatgggaggcaggggttgtagtgagccgagatcatgcctgtgcactccagcctgggcaacagagtgagactctgtcccgtccctgccccaccaccgccaaaaaaaaaaaaggaaaaagactttgcatataaacagttattgtccctattcaggaaaatatacagcgttagaacttgaatctcagactgtctcaatttttgttttaacacccctagacttgaggaaggtgacagaatgacatactctcataagtaacagtggatcagtccgaaaatatttctcagtatttcccagtatctgaggctgcacgtaacaaaggctgaggaggggagcaagttaggggaagcgctgcccattttcaggctgaaaagaatttctcagatgatcctgataatgtgttttctttgaaaatcactatggtattccaaaaacaaaggaaacatagcttttaaaaaatattttataaatcttataaaataatgcaaccttttgcaccagaaagaccaaaaattacttttttctatgaggtaattatgtatataagaaaggattcttaacaacatttagttatttgacacattaatggagtaccttttatgtggcagatattttggcaggtgagggagataataggtgaataaggtacaatctctaccccaggaggtttctatgataggtattatttgcaaaaagtgcagtggctaattcagcataagaggaactcaggaaaaactttataggaggacagttaaaccagagattttaactgtggtggagaaaatgggtgcatgtaggatgataccagttaaactggctgaagcagtgcaagcaaagctggaggcataaaagattcttgaaaatctggttagcattttatcacatgttatccttctggaccttgtgggtcaacttttcttcttgatggactagccaaaatcaaaagtaataatctcacctactctgcacttaaaataagggctttccttttttttttttttttttttttttttttttttttttgaggcagaatctcactgtgtcacccaggctggagtgcagtggtgcaattttggctcactgcaacctccacctcccaggttcaaacagttctgcctcagcctcccgagtagctgggactacaagggtgcatcagcatgcccagctaattttttgtatttttttttttttttaagtagagatggggtttcaccatgttggctagggtagtctagaactcctggcctcaagtcatcggcctgccttggcctcccaaagtgctgggattatgggcgtgaacaactgcgcccggccagggctttttcttttaactaaaaggatacttggtacaacaggagtaccttaagttccagttaaggtaagttcttagttgcagtggatatgagaaaggattacagataaccaaactctggaagtattgaatatattgttttaaatcttaagtaaattgtgttttttggaagttggtgacaaatttgaaatgactaagggaaataaatgtagctggctagttttagtgtgttattgttagctaacagcctttctctggaatttatctatctagcaacctcgatccccttggacatcatttagaaaaaaatagaggagtctcttatatcaaattggttttcaaagtccatgaactaaaggtcatgcgatctgttcatgggacatccctgaggcactcattctaaactcattatacttttattttaaatgaatgatgggttttaataaacttttttttttaatctacccatcccatttattgcaagttagcattcccagagctagtatgctaagaatttttagtaatgactgttgaaatacagagcaggcaaactataaaatgtggatataagaattaaagaggcttgccagaattaatagggtagaagacatcttttcagtgataaatatttatgtcttggaggtattagacaaaggtttaatatcatctatttgagaaggtgcggaattatatgtattttagaaagatttatttttattagaaatgtccccaaatttaagttttatttaaacaaggaaatcttaatcacatggaaaattcacttatgtggaatatttctataatgaaatgtatgttactgatttctgaaatttctcattaggaatgaatcatttatttcagggtattaatctggtaatttttggaagttgtaagaaggtatggcatacctcagtgtgatcattagctttctggcacacttaggtatctggagcccaaacctgaaagtggagccaatagtcaaaaagccacagttgtgaagattaaatcgtgtaatagggatgtagcttctccgaggaacactttttcatttgctttctagttattagcagaagttgagacacaaaagagaaatgacaggctaaacattatatgggtacatgtactgttgcactaaaggcatatctactagtgttgtacaacagtgggtaggagatctaagaatgccaacagatggttttgaagaaaaggagaataacagcagctagactaacatcctgactgggagcattcattcattcagaagacaatgttgagtaccatatctctggagcctaatggcattactgtattctgatgtccagaggcacatcctcaatactaccgtttgctcatttcaggagtttcataggagattattgcatttatcacctgttgtgcccctgcccttcattctggctctgtgatcagaacacacctagaagccttctgtttcctaaatgtaacatgactattcatagtgtttcctgcacctttgtttatgctcctccatttgcttagaatgcttttctctctgccaggtaaactcctatttattctttcgtactgaattccagtgactgtgtctctctctctctctcacacaca

SEQ ID NO: 70745 - DNA, 1241 bp, Homo sapiens
acatttaagcaaagcaaagtgatttccttaaggtcatataatcaggcattggttgagacccaagacccaagtccacatctatttttgacactgacactcatgatgttataacatttcatgcttattgctgtcttcattttatttactttctccctgatgctttcaattctagtctctcatcctattattcttttttttgtttgagacagagtctgactctgtcacccaggctggagtgcagtggtgtgatcttggctcactgcaacctcccccctcccgggttcaagccattctctggcctgagcctccctagtagctgggattacaggtgcacaccaccatgcctggctaatttttgtatttttaggagagatggggtttcaccatgttggccagactggtctcgaactcctgacctcaagtgatctgcctgccttggcctcccaaagtgctggggatgcaggcatgagccaccatgcccagcccctcatcctattattcttatttgacaaaacctcaagccatacatacatcagtataacagcccatattttaaaatatagatattgttaggtatatgtaatttaaaatactgtttgaagatggttttatttggctcagaaaattacaaggaagaatcatctgctgggaattatgggtgtggggaagaatgggatctcaacctagtggaatatagtaaagactaaaaattactttcattaaattactttcaaagagaacttctttgttgaacacattatatgacataaaagtatttgttatacttgccagtaatttcttgatctcggctgggcgtggtggcccacgcctgtaatcccagtaccttgggaggccgaggcagacagatcttctcaggttaggagttggagaccagcctggccaacatggtgaaaccccatttctactaaaaatacaaaaattggccaggtgtggtggcacatgcctgtagtctcagctactcaggaggccgaggcaggagaattgcttgaacctgggaggaggaggttgcagtgagccaagatcgtgccactgcactccagcctgggcgacagagtgagactccgtctcaaaaaaaaaaaaaaaaaaattagctgggcctggtggtacgcgcctgtagtcccagctactcgggaggctgaggcacaagaaccccttgaaccccggaggcggagatggcagtgagctgagatggcaccattgcactacagcttgggcaacag

SEQ ID NO: 70746 - DNA, 1031 bp, Homo sapiens
taatgcatcaggaatgtcaaatccagccctctgagctctcagtgactcaggaacccaggccttctgccatgacatccttggcatcactgctttgattatttcacaagctttgtctgcttgtctagaaagtggaaacctcccagaagaagggtcagcgaccacgctgaggcaggaggtagtgctcaggctccaagacctggcaataaagtgcagcctctctaaagcctgtagcaaattgaagttaggctgaagtgagatttgatctagattggtggtatctaaaattcatgtttatttcactcatgtattcagttggcttaaccttctctgacttctctgaggatgaaagccttacaatttcatcatttcgggtagtgggtactgtctcctggtatcgacaaccaaatggagacccctcatatccagctcctctcattttttttttttttttgcctttggccagagattcattttgcattcttcatctttagtactttattgaaattctgccactttctacctgttttggataagccttggtgtggtggttgctactattcttggacaggatacagttattgcctcctccatctctaaacaatgtttgtggttttttttttttttttcactcatgagtaagatacctgtctctttctgaagtgtgcctctgatgttctctagccatctttattgaaacataggctggatgcagtggctcatgcctgtaatctcagcactttgggaggatgaagtgggagaaggatcacttgagcctaggagttcaagaccagcctgggcaacattctgagacccctgtctctaaaaaaaaaaaaaaaaaaaaaaaaaaaagggaaaaaaaggaaaaaaaaaagaagacatagttacacaagtaatgttccttcttcttttttttttttgagatggagtctcgctctgtcacccaggctggagtgcggtggcacgatctcggctcactgcaacttctgtctcccaggtccaagcaattctcctgcctcagcctcccgaatagc

SEQ ID NO: 70747 - DNA, 1030 bp, Homo sapiens
aagtacttaattttcttttattcagtgtatttatattgagtttcagtaaatgccaggcttcatgctaaggggtaggaaacagttgattaagctgtgggtcctccctttagaactcacaggctgtttgggaggtgaacatttaaaagtaatgacagtgctatgtaatagaataatgaagaggacagaggacccaggaggcactctgtgggaggtgagggcaattaggaaaagcttcagggacgggggcatattcacagctcagaagagggaagggcatgtcaggcagagggaacagcaaatgcaaagagatggagtcataaaaggcgcaggtagtactgtgaggagtgtgaacaatgaagcttaggaagtgagatggtctgtagcaattagtaagagatgaagctaccgtggtggctagagaccaaattgtgagaggacgtaagagtccctttgaaggagttcagcttttatcttgtagttgggtcagtgttaatgctgagtatttaatagggacattttgataaatgtcttaaatctggtgatttactagtttagaaggtagaatatatattttattaactctacaagtggtatttaccaacaagtataacttgaatctttaaattgtgtaacatggcaacctattttacccctccctgctaatcttatttctcagcacagatattaagctataagattaaagctattgttaatttagagatttatttgaaatggactctgtgctttgaaattatgtggcattccttggctgggtgcagtggctcattcctgtaatcccagcactttgggaggccgagacgggcggatcacctgaggtcgggagttcgagaccagcctgaccaacatggagaaaccctgactctactaaaaatacaaaattagccgggagtggtggtgcatgcctataatcccagcgactcaggaggctgaggtaggagaatcacttgaacccgggaggtggagattgcagtgagctgagattgctccattgcactccagcctgagcaac

SEQ ID NO: 70748 - DNA, 1072 bp, Homo sapiens
tagttgttatgaggtccaaataaaatagtgtataaagtagctcccagtaagaactgaatcattattacttctccctttttagttgctgaaattcaggtttgtgagcttacgttgacttttaagcatctaaatagattttccattttacatagatgaataatgattaaaaatagcaaaagtaggattagatgaacacctgggatgaagcaaatccttaaaggaaaataatatgatctcaggatcttgaaaacatgtttgcaagatacatttttccttgagattaaaatcttagacttttgttatctcttccaaatgaaccatttaatcaatgagacagtttattggacaaatagatgttttccttgcactgtgccaaaaaacagatttgattgattttacaattaaattgagggaagtggctgatagtttttgcaaactcattccttgccctttattgatttttgtttaaagtttagccattgaacattacaataaagtaactaagcaagccaccttgaactgacaaaacaagggcactcactaagtgaaaacaccacacataatgataagacctgtcagagcacttatggattctgcatctgatcactggaatatgacgtctagagtactaggattaagaatctcagccttgaagttaaaaaaaaaaaaaaaaaaaggactcttaaccttttcctggcacagtggctcatgcctgtaattccaacactttgggaggccaaggctggaggactgcttgaggcctggagtttaagaccaggctgggcaacatagtgagacccctccccttcccatctctacaaaataataaataaataaataaataaataaataaataaataaataaataaataaaagaatcccagccttgaggttagctttggactatcaaagctgcctcaactattgctcatttagagagctcaaaagcttttttaagaactcgcttatttgtttcatttcctcttctgaagattttttttgcagatccagactttgaagaggctcctccctcctgccaggctcacttgcccttgtccttgctgtgacaaat

SEQ ID NO: 70749 - DNA, 1107 bp, Homo sapiens
ctgggcaacatagtgagattcccatctctaagaaaaattaaaaaattagccggacatggtgatgtgcacctgtagtcctaacaactgggaaggctatggcaggaggatggcttgagcccaggagttcgaggctgcagtgagctatgatggcaccccagcctgggcaacaaagtgagatcttgtctcttaaaaaaagatagagtgtggctctcggccttagcgccattttttttggaaacctctgtgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtgtcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcaccttttccactgttttagctgaagaattaaaaaaaaaaaaaaaaaaaaagatagagtgtggctcacgcctgtaatcccagcactttggaaggtgtaggtgggtggatcacctgaggtcaggagttcgagaccagcctggccaagatgatgaaaccccatttctactaaaaatacaaaaattagccaggtgtggttgtgtgcacctgtaatcccagctactctggaggttgaggcaggagaatcgcttgaacctgggaggcagaggttgcagtgagccaagatcgcaccactgcactccagcctgggtgacaagagtgaaactccatcccctccatgcccacattaaaaaaaaaaaatggagtttaataactgggaagaccacattagatgattttacatttgattgcatattgttagaacacatttttgaatatattaatgcatttaaaacatgaataaatgatactttgcatgtgttcctttttccccacagaccaatttttttca

SEQ ID NO: 70750 - DNA, 1818 bp, Homo sapiens
cgccactgtactcctgggcaacaaagcgagactccctgtctcaaaaaaaaaaaaaaaaaaaaagaaaagaacatcagatatatagaaataagtgtttaaagtttagtactggaggctgggtcctcatacctgtaagctcagtttttgggaaggccaaagcaggaggttcccttgagggcaggagtggaccagcctgggcaacatctccagacttctacaaaaaaagtagtattgagagccaatttcaccaccagtaatgatgaagctctagttctagtcttctgtttaacttttaaatgttttgtcttatataaagtcacttttgtgttggactgtacaactgaatatacttgcctgtgctgggaaatacgctatgctaatcagcagtatgccagactaatttttttcccttggaaaatgtgtccatggctagctcctgtagattaaaatgcatttctttttatattcaagcagaaccaagaccgaaagcacagaacatatgtttatgttctaacagtcactgaaatattagaagattgggaagattctgttaatattggtaagttcccttttgttatctgaatactctgttctaacagaagattgggaagattctgttaatataggtaagttcccttttgttatctgaatactctttgcttatattcctgtgtccagtttccatcctagatttttttttttttggtcacttttcatttagagcagggaagataattcaaatgtagagatgcatattcatcttaattattccccaacatattgttgtctaagtcatttatcggggagtaagtggacattacttatatggcttactttttaaaatggactgtcttgtaaccaatgtcattcttttctctaggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacat

SEQ ID NO: 70751 - DNA, 1659 bp, Homo sapiens
ctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccag

SEQ ID NO: 70752 - DNA, 1974 bp, Homo sapiens
gacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatacaaaagcttttgatgactggtaactggtatccttccaaataaatgcattgcttggtaacaaatgttagcttaattcagaatgaaatagttaacaaccctaatattgtaaaatttgaaaactgatagcagctgtcatttataacaattcttgggctgtttaaagggtacatttgactatagctaaggaaattgaatctcactttaaaaatgaaccacacaaaacttcaagaaacgaaatagaaatcaacatttactgcccgtaatattgctcatggttatagctagtatcacatagtgatttacaaaccatgaaattccagatttaaatctgttgcactacaaaaatgtctaaatgatgtctgctaaatttgtgagttatagaagtacagaaataagtcattttcatttcaaatgcagtgaatttctaatttcatggtatcatatttttttcctttgcagttttggtaagactcccccattactttgctaagacttgctttctcaaccagtgggatgaaacgagtgccagtgtgttgactgagccttcttaggacttaaggggctctgggagaggccaaggcagcagttgaaaactgcagcttcacctggcctttgggcctgttttccctggcccacacagtgtggctggttaaaacattctgaatttgatgccaacatttttaaaaattgggagatttgcatgaaaatccagaattcgggtaacttttgaatgatctgaagatctggcaacagtagacctgacccacctttgtgcacgggacttaactgagaggatctgagtagcagacaccctaagagcatgtcattgtcttctcaccagttactctccagttggctagagtcccctccgagcacacctgctagtccttcccccttgtaagcctttgactttgtaatccctgggctaaaggaaacacattattcaacaaaagtgtttcatgtttgcccactagttgttggggatgattaggtggtgagtgaatggcatggggctttcctttggggaccatatactctaatggggaagggggacagacaaatagttgtaactctgtcatggaaaagagaagtaacttggacagacttttggattcaggccagatgaacatctccaggcagagggaacagcagcatctgcaaagtcctgggagagaagaaaagaatctgaacattaagtggcttcctgaaaatcgactgcccaggccgggcacagtggctcatgcctgtaatcccagcactttaggaggccaaggcaggaggatcacttgagtccaggagtttgtgaccagcctggctaacatagtgggacccagtctttatttaaaagaaaattgcccgttaagaggcttttctaaaatcttgaggtgttgataggagctttatgttttttgacttgattgttgtagtctacttcgctgcgatttgcttctgctctagttatccttcatcctctcaaaggctgtctagcaagatcttaggtctaaagtaaagtcatctcttggtatttgtcgggaactggttctaggacttcctttggatatccaaattcgcagatgctcaagtctctggaataaaatgatgttgtatatgcatacaatctacacaaatcctcccgcttatgttaatatttagattacttataatacctattataatgtaagtgctat

SEQ ID NO: 70753 - DNA, 1048 bp, Homo sapiens
tagataagtgaaacagtaggaattttagccctttacttcttcacttaaagaaatcatactgtactctgtctttccaccaaagaatagtgtaaaaccagaaggtattttagttagtcatgtgttgaatagtggccggaaagattttatttcctagccagtttttgcctttttaggaaaaaagttgacatcagtttctgtggttgagactttttcagatgctgccatttcagacttgtttcatttagtttggattttattccttttttcccctcccacagtttatgctgtgggtttgttagggaaaccaacagtttagtgaaataattatgcatgtttttgtgtcagtccattagaacttgagagcagcatatattataaggactatttcaaaatgttttctacacacgaaagcttattttagaatgtgttccaattaaatctaggcttgatcaggtcacatgatgtgcttaatatgtacattctttacaaagaatatctgattttgagggtgaactgaagatgagaaagtaaatgccatacctatctctgccactgtgtattgagagtgattttgaagctattttgggatacgcttttggaggcctttctgtagctttttatagtagatacagagctgctactactttgtgtaactggtgagtggtggattgggactcttgggccctggctttcttttttttccagtcacccaatttatggctttctaaaaacatgaagacctggggtaaaattaaaggatggaggtgaggagagcccagaattcaaggaattttaccatccagttattttctcatttttctactcctgctattcatccctaatatcttaacttttttcctaaaaaatgaagaccagcctcttttgttctggtcacatgttaaaggacttcccaaggtcagaggcttcattattgcctcttgagctttttaatactctaaaaatgttttagtttgaacctaaagaacatgtcagtttctcacttgctcttacatcgccatgatcaaaacaaaaaactagtcttaaaata

SEQ ID NO: 70754 - DNA, 1004 bp, Homo sapiens
agtttcactcttgttgcccaggctgaagtgcagtggcacgatctcggctcactgcaacctccgtctcccaggttcaagtgattctcctgcctcagcctcccgagtagctgggattacaggcatgcagcacgaggcctggctaattttatatttttagtagagacagggtttctccatgttggtctcgaactcctgacctcaggtgatctgcccgcctcggcctcccaaagtgctgggattataggcatgagacaccacgcccggcctgacattactttttgtatagaattttttgaggggaaaatagtgatgctttaaagtttctgtacaaaattttacctattatatgaaataaattaaattattcataatgaccaggcagtaacattataacatgattgtcttgtgtttcactctccagactaatttgggagccactaatcattccatgtggctgttgagtagttgaaatatgactagtttaaattaacatgtgctacaagtgtaatttgcacagtgggcattgaaggctatgataaaagataaaatacatcattaatttcatactgatttcatgttgaaataatattttgaatacatttttagataaaatatattaaaattaattttacttgtttctttttacttttttatttggctactagaaaatttttaaatacttacgtggcttgtattatatttctgttggatagcagtgctgtggagaaaagtactcatcagccatttttatcttagtgtatctctaggtggccttatgatttgtaaggaagtagtgtaatggggagcttgagcaaaactttggttctatttctaatcccagctagaaaataggcagtcagttttactataatgagacattatatgtttctaagaatgttatgttatacaaaatcatgtagtaaaattcacagggcttacagataaaatgaagcaaggggtatgcacttgaaaatgtccattgatgataattaactttttgtttt

SEQ ID NO: 70755 - DNA, 1892 bp, Homo sapiens
ccccacgctaggtacaccaggctgcttagttgaatttaactgtctaatgtgaaattagctcctcctctaaaaggttttaagtagaagttctttgataaagagattggttgacttgtatgctctcctcttttgacttcatttaatcccaaagagttatttagcttcttaacgtatttaccagcccccaaccccctcctgccttggtctgctaactcttaaccttttcttcacttcctttcctattgagtttagacttcattttagcaaccaacagaagccagctttggctagtttaagcagaaatgatattaagagttattagttacctcacacattcttcaggagggccaaagaaaagagggagccaggaacaaacttcagaatcacatcacgatgatttcagtgctcacactgtgtgcaacacattctacagtgtgtgcggtgtgattattgatgtcaagcgcagaatgctaccactagaactctgctgctgtcttagtggtaactactgcagttctctccagaatgggttatttctttgcttgtgatgcgcaagaagtgctggatgcatactaccaacctcattttgccctaaatgcttccaggcagtccttttgtgtgaccacgggtaagtttttctttttctacaagttacttaaaatttttacaattttcttatctcccagctccaacattatactaaagagtgggagctaaaggaacatatgaatgagtgggggaatttttaacattgtttaatagttaacatagacaaatgactaaaattacacataagggcctgaaatgaattaccaacttgaaaaaaacaagtaaaattttatgaaagaaaaaacccacaatctacatcattttttacataaaagctggatcaaagaaaaaaaccaagttcactggtttttgctaataaatcttattattttagtgttcaccacataaaacaggcttttaaaaaatttccctaattttaattcaagatgaatacagaagaacatttcctacctcacctactaagttatatacccactcccagaacctaaaatatgcaataggtttgttaatagtgcctcgaggaccatggcacacagcagtcccaatgaactgtgttactaagctaggtcctttcttttcattcagcattctgagacatctctgtcaaatcattcctgagataacagagttcattaagatagacagctacattatttaaatcactaaagtcttatttttattttttgagctggtgctaagaaaagttcaggcaatgaagtgttatgtcattcatcaaatcaggaaccatagaaaatggagatgcttgactgccacgagtctactaattatagtgctgaatattcaaaggacatttttaccaccaagaacttcatgagtgttttatgaaggaatagttgacaccatctttagctgtgatgccaatatttggaaatctttgaaaaaacaaagagggaaaaaagatggagacgaggtttttaatctttccagaaaactttaaaaatgtctttagaaataaacaagaacataatagccctgtaatctggttctgctcttcatatattaatagtatcctaactcacacctcctgtaccttaagaccttgactactcacaatgaaataaactgctggatgccaagaagttttactcttccttccagttatttaataccacaatgccatgaacaaaatagcaatgagtaaacatttgtaagtaaatttatatttcaaagtcacgaaacattttagagcatgttgatctcatgcactatcaaagataggcaaaatggtttaccatctgataattccaagtcaaaatagtatataccaatttttcaatcaaatcagtttttttcctattttt

SEQ ID NO: 70756 - DNA, 1050 bp, Homo sapiens
aaatgggatgttttgggtaaataacattttgatttcattaaaattatcatatgtgtaatccattttccatgggttaggtaataataaagttgatctttgcaactgctaaattgaagttttattttttaatccaaagtatttcactgtataacttcaagaggcgccatttatgcagactgtcatacgaatggtcctctcctgaagctgtgcggtatggttagccctgagagaggatgcttactgtgtgggagacaaccctccaatatctgcatgctttcatgtttcctaatttatctcagagttagtatgcagagtgtgaaagactgttttaatttttctttcctgatggtttggattttatacaaaattgtgttactggtacaattggattgagaatgcaaatctgagcgaaatgtaacttgtttttttgtttgcttcgctgaaaagttcaactgctctgcttccatctgttcttgtcttgccttacctattatggagtcctcaggcattaaattttgttgtgattgctgcatttgaaaccagaagtaacctgaagaaaaagggtcgagtaagtaaatacatggtagctatactagtatagtcactagcttgtaggccaggaaaagtacctgtttatgccgtatggtttttaaagaatattgatttgtctgtaaatcaactagccttgaggaaagtggctgcagtgacacaggagtgaaaaaatgtaaacatattaaactgtttttaagggcttttgtctttatcagaacaacaacaacaaaaaacattctagaatgttaattggattttggttattaggagaatggctaattttatttagattaattttatgtatttctttaatgagcaagtgaaaaaaacttgggaaaaaagcaggtgcccttagcaacaaattttctctttatttagatattgaacgttggcataaataccaggatgacagttcataatatccttctccttcagcagggaagactaaaacagtaattataggcctaaagaatgttattacaaaaggggaccttccag

SEQ ID NO: 70757 - DNA, 2144 bp, Homo sapiens
ggggcagccggacagcggggacccggggcttccaggcggctgcccggcgggccagggagtgctgtcccacgccccggcggagggtggggcggcaaggctgggggtctctgggcttgggcgcgggcctccatagcttctgagaccacccccccgccggaggccgcgggcgcgcgggaatcgcggcggggctcgggcgcctggtggggattgtggcccgacaaggtccctcggcagccaagcccctcttctccgccccgacggggccgcggaggtgcggcaaccgcgggtgcagaatgaatgaaccgggagggtcaggccgggcggggccctgcgccccgggaagtggctctgggaggcccgcgcgtcctgccgcggtcagcacatgctcgcccctggttgccgcggctgcctgggtcccgggacgtgggggccccgcgccccgctgcccttgcttccgcgatctctctcttctgaatacgtttccgctcgtttatctctgcgaagtgattttactctggttggcaaactctttcagagctgttccgaggaaatagttttaacacaaggctgggggagggccgcagttatgggggattctctttctctctcctcttctctcctctcctctctttttcgtagatatgaggcctcgctatagtgcccaggcggcttccaaaactcctggcttcagagatcttcctaccttggcctctgtgggggatctcgtgaaatcttttgcccctcaattttgtgcgttttaattattaattggctgtttatgaatactgtgttttgacaagtatgtatggaaccatgacattttcgattctttgattttgtaaagtcttaaggaaatatcgacaagtcttcagacgtgagatattccttgtcatcacaacaactaaaccttaaatttttgtgtcggtttttatgaaggaaattagttgcacatttatgtgactaaatgcgccagttaaagtgactcaattgcagcatcattttgcttgatataacctggtgaacgtgtatgttaatcttgctcattcttgtgaaatctgtggggagatgcatactaagtggaagacctgttaggcttcgaggatgatgtactgtatactgcttcatccaattgcatttaaatatatctgagatgagggagatgtcactgacctaagggtgctgatgtagagaaataagacgtttttgtatggtagaaattcttagaaatgagagaagtagaacagattgtcagggagcactggagtctaataatgtgaatcttcatagtccgaaatttgttgtgtgtggatttatctaggattctgtccaaggagttttaattgtcatatgtattggcaggtccgtacaacgtggttttagttataatgcagtcacatggtccccaaaggtcatgtttattgaggccccagttgaaaaatgaatagggagtgatagagccatacatcaaatatccttgttttcgttgttacttaggttattgactaagtacataatgcaagttgacattcatgataattctctgaaatacatagtgaactaaacatttaacacgcatttttctatttttgattatgaagatatgcccagtaatatgaaagccttggatgaaaaaataaattctgtggaaccttgtttataaatttacagaaatggtttaaggcaataagttgaagtcctcatgattcaatccatttggcacacagtaatttacactgggcatttacattttgctgttgaaactaagacagtaactcatactgtgatatataatcttaattttacggtatcttgttgacaacatctatctaatgaatgacaccttgatttgggttttatcttactagtttagtgtcatttatagcttaaaaggatggttttctctaatccttaaacagaagactaaaagactagatttttaaaagtgtccatgcttgtgttatgtaggttgttccataatcagtgacaatgctttaaaaaaaatcagaatttatttttaaaagttgcctcttttctgtcaatcactatacaaacttctgtgtggtggatgggggtaacggtattgtcctgaggcaatagggacatgactttgttgattggactgttaatttgttttatttctgggt

SEQ ID NO: 70758 - DNA, 1523 bp, Homo sapiens
tcattgaagactattaaaaacaagatttaacaatggttatttgtcatttattcacaacaggccatgaagattgtggttttccccattttgtcattggagaaactgaggatcgtttagttaatgacttgtttaaagtttcccaatttggcagtgactgactctaaagtccttggaagcaagacgtttaaattttgtactttagtttcttcatgaatcagaataaagatacctcacatgattaatacgagagcaaaatgaaatggtggtgaaagtacgttggaaagttaaagactttgtacacatataagatggtgaaattttatctgggacttgagggcatttatgagttcctccaattgagtaataggctaaggataggccttgtttgatatttctttattattattattattattaatggctcagggcagacaactatttcatttaatcagaaacaggatagtactgtaaatgatgtagtatcttgtgtatggaaccttggagggtgtacacagccacactagcattaaaagaatgaatactctgtgtaccatttgtgagtgactgtttcaagagtaattacacatttactgagtattcattaagtggaaggagctgcactgggtcctgcagagaagtttgtatctaagataaatagtaatggacatagttccagtggttctgatcttatattctgtccatgtcgctcttcgtcctgttgttcaatcatgtggaattgccaagttgtttaaaagcattgcttcagttgacttctaggcagtgattcttaccttgttcttgtggtgtttaatataacttaaatttaccataggtagcactgatttttctttatctcttcagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaagtaagtgaaattttttttaatgtttaaaaacttttaaacttttaagaattaagaaaatttaaagcatttagttattgtatatgcctgtaatttgcaggagtgtttgcagcaatggaaagtgggagaaaacctaaatgtcagtcagaaggggaatggataggtcagatgtggtgtctcatgcctgtaatcccagcactttgggaggctgaggtgggaggattgcttgaggccaggggtttgagaccagcctgggcaacatagcaagacccccacctctaaaaaaaaatgtgggttggggaggggaatggataaattatggtacatctgaactgtgactgtcatgtagctgttactgacatggaaagatctccaaatagaaacaaaaaaagcatgtcagaaccacatctatatatatctatcatatgatcttatttgtatgtttaaaagatgatccatcatatgcatgtgtgcatatgcataaatgcagaggtaaaa

SEQ ID NO: 70759 - DNA, 1049 bp, Homo sapiens
aggcctgtttcatactaaacagtaatgttggttgaatgagtaaaactagctttaaatttatggagaaaatatgctcaaattaaccaaatctgttttactgtttggggtttttgcagatggagctttatattgtgtttgtcataaatctacgtattctcctctaccagatgactataattggtatgtattaaaattcaattgaagaaataatagtcttagctatagctgaaatgatttaattttatttcttgttttgatgtctgatgctttcttttctcattattctttccttaattttgtttttaaaaattattttaatgattttatttacccagtatctgggcttataaacattttaaataaaaatcattgtcattgtgtttcattgaatatttaatttgttataagacagacatgctgtttagaactgctatcttttcttcctgaagcatgctttagctttttggaaaagttaattagtttttatagggttcatatctattagcttaagccattattatcttttcttttgtttgatattgaataatcctaaattatacatacttaatttagccaccatttatttggtacttattcaatttagtcactatgataagaactaggaataacatatgacattgtcttttttctctgcagcagagtctgatatgcagaaactgcaacctattttcttaatctatgttgtttttattacaaattataataaaaatattttttcttctctcttgacactagttttatttttattttgttttcgagatggggtcttgttctctcgctcaggctggagagcagtggtgtgatcttggctcactgcaacctgagatggggtcttgttctgtcacccaggctggagagcagtggtgtgatcttggctcactgcaacctccacctcctgtgttcaggagattctccagcctcagcctcctgagtagctgagactacaggcgcatgccaccatgcctggctaatttttgtatttttagtagagatggggtttcaccatgttagccaggctggtctcaaac
